United States Patent 7,868,149 (PLANT GENOME SEQUENCE AND USES THEREOF) - sequence listing, part 20

SEQ ID NO: 9650 - DNA, 7748 bp, Oryza sativa
  unsure (1)..(7748): unsure at all n locations
agaagatgtagtaaaatttacatccaaaatggacaattataccttcctttcgtggcttcacttccatgtgtataccttatggttgtaaatatttaacatttagaaaaaatattggttaaacctccaattttacaatagcataagtttataaaatatactacatcctattcttttttacttgccgttttagacattgatacggatataatttacatattttatcattactttttctaaacatattttttacaagctataaaaacaataattatatgaaagttttttttacaaatatctactgataccattttcacgtgtcaactcctaatattttagaattaactaattaattaatatttgattttaccattaattttaagacatcatctacttgagaatctacttgagaaacggatagtaataagtttaaagaatggtggtggttttgaaatcgggatcctctggattacagtttgtaatgcatatgaccaagagcagatcatgtcatgcgcttcggtactcaatagtggattacaataaatacagttcgcatgaataatgagcctctgcattactgcagaggatccagatctatggctttgacgcacgtttatgcatgcatactaattttttaaacctaaacatttgataaactattattaatagtgagattacaccagtaccaggcttattttttggtactaacctccgcctcatggaatttttttttcttgtagcacgcatgtaattttttttcttgtcccgagatggctgcgttgcctctcgtacgtttggatggatccgcgagggagaagcgtgaccctcgtggtagcatcccgatgatggaggagcgatgccagttgcttcccttgtcaccatcggaaaacaggtgtgtggtttgagctagggatgacaacgggtcagatcgggcacggcagagtaaaatcatgcctgaacccatgcccatcgtcgcttgtccaaaccttacccactagggttagcgggcaaaactctgtgcccgtacccatgcccgacgggcacgggtatacccggcgggtacttaatggatctcatatgaatagtaactcgaaagatatacagtttaacaaagagaaataaaatcaacaatttaacaatttattagttatcaacaataatttgaattacatcataacttattacagtggcgaatccagaatgaaaatagaggcggtgctctaatgaccagtgtcaacgttgggaactagaatatatcgataagtgaaccatgtatatctcactatgtttgtagaaaaatctcacttttttagctctaagaccgtcaatcaaagatcattcatatttgctaatatgaaattaatggtgaagaaccacgttgtctcgttgatttcacacctctctctagccatcaggtctctgcccccatatataactacagctaaaataatttgaaatgtgccatatcatagcaactgtgactggagcacaaaacatccgagaaaacaaagcatgaaagcagtagtccaagtaccatctagtcattttcttcctccaaacggtagctagtcataactactgcagcattagtgacatagggatacttaggacctagtagatggagctggggcttgcgccccaacaagccccaatactaaattcgcccctgacttattattagttagtatcacaaatgaaccaagagaaaggggcataacaattaagagataagtcgaaattagctaatacatatgtatcgggtcgaacatgggttacccagaggcaaaaaaatgaaacccggttgttacccacgatgtctacgggtttcgggcggacgtgcccacgggtaaaaattcacacccacgcccatgcccattgggtcaggtatccgcggatacccggacccataggcaaaattaccatccctagtgcccacgggtaaaaattcacacccacgctcatacctattgggtcaggtatctgcggatacccggacccatgggcaaaattgtcatccctagtttgagctatactcctagttaacaaacaattataggttagcctggtgatcactcgatcagatatactagtaccgcatatgccacctaccacacacgtacggccgcacccgaccgattgatctttaactgtgttgaggactcggcgacgacatgtcgctgtgggaccacttcgattgatcgatacccggttgttggtcagatcagtttcagcgtcttatcttgatagtcatctttaatttgatagctcgtatgtaggatcaaatcaagtgaactaagctagaggtgaatagtaggaacaccgaaaattagtttttagtgtaactaaaagttacgctcaaaatccgatgacgttaattaactggtatgaccgggctaatcaccctctaaaccactgtcatcgatcgacaccgctggtctagccgctgtgaagccactggtgtgaccaccgtgccctcacaggtgtgatcaccgaaactgagaaaaacacaaatcgaaaaactcttgaaactagatcaactttattggttctaattgtttttacaaagtgcaacaacagtactactctctcaagtttcgactaaacttgaaatttatactaaactctattttttctctcaactaaactctcaaaattgataccaatagatctcaacccatcttctatttatccccgaaagtagcaacccaaaagccataaatccacattaataagtagtcctaatccactagggaacctacccatatgcacgtacacacactacgccagatcaattcatgtgacggaccaaaatatctcgtcacaaacaatatcttttttgacgggttaaataaatctcgtcatagatgaggctaaaaaaaatgacccgtcacaggtaaatagtatttacctgtgacgggtatatataaggacacgacacatgacgtttgtgacatgtccacgtataaacccatcattgatgagtacttatatgtgacgggttttaagtttgcacccgtcaaaggtgagtaacctcacctcagatattccatcaattttgacttattaaaataagggnaaaaaaccccaaccctcccccactgcccactgccccatctcttttctctcttctctcttctctcttttctcttcccccaccatcgcctctccccccaattgtgcaccagctgccgcggtctccttcccatagcagcgtcgccgcctcctttgcccgccgtcgtcctctagaagctcagggtcgccgcctccttcgcccgccatcggcctccaggaggtcgggcccggtggccttcaacatcgacgccgccgccacctcttgaccgccagtcaccagattcgactgccggtgccttctcccgcctcccggtcgctgacgccgtcgcctcccgaccgccggccttcaacactgacgccgtcaccgcctcctgaccgccgatcgccagatctggcccccgagaagccggatctggccgccggcgccttccctcgcctcccggccgcagacgccgccaagtctggcctccaggacgcggatccagccgccgacaccttcgccacctccgcaacctcttcctcgactgccggacaccgcctccttcgccgccaaccgctgaccaccagatccgacctccacgaggttgtgggatgcggatccagcatccgcagcctttccttgactgccggacgccgctgcctccgccaccgaccgccggccgccggatttgtttgtgcttgatgtcgtttgtgcttgatttgctaatgtttgttgcttgtgtggatgtgtagtttgttaaaattgatatgggtacttgtgtgatgtatattgttagattgcttcatgtgtagttttttgttgagatgtatttgatttaaaatacaaagttgttgtatcgtgtgcatcttgagatgtatttgatttttcttcatttcgtacatttggggtgaggaacttctttttttctgggtggtttttgacatctgtgacaggtgggaattaaaaccagtcacagctgttttgtcacctttgatgagttggaaagagtcatccgtcacaggtgtgagtcacgtgtgacgggctatatttttctgcccgtcaaaggttttaattaccagtgacgggctttcacccgtcaaagatgaagtgtagtcattagtgaccactaatctctgaccaggactaaatccgtcaaaggtgagggttagaacccatcacagatgaccggatctggcctagtgacaacttatccctttacaattcaaactttaatcttcctacatttggactctttccaaatttgactctgcttttcattcgcacataatctctcttgtatgccgtatggaatcttcacaaccacgcgtattgttattcagtctgagcattccacatgatctcctgatcatccgaacattaacgtctcccaagtcggctttcaatccatcaccgccaatgttctttcgaggcatcaagacacacctgcacatgaatcaaataacaaaccatattcgagcacaagttatttcccaacttgactcaacattaagataaaacagtattacacacgtatagaaatcataaacatgagataatcgcgagtatccaaagaaaacataaaaccgactctaaacaaagtccaaccgatcttaccgtagccacaacaccagtctaaccggcacaccctagtcgatctgatcgcaagagccaaacaaaaatccctgttttcgtactatcactattcaatatattgcataacagaacttcaccaattatccaccaaatttcaaaaccaatataaatcacatatcaattgttcatcacagaatatataaatgaaaaacattgattttacacgcacgtctacgattcatgagctgccagcaacagatgcacatggaaatatagaaggaaaggatccggtcgatcgaagttttcactaaaacttcaaagtcgttcatgtgaatatatacaatcataaatcatgtagcaaagtcccttcataaatttatgtcatgatgatatatagccacgttgccaacgcactgtgcaactactatatatagtgttattacagccatttttatacgttttatttttgctatttatcattaattagttgaccttttttttctcttgtctgttattcaccccgactgtagtttagacatgcaacttaattttgaatacagataaattgccatttttgtttgctttattttttaataccctaaatttatctagatgtatttatagttatatagataatattctaagtgcttttgtatcactttggtgtaattggttaagttcaacaaaatctttcattatttaaaaagagtaaaatgtgcgggtggtctctaaagttatacatgggtgtcatctaggtctctaaactcttctcaatatatatttttggatccacaaacttatcatgtgtgtcatataggtccaaacgggtttcaacccactctctgtgcactgacgtgacatgacatgaagtatatagatgttctgcatagcacatagacaacaataaattgtttcaaatgggactttctttttttccccttaaagggatatcgtcatatctacttttacgagcccacaacaaatcgggacctccacattcatgcatcattagattccccacccacatatgcactttattagcaaattataaactattttttcttacgaattaattatccgatatgtgatctgattgtattattaaatttattgcaattaaattttacagagagatcccacatgaaaatattttggataaaaaatattcgtaacagaaatatttttatatgatatatgaaacattgagttataaccgatgaaacatcacaaaatacttgctgaaacatccaaagaatagcacgtgtaacaatctaaaatgacccattaaagcatcacaaaatacatcccgagacatccccaaaaatagcacgtgcaacattctgaaatgatatagtgaaacatcagctacaattaaacatcgcgaaatacctcctacaacatccaaagaacaccctgtgcaacattcaataatgacatagtgaaacatcctaaaatacttattgtacattttaaatccattgcaacaaaaaaaaacttctaaaagcaaatcatcaaaaatatagtcatgtgagatctaaaaatgtttgtgcggtgcagttgaatggtaccattgcaattgtgaatgatgactccgaccctaggtctttcgagtaggacgggcagtagggagatatcgatgactattcatcactatcttccttagatgatgaaggcccaacttcattttataccgaggaagagttgcagaatcttaagaggacgaaagatgtcttggttgaaattcctattttaggtgattgcttacaatggatttagccatttctgtccttttaaattgcagtgaaaacaaagaacaaggaatcgaatatgcttgaaccattcatatcttcaacagataaatcaagtccatcaaaaccactctaaaatggattcctccaaaccattcattactatggagtttactaatagtaccaattttctaaatacaaacttgttatgttcatcataaaccacaatggtcatgaaattaataaacaaataatcctaacacatgaaattttctaagtgaacaatggaaattatttcttaaaagacacaaaataaatggggctagctgaactgccacggcaacgagctgggcgtggcagttttcagctgccatgtcacggagcctgacgtggcaataggtgctacgtcgaagccggcttgaccttgtcaatgccaatgattgccacggggcaccgttgcccatgccaagaccggtggtgtggcaaggtagtttggccacaccggttacaaatggcatggcaaaaaggttcatttttgaaaataagttcctgggaggccgttaaggttcatttatgttatgttgaaataagtgaaaattatttattaaaatggtctaaaataaaaagattccaccacatgccacctaccacatttttcgtgggatatactagcatccgacgccatttaattaatctaagcatcatgctcacattaataaataatgatactaattaccccgggactccaaccctttagatagactagttagaactagtgcaacatattaaaataattagaccgaagccgtggcatagatcagctagtccaatcaagtgaagcacaaactattcctataacacataactaataaagtagtatatgaactataaacactaataagtgcaaaagataattcctttatgaaactcatagtcttacaaagagagtaaagtactaagaacatacccgaatctccaagaagactatggaaccgaagactattctaagcttatctccactactaaagagaaaacaagtatatgaataagaaaactgctctctaagtgtgtattttgagagtgaaggagtgatttctatttataggctgcttatgacgattgttaagtcggtaatcaagtgcaaccgcctttgagaagaaatcatgagttgccacgtggaggatggagatgagaggtggcgatggtgttggttcgagtgacccatgcatgggccccatctctctctaccacctttctccaaggattgacatgtgggcctctaaggaggtgcacggtggtttggcctcactttaagtcggtttgagctgacttatggggcatcaatccatgtgctcaca

SEQ ID NO: 9651 - DNA, 3411 bp, Oryza sativa
ttagtgcattggaaaaatattctataaagattacgaagagaaatttccgctccctgtcgtccacgcgggcgcagggagcgaaccctagtcccaaccaagaccatcctcccttcctctcccctgcctcactgccgctagaaaccgcgcggccgctaggatggcagcgatagggctgaaaccccagcggtggcccattcttcggcgtgaggagacggcacgcgcggcggatccaccgccgcgggatgtagccccctccccctgcccccgcggatggatctggtgctcctaccgccagatctgaccggagtgcactagcgacgacgtggacgatggcggagggacgacgactggaggcgctagcaatgggaggccgcgaggttattggcttgctgtggccggtaggaggcacaggagatgacgggaggagcgggtgacgactccagctgcccaacgggaggcgccgacgacaacagtggtcggctgatgggaggcgtgggcaacagcagcggttcaccggatggaggtgcgactggtagccgctgacgatggcgcgacacaacgaggagcggctggaggcggtggtggagctcctggtatcagcgcatgcgagcggcagtggtggttgcactctcggtagttgttgggggtggttgcggtcggtaaatcgatggccgatgtaggtcgcaccgggggctatgaggccaacccggcaacgggctaaccgctggtgcgcagcggtggagaggttcccgtgatgggaggacggaggcgacggtgatgcgactaggcagctggttgtgaacacgagcagcctggtcgaggcggcgacaacggtagcgccatgaggggtatgttgaagcctgcaacgagcttcctttccaatcgtttgtccttttgcagcgctggcttgccaccgtaagatggccacgctggacgggctagtgcagggcagaggggatccttctctctcaccattttctatctccaacccaacaacacggatggagttgaagcgcgatgggtgttgagattcttcttagatggctggccaacggcgaggtgtcggcgcagtgtctgtgcatcgaaggtggattagcgggtggttttgctgaagctgacatgcactctttggcgcgggagagtataacaatgggtgaaggcctagccttcgggccggcaatggcgatgactgtgggcgcgttttccccttggggtgttgtcgtgttttctgtcctctcccatgggttcttcaggtgaaaactgttaacggtcgttatcgatcagtttcgaccatcaatattaccaaaacaggagagaactagtgatgcttgcaatgcataaatatgttagaataataatattccactagtacaggtctactgaccttttgcaaagaatgatcataaagtggaggagaatcgacatcaacaccaacgataaatcaatcagacgatgtcgaggatcagacttatgtatgaatgggccaagaacacagaattgacacgatgaattgggccaaaattcacaagtctgcggagtggagcaatagaggaggccaccagcccaaattgggctggattgggccagccccgggttcggctgaacctggtggtttggcccaaccaatcctggcgcccttggatccaggttttggcgtggacgtccaggattgcatccaatgacgggtggagggtacttcggacaatttccctttcacaaccgccatacctacctctatataaggagctcactctcttcacttcaacacacacctcaagcaagagctctctcattcctcttaagtttagtttagtagtatctagctggtggaatagaattagaataggaatcaggagtccggaagtcttcgaaagagttcaggtatggctctagtagctttcctttcctcttttgtaagctttgtacttttattagaatactcttctaaatacatttctggtattgaaatactttccgagtatatgagtaccaactttacattatgttcttgttatactgaatatacggctagtttatctgggagatgctttggtgcgggtataatgtttctttatgcaattactctttgtcatgacgatggtattagagtagtatctagtagtttaggcgtggtgtctagattacgggatatcattatttggggttatatattgcggatgagaggtgggccgctgatggtgacagcttagtacgggtattcctccgcgcctatatataatcctaagttaatttcctaggggggtattcctctgtatttagccccggttggatggccatgacgggctgtcgtaaggaactcggcagtcaggggtggcttttcgaagtaccaggagagcatcggatatagggtattagctagtatatcaattaactagaatgtatgtatactatgtatattagaagtataggaattgattctctttctcttttctttccacctagcttagattatttattataaggatgagtagaaatgcttgtgtgccactctacccttggatttatcttaacccctgcttagaatatgattatcacatgtaatatataaattattagttgagttctctctacatgatcttcccatgggataaaataaatatgatacccttggaatactctcgggtgaaatgctacaatggtatatccgtgcgcttgcggatgaactctgtaaccataatataccagaagtatttctgcgccattgctgggaattatatttctagtaatgtcgttaagaaataccaacaaaaaccacgtcctggatctctaggacaggcggtgacgaagctattggcatcgtttcctccttggaggcgtcgtttagaagacttatttcttaggggtattgtgtgcttgtcctgtatttagcagtaagatcagacatagacgagtggtgtggatgcatattttcttttttcttactatagtcttccaagattatagacttgtgttttattcctactttattaatataaatgtcgcactatcttgtatgggttgttttaaaaaaatatatatggattatcttctgttcttctatttgagtggattgtctatacatttgtcaacaaattttcttctaaaattttgtcagatgtaaatatagtataacaatactataattacattctaactaacttacatgtaataactacagtgtaactgatattataactttcgcgtaattttgaaatcgttagatttgctttaagattggtgcaagctgagaagatatataaaagtcgcaacgcacacaagtgaggggatttggtctcgtgacctccgcttcatgaaaatagcaatgttatcgtaagatttttgaaagttgcatacaaattatactgtgttatatgcaagttacaatgtacgtaattacactaccattacact

SEQ ID NO: 9652 - DNA, 616 bp, Oryza sativa
cgcccgttgctgcctccgctgcccaagcatggtagctcgcaggacgtgctcgccgtccaggtcaccgtgttccctcgcgccggcatctgcgtcggcacgacgctgcaccacgccgtggccgacggttccagctacgtgcacttcctcaagacgtgggccgccattcaccgcctcggcgacgagcgcaggaaagcggtggtggtggaccacacgccgccgctgttcgaccgtggcgtcgtgcaggacggcgacggactccgggaggcgtttatccgcgacctccgggatctcgtggagtccggtgacaagcggctcgacgactgggacctcagccggaggccggacaccgtgctcgcgacgttcaggttcacggacgagctgctccgcaagctggggaggcatgtcgaggcggagacctcggcgcggtgctcgccctacgcgctggcgtgcggcgccgcgtgggccggcatcgtgcgcgcgcgaggcgtgggcggcggcgacgtcgcgcggttcgggttcgtgaccgggtgcaagccccgcgtgagcccgccgataccgtcgagctacttcggcaactgcctggggctgtgcttcgtggaggccaagcgaagacccc

SEQ ID NO: 9653 - DNA, 720 bp, Oryza sativa
gatttgaacgaatattaaattgtaagaacgcgaatcgaagatgtcgggcaagacagctccggcgggcacagaaccgacggtcaataaacctaatgggtaggacagctccgtcgggcacagaaccgatgtcactaacaatccccaacacgaagaagatgtcgggaaggtaccgacgtcgagcaaggaatcgtgatgcacaccgagcgactcgtttgagctagaactagcgcaattgcagtatgaaagacctgaggatgacccggattatattcctatcgagcaggcggtaataactgaatcctgtcgaaatatatatttggaattaaactttccccgatgtagcggtctaatgacttaaccgtgcagatggcaacccgtcgtcggtcaaaactaagtgccgtcagggttgaacctgattcagacacaacgacctcgggaccaccgcgaacggacacgacgatgagtgggggagcttgtccaaagaaaaagcgtggcgagaagggcaggaacctcatgccgaaggagacgtactacattgctgctctcgatgttgacggcaaacccgtcgagccgcaacatgtaagggtgaagtttagcaccgcatgcggcgcgctggcaaggcttcatgggcctctcaacgtggacgaatggaagcatgttagcattcacatcaagaacttaatgtgggaaggtctgcaggagcaccgtatttatccgcct

SEQ ID NO: 9654 - DNA, 4096 bp, Oryza sativa
atgctgttggactgtccagacatccagaacgtgccacgtctctccaacagatcgtccagaaggagaagaccggtgagtttgtccctcgacggcagcatgatgagctgaccgaagctttgagaactacagaacctccggtaggttagaggacagtcgtgcatgacgaattggaaggtagggtttccacaggaagcccaaagttacaagaagcgcgatgcctacaaggccaagatgcgccaggaaatcacaaatcaagtcacacaacaagtcacccaacagttctacagtcttgccgcacaacatcctcaagccttccctgacctggttcctcatggtttgcagtcgacacagatcctaagctcagtcgggtcggtagaaaatacaacctacccagtagatagtataactggtccgacaccgtgcagctttgtcgttccgatagggagagcgggaaaaacgaaggaggttgcgtctggattggcgataccggggagacagttccataacagcctaattccggcggactacgtaagtgttcaggtcgcacttgttcatggcgaccagatgtcgttggagcttgacatcccaacaccagaggggattgaacttctcagggatgcggttaaccagttcatactctggcatcgtcgtgacatcatcctcactggacagttcatgtcgatgacaccagctccatcggtgccaaatacgtgtgcacgtcctgcaccgccgtcccctccgatatgcactaccccacccggatctccactcccacagatatcaccacttagaggtccttctccacctccacaacaagtagcacctaactccccaactaccctacctcggtagccgtctcctgctcctcagtcctatcttgctccaccccttgacgaacatgtgccacctccacagccagatacatcaaaggagcagccaaaaacctgtgaagcccgcaagctcatacccgttatggtatccacatacaacaaggagaaaatgcagagtgtgagacgcggatggttttgcaatctttcaagggtcgagggggtccgctaaagccagttggacctgatcagtattcggacgcacagaagagcgttgtaggtcttgctgacaaaatgcaatcttggacctccaatgaagtgcctaaggagtatgaatatggcaagccgtttttgccgttcaacttgatgtgtgaactcccatggccaatgaggttgatgcatgagtggtacttgagggcaagtgagttaggtctcgggatgattactgtgcatgtcccggaaggcgctttcaaggatggacctaacgcaaacttcgcctttagtttcaaggacctccacgcactctttaagatggataaaatggatatcaatctcgtcggtgcgtggtgcctataagcattccatgtacttcgttattccaatgtgtgccaatataattgttagttattctaacttccaaatttcctcatgtcacaatgggtagacgctcaaagaacggggaccttaatcggttacgtaaatccaacgatggtttgcgagacggcccacactgtgcggatatcggaggatagtgcggtactaaagaataagacacctcaggagaaaaaagattacatcgagcgtatgcgtaagagaaagatggctgaggtgggaaattacttggccacctcatttctcgcacactccgacaaacgagtcatcatggtcccctaccactttgggtaagcaactttgacatatttccgttcacatattaataacagcgcaagaaaatgtcttatgtaatttcataatccgtgttcacagcgaacactacatactattcctcgtctatccaacggaccaaaccgttgtagttcttgatccggcggactatgacaaggacgcgtacatggagttcctatgcttgctgaacttgtaagttcgaaacaatttccgtaaagattccaactttccgtaaagatcattaaagtagatttatcataattaattaatttatttttgtagagcacacggccgttataagaaacgtggcgggtacgttaagaatccaagtagagagaaactgtacataaggggacactggccggtatgtcagcatttattcagtacgtacatcacgattgtcacttcttacttctgacgtgtccacttgtgtatgcagtgttataagcaacctagctttacgaacctatgcgattattacgtgtgcgagatgctcagggtcaatgggagatacaattgagtttacagatgtaagtcattaaactctccttagatattgcaaatagttcattaaacctgactgtaacacaaatcatttgtcttttaatttcgtagctcccgagtatcccttatagtgcaagccggttcgatcagaaaacacttatcaacttgtgcgtggacttgtgccggttcattcgccgcgacatctgcaatcatttagaagagttccatgatcctcatagcgaacttgctacgggaccccaaattcaagaatctaagagagtgggagaggcaacatgctatggactaaatggatgtatttgtcgtgggggatgcttgtaataaacactatactttttatgtaatatgatttaatttgatgtttcggctaattttcggctaattttctatctattgtctcgtgaggtcaaattatacaaaccgcacgggataataggttatcccagatggctagcacgtgctagccgtggggggtaacatattatcccgtgcgggccacttaatttgaccgcacgggaaaatagattatcccatgcggttggccttattgcacaggggataatcgattatcccgtgcggtcggcccgcccgcacgcgaaaataaagattttcccagacgatgagctgcaggcgggccgggcgaccacaggggataatctatccaaccgcccggaataatgggtattgtcgtagtgtccggtgtaccatctagtatatgtaatcttttgtctaacaagactctagctggatgatttctaaaagtaaagagaaaattcgatccatagcacaggaaagaaagcggtaccaaaaaatagcacaaaaaaaattccactttcgatccatagcataggccactaatttttcttcgccccgtagcactttcatcgtatttggaagtaacggcgttagatcggagtggagaaaattttcgtcggactcatttgccctttgttcccccacgttcccaccacgtctcatcttctgctccttcgtggatggcggtgcggtggccatcagcgtgccgggcaaccgcctcgtctccctgccaccgccgagcgagctgcgacgtgcactcttcaacaacgtggacgcgtggctcgccgttgccgccgagtcgaagaccttggcattgtggtgctcgtcgaggaggatgttctccggcttgatgttgcagtggacgatgcagtcgcgacacttctcgtggaggtaggtgatgccacgggcggtgccgacagtgacggcaaaccgcgtcggctacgacatcttgcagcccggcgcgtcggtgaagaggaaggcatcgagggagccgttcttcatgaactcgtaggtgagcaggcggtggcgtccctcggagcagaagctgatgaggcggacgaggttgaggtggtgcgtgctgctgatggtggccacctccatcctgaactgcttctccccctctcgatcccctccagctgcttcaccgccaccaccgtccggttcgccatcacgccgtggtacacggcgccgtacttcgggctgtgccggcacaacacacaccacaacgctcactcgcacagcaccagcccggacaccacgccgagcatcacccacctgcggacgccagacaccctgctctacagcgagccgccgccgccgaggggcaggttgggtatccccgggaagcagaccttgatgaacgacgtgctgggcagcgccacggaccggtacccgctgacgaagttggacaccttgaggaagcagaggctcgagccgccgtagagcgccatggaggcgacgcatgagctacaggagaggcagttgaggcggcaagcggtgatgccgacgaagaactgctctgtcgt

SEQ ID NO: 9655 - DNA, 2950 bp, Oryza sativa
aagcgaaaaattcttgtgctatttttgggtaccgcttttttcttgtgctatggatcgaattttctcaaaagtaaatgtcgaccttgtgcataaggcttttacctagcctgcctttctagactatatatgaggattcaccttttttctcattgaacatttattgattgtaatcccatctatttgtcggacataacgtttgtaatttgaggtttcatgaaacaatcatgtgtctcaaatgtaattgtaatcattattaattattattgtgatttaggccccaattggaactgttgaatatagttcgatcgcccggcctggctgaatggcagattatttcattcatgcttctaaacataccttttttaaaaaacaaacattcaactgactcccgtagaccacattagtaaactatttgttattttttaaaaaaaaatcaatttaccgcaccaatcaaatagaccatccatttcgttttatcccggtttcatcactttgcaaccatccttaagttgtattcgttacctatggttgaaaacaaatccatacagcgcaaaaaacagaatgacctattagagcataattaattaagaattagctaaaaatactataaaaattggataatatgttctttttaaataaacttttctataggaacttttttataaggtgcactttaaaaaatatgcgcgttaaaaatgatgaagtgaagttgggaatgtgtcttaagctagggttagagtaaggctaataatacagccgatttgttggctataaagttctttgcagacttttcttaacccacacatataatagattaatagttagctatttacaattaatacagagtctacttgtctctcatataattttttggttcttatgcccaagtcgactgtaagtttacagcccgctttttctctctcctcgtatttcctccacctcagtatttagccgacttacagcctcctattatacttgctcttagggtatagagtatcatttcgagcaagctttcgctttttctcccggctgtctacaacttgacatcaattgcatggtatgagcaatgagttacagctagtgtgaacatgtttcccatattgtaacgtatggccactcggcggctagtaatcttaaaaaaaaaaggagagctgacatcaattgcatggtatgagcaatgagttacagctagtgtgaacatgtttcccatattgtaacgtatggccactcggcggctagtaatcttaaaaaaaaaaggagagctgatgataaacgtaatgataggcgtaggacgccatcctcccctgccgggggactccagtccacagtccgcgaggaattcctccaatctccaatctttttgcggcttccatcccctgccgggagcagaggcgcatcggctagctagagctttcgcttgtccatcttgccgtccgtttcctgagctgtacacgaggacgttgctgtgctgcatgcgtacgtcagtcgatcggtcagttcgtccagctctcgctctcgcatccatccgtccgccgttcgtgtcgcctgtcatctcgttccaaccgaccatgagcgaccggataaacccaacctgatcattcttcccccccgggaatgattgcaccgtgccgtgctgtcccaaaatatctcccgcagaaatgttgcaagatttttgtttttcagctggtgtaatttgctcgcgtttcttatgtaacctgtaacaatggtggaataattcgatcaggagtaactgagaggaaaaaaaattgatcatttcgcctctctgttcagagcagagtaccatcccgaagcatcatacagcatgatattcgttcggtaatgacgccgctaatgatcaacgtaactcaaaacagcgacttggttgcttttggcaaatagtgccggtgcagtccccctcctttttaaatattgcccatcatgtaagattgtacttgtcaaaaaccaaatcctttctgctcaaccacagagcccaacatattgcagaggctcccacaagtacaagcttactccttttcttatccaccccaaaaaccaaccatcaaaaagaatattgtattgctctccatataaagtttgcataatggcaatccatgttgaatattctcattttacataaaaaaaacaacatcttaaactactattccaattccgtcttactaaattgtctttggttaacacaacctctttaagtaagtaccacatatatatacaggtaattttcagggcaacatattggcttcggtgttgggctcagctacaaaggtgtgatgaagatggcgagtttatgaaggttgcatgccgtaggcttgagacgacagttatgcaactttttgtcaattatggttggagatttacaaatagacttcaataacgtgttctccttatcttagatgggttattttttattttaagtgcgtgttctcaatgttttgttgaactacactttttttagtgtaactttgtaataattggctgtagctcgttttgagtaaaggctgggatattctattccattatcttaaaaaaattgtaagattgtactgaatttctacatttgctaagatgagttttcgagcaattggaatccttcttcttacttctctatttttcaattatgggtttgttccacttttgcgactataccatgtacgatgcacctaggacaaaacgcagatatgaaacctgctgtccgcgagtgtgtgccttggccgccagcgccactagatagcgcggtacggcccgcgcgggctaaacggccgccatgcagacagaccagcgccgccgccgccgcaacgtgtgtacgcgccgcaacgtagagtacgtacgtacgacgtacatgggcctccactttacggtcacgaggaggcgctgcatggagcgcacgtgcgtccccactttaccgtcatgttgccgggccggtgcatgcacg

SEQ ID NO: 9656 - DNA, 9986 bp, Oryza sativa
ccgacttgttgcgggtgcagcgtcatcaagattcacgtgtgccgcacggcacacgtatcggttttcaagtgtagtcatcgtgcgtgaatcttgatgatgctgcaccagcaaagagccggccgtatatatattgttctattagtattgttcaaggaagcatatgtgtgcatggttgtctacgtgcaggcaggcaggcaggcaggattagctttttggccaggtacagtatacattcaactctccagggtttctttaaaagtacgaaattctttttgacaggttttatattccttgttcttataattaatagcatggctgtcatctgttctcttatttataatatcggtctttgtttaaaaaaaagcactcctcatttaaaaatataagcatttctagctagatacctgtatattcaaatttataagttattaaagttatatatttgaaaaccgaggtagtatgttcttaattttataatggcaacgttgtcatatcgttcttataatgcatatctccagtttttttatgatctaattaattattaactagtgttaccaattttcatgcatgttcatcgtggagattcgaagggaaccatttttggacgtacttgtatagggatgtcatgtgaaagcggcagtccatcccatactgatgagtgatgacaccacacactccccaaaacgaaaatgcattatctacggtccgtgctacttgtggcgacgacattcgggcaagatcagtggcagctagctaaatatttaaatagtagactatccgagacactggctttgctgtctgtccgacggccaatcggtctgggtacgagctcagttcacaatatatacagaggatggaccaaacagcaagggtgtgtttagctcacgctaaaattaaaagtttggttgaaattggagcgatgtgacagaaaaattaaaagtttatgtgagtagaaaagttttgatgtgatggaaaaattggaagtttgaagaaaaagttgggaactaaaccaggcctaaactcggcctaattgggaggtagaatttgttaacaacggttgtgtttagttacacgctaaaattgaaagtttgactaaaattaaaagtttgaagaaaaaaattggaagtttatgtgtgtagaaaagttttgatgtgatggaaaagttggaagtttgaaaaaaaaaagttataactaaaccaggccaacgtcaagtgtaatatttggaaactggaacgtaatgaactacatcaagctgtggcagtgcaagtatacataaagttaataaaagttgtgtaaattaaagaatcaggactcgattggagcttaaacatgcacgcataaagtagtagcaaataatatagtaaatgtccttttggcttcactcgtcttagataataataacgacattgactgaaatgtgacatgaccatttttatatggtttattttctaaactatgtatactacttatacatatgcttttacaccacactatctaaaatagcgatgcttgttatatatttatactccctccatccctattttgcttctgatgttcgaccactcgtcttattaaaaaaattgtacaaatataaaaaacaaaaagttgtgtttaaaatactttggataataaagtaagacacaaataaaataaataataattctaaaaaattttgaataagacaaatggttaaacagtacaaataagatgtcaaaatctcttatattagaggacggagggagtacaatgttaagcgctgcagcctgcaggaactgtgaggcaagcaaaatatatatataaaaaaaagcagtgggccggctgcaggaacagtgaagaagcaaaaaaaaaaaacacagtgggctggctgcagccggctgctgcacctgcgtgccgaacaggtccatatgttgttgaatttataagcacaaaataatttaatttattccataactaacataatcgtatcatacaatctacacatgtaaaccagacattatagcatgaacagatcgaatatgcgaaacatattgaaggcgtaccaagggatttgcaaaaccggctgctcagcgggaaggactcgtggtaccgtgcgttaacgatggtgcgcaacccgtgagcgaagaggaagaggagccgttgtggatgaacaaggagcggtcgtgtaaagcacttcccaaaaacattattgctgccttctcccggtgtaggacatcgaaggcgaaggttccggagacctgctctcccgatcgcagtacagaggaggaggcaaaccctagattgatttcgcatatgttgcatggaggcggcggctcaacttgagcgggatggagtagactacaagtgacggtgcagtacagagtaggaggcaaaccctagattgatttcacgtgtgttgcgtggaggcgccggctcaacttatatagagatatcaggacgcatgcacaatctccactccacgtaaccgtactaccgcgtaacatatccggactccacgtcgtttcacgtaccggaatattcggagtgtttccgaaaaacaaatccgaatttccaggccaggcgagcgagcacgtacgtgtgttccacctattctctccacttcacatgcctcaagtggctaggaaagcatcttcccttataaggaggtctccctctcctagaataggcaaggtggcactaaattcctcatgcatgccatcccatgatgtgggcttttatgattttccaaagaattaatcttgaatgggttaaggctcatctattaattcaaataatcccccaccaaatctcaaaatcccactgagatttgccttttctcaatgtactgtttatataccagcggtttgatggagaccaattaaggctgaatatccacctagaattctaagctacacttatttacaacttgaacaatggactatgccttgaattgcaagtcttttgcaagcaagtttcacttagagtcttatgtggtactaccgtactagaccgtcagtagactatccctcgtgtggagcgtataagtcatactccttgctctcttagtaagcttcctagaaaattcatccaaaatctccatagactacgaccactccagctcacaaaggtgcgttctttcaagaatggtctgcaggatagcatcttcgctaattaaagaacttattaagacataaccaacatgccttgcagctcatgagagtacatgcaacttcagttagagatggtttagattggtactcccctcaagttaaataatagcttgttcgtcccagggtctaattcacgggatctccaatcacataattatgttaccgtcatagtagaactcacatgggtctcaaacccatctccttcgatgcattgtctatcatatttcgtcatagtcccttcgtgaagggatctgccaggtttggatgtaattcaatgttataaccccaaagtttctcaaattcctgaatgacttcaatcgtcatttcacatgtctaaacgatttcatgttatccttagaactattcactttgaaaattaccatttgattgtcacaattcataagaatagccggccccggtatttcaaccacaagcatatccatcaatagatcacgcagccattctacctcaacagcagcagtatctagtgccgtcagctctgcttcgatggttgacctcgtcaaaatagtctgcttacaagacctccatgtaatagcagcaccacctagtgtgaaaacatatccactaatagctttgatctcatccacatcagagaaccaattagaactgctatatccctccagtaccgcgggatacccagtatagtgaagctccaagtccatagtaccttttaaatggtgcatcactcgctcaagagcacgccagtgatcatctcccgggttagaggtaaaccagctcaacttgctcatagcaaagaagatgtcacagcccagaaattcataagtaatttccaaactaatttgtgcattaaatcctcgtctagaaatcagctaaggtacataaactgacaatttatacaaattcatcaaaataagcaaagcgataaatacttacataagaggcacttagttctcaccaccaagaaaactgcagcggaaaataaaatctagcgaagctccaactccactcccacaggcagctcaactgggatctaaaccaaaggtcttctccttctagatcctttttcttcaactgagatttggtgtttattgcaaggtgagtacatggaatactccgcaagccacacagcaaatatgcaagtgcatagggatcgataccaaagaatggcatgatgtaggactcatttgcaaaagcatcatttagcaaagagttcaaaatttgtaaaatagtagagtaattaattatcaatattaatccaatgctatacaacatacctgctgcataggccctgccaaacctgaacaaccaaccccggtcgtacagatcaaacctccaaatcaggaattagccattccaaaccagaagttaaactaattatcatcaattatcacattattattattaacgagtagtgtgagactaatcaaaacattattagactcactcataaccgcgagcacggctattcgaataattttactctagccagagatgtaccactgtacgcacaagacacgatttcacacatgttgtcatgccccgaagtaccaccacagcactacaaagagggaaatcgtgacattacccttcacataacacaattcataacagtgcaccgttcctggatcataatcaccccctcaagagccagaggtatggactccccagcgagcctacggacttatcgccgctttacagtctggtgtctcgcaatgaaacacactgtacaaaaggtaaagtcgttgcccatactggcttgtggttgacacggttaatgtttcacaacagtagctcgcgaaccggtccttaattgtcatgagcacaaccatcaaaatcatgtgctcacaactctccattaatcaacttttagtttataattaattatcataacacgttgaccatcgtgagctaccattaaatataaccataagtgatagtgaagtataaattatcccattaatgagctaatgtttctaagcatacctaagtaattacatctaatatctagttgacccaatatataagtctaactagtcaaattataacccaagttatctagcaaaaaagagaaagctatagataaagggagggagtgcattgaacttatcagataaaaaaaagcaccgcccttatgcttattttcttttggaacaaagatgtaccaatatcatttcatacaattttacaaatcttgttacttgtcatgggctttgggccaggcgtcctaggctcattggataggattagggtttgttaggattagataaggtttcttaggattagattaagtagtcctccatctatataaggagggatcctatcccaggtcagttaggcattagattaagatttatcttagtgcccatcggcctgccttctcagtgcgacggagagcgtcgcgtcgtttaggttcaggaccattcctcgttatttcatctactataatccaatctatccctattcttcccgattcttcttcatataattcttgctcgtgacaacttggtatcagagcttcggttccgtgcccatgggtgccgagatcgcggcggttcccaacatcagcgaaggtcttgccaagatctcgacgaagatgatggacttggcggcacaactccaggctttggcggctccatcagccgagcaggccatgtctctcggagctgctgaacgatccgaccggcaggccatgacgttcctgctaccacggcagcacgaattcaagcagcggttgcgaggcgccaactcgaggaggaggatgagttgcctgccacagccaaaggcggccatccctcgcggtcgtctgccaggagttatgccactcatctcggcggaaacaagacttggtggcgtggtgctggggatggcatcaacggcgccacttctgcccaagccgccgtcgaccaccacggcgaaacgacatccttcaccgtgcctacaggcaccacaaccggttgggttgtcaccggtaacagctgtcagatggagtcttcctccttcgctcttggcggcgcttcaacagtccgagccattggagaccacccgggagaagctcagggcgaccgacgacacaccgtcaagggcagcggtgcctacttttgtgacgccaacccttgaaacaagaaggcgggatcaaggtcgttggagagcatgcctagccggaactcgacctcgctgttcggcctggcaatgccgccgtggttattggcgttctcaacggaggcagaggagacgactgcgagttccacttccatggcggcgtagcacggtacgggcatccgtgcgatttccgggcgatgcgatcatgcgaatcggtttccacagtgggaggcgcaaattccggcgacggttggagcagagccatgggaagcggagcggcttcttcgggcgccaggtttggcacgatctgctggcgaaccgtgcccttcgcgcggatggccccgctcgtgcactcgattggctcccgcggaggcgtggggacggcgcagatcgctccgagtccgagcgctggctcgagaagctcgcgattcgatcgcagttggctgcatcgctgctgtcggcgtggccacgtgaagaaaaggatagggtttctgtcttcttccagttgggctggctggtctggtctggttggtttccacgttggcccatgaatcatagatggttcttcctcatgttttgggccatgaaccatgcaagtaaactgctgcttctccctttgctgttggtctgggcacgtgggttttggtgagaggcatgctgctgtgcttggccacggcttgagcctaactgtccgttcaaggcttctagacggcgttctcctgtccatgtacatgatgaccgcagtactagttctttagggctctaaaaaaactgagatgtaaaaggcttgagagtcttcgtttaggttatggtacttcgtttgagtccagcagggtgagctgcagcttgaggacgagctgctcaaaaaggggggtgtaatgtcatgggctgtggaccgggcgtcctagactcattggataggattagggtttgttaggattagataaggtttgttaggattagattaagtagtcctccatctatataaggagggattctatcacaggtcagttaggcattagatcaagatttatcttagtgcccatcgacctgccttctcagtgcgacggagagcgtcgcgccgtttaggttcaggaccgttccttgttatttcatctactataatccaatctatccccattcatcccgattcttctccacaaatccttgctcttgacattcctccaatccaaagaatcatataggaataaaatcctaaggaattcaatcccctatgaaaatcctccaatccaaaggtgcacttaacagtttattaagaaggatttggaagttaggtgttgaatattctcaccactacttcttgtttatgatcagattcagtcaaacttttcagagttgatatggagaaaaacgatattaaattctgcatatttctacactacaaattactgaagttatccgattaaaataagcggaacggatcgatactactaaacaaaacattgtgccaaaccttctagtattcaaattttgttgggcatttcctttggacatcaatccatctaaaacataaacaggcggactatgcgagtggaacatgtggttttcaaccaaatggattcacatgaacaacttcaaagaatgcagcttttctttctatagtgacaattgaaatgcaaaaacaactgatacatgagcctcagaaacagcatatgataccaatccacgggaataacaggtatatgtaattgacaagaacaaaaaaaaaatgaggaggcatcagttgtacatactcagttgtgattgatgacaaatagacatctcaaaagaaatctaaggacatcagtaacaggttggcacaaacttgactaccattcaccttcctggcctcatgtgtcagaaaaccaagcctgagatatcaaagtaaccaaagccatacatatgccaaaatattgctctttattctgtgaatgaaaaacaagactgatctggcattgtgattcatggatctaccgctcgcgtcctgctctgtggcacagtgcactcatgatcgcaatgcagcgactcaaggttctaagcttccaccttcttctttggttgccgatgcacggatcccttccatgacttctgcttcaggactatgcccttcttcttgggggcatactgctgtttcctgataaaaaatatatcagcgtgagattgaaccacaacatataagcaattcacatccatccttcatgattcaaggaacttacatattacaattcaaccaagttatgtcccatatttctatttattaaaattactttgattgcacccatttcgtagataaaacaggaaaaaaattcccacacttcatctctagcagactgaagcagagctactgatttacttctgaattgctggcttctggttttgggtctacaattaaaaaaccttatggttgcaatgaaatcaattcatgagtctattatatgttgctaaaattaaccatgatttgctatcccactcctgacttgccaggcacgcgcactcttctcccattcttcaataaacaacacctttccctcccagaatctgcagctccgcccgatgcccactcccccctaccctaccagctctccagcaaaagcgccagtgagagccaatgttgcactcctgacctccatgcgcactggcatgggcctgatgctgcgcttccatccttcacacactccccctccccctttaggcctccatgacagaggagactgccgtgtttccatggtaaagttccttcgtctgtgagggttagatggcatctattgtcttctatgaattatgatggatatcacctccattgccctgcgtgctcaattagctgtcatctttctaacctacatgctcacatgggtatcatcacatatcctttagccgatgcacttgtgtcctctccagtcagaactgagacacatcttcagcacagtgcgttctaacaatttttggtgtgtcagcatgatgtcagtgctttaggtaaaattcagtgatggctttcttgatgcttctgagaatcatgctgcaaacattatgtggactggtattggttgctcttctattcacagatgattgtatgaagcttaagcaagacatagttgccctttctaaaaaaggaggagcaagtatgaaacaaacttcagccttggatacagaatactgatcaagatgcacctttccaatgggaattctctaaaaatctatgagaaccctaatgcattggtaggctggttaaaattgccactacaccttcctgtacattagtgtttatttcttcaatttctcatagcaatatgacatactaataagttgacaactttgcatggttctagcttttaataatttgaagcattttttggtttgaccatatgatcgaggtaggtaacaaatggtttggaaccaaaacgtacatctgttgtcgtttgatatcggaggcaatggtttacattaatctatattgagagatgatttcacctcttcatccaactcatattattgtgtccttttatagccgcaaatttgggttggtcaatagtaggcttactggatgtgatcttggaaagagcaatggcagccgatgggaaggctgggtggtggtatgtaacaaaaaggaagagaacttatacctgagctacttagcatacctctacagataaaaaagaaatacatcacagagcaacgtggttgtgtaaattatcttgtgattgtgggattgctcatatattcctttttagttgaggacttgaggtccaaattaccaggctc

SEQ ID NO: 9657 - DNA, 5657 bp, Oryza sativa
  unsure (1)..(5657): unsure at all n locations
gtcttacaatatgaaacagagggagtattgaataacaataatagttttatttttattccagagatatcatactgaattattttttatttattttgtatttttcatgtatcaacaatcttatagagatgtttttatgcttttgatagcatttggcaattccaaaaatcccatgtcagactttttttgcaagttcaaaaaatgattcatgatcattcttcacattcagtcggtgaactgataatcaattgttctttcatggattattaaaacacttaactaatggtagactgattcccttttgtacaatttgctgtgcaaataattgttgaattaccgagttgctcctatgactttttcactgtgccaaaaatgattttgtgagcacctgcgggtgctggtcctcttgaagatggcaacgctatttgtcgatctggccaaattcaaggtgggtctaactgaatgcagaccatactatctctaaaagtgcctttgagcctatagtaagccaacttataataacttatattaaatttggaatgacagtgttttctttttgtgggtttattggcccgagtgaaatctagccagatcaaggccatgtgtgattttggtttctaaataaaagtaatggttatgaacggtatggttttccctttcttctcaggattgaatctttgaaatatgcatgaatggttagctttgaatgaacatttgtactgctgtattatactattaacaagtgcaacttttcaataatgtgacttgggatttagaaattaaggattaaaagtttgcacagaaaaggcatagagaagatattggtagcatttagctaactccaatagagggatggttgtgcaacctataagagagtagttaaaggaaaattggaaattatgtgtataactctgctgcttttcgatgtcatcgatacatcagaaagtaagaaagatgaccaatggttgagatgatgaacagtcattctgtgcatggtttcaaataatcaattattttcaagttatacaaattttaatttgcaatgcttttaaatcctcttttagaggaaccttgaagcagcaatgaggtgacatgcaaaatgcattttgcaccagaacaccttgaactaaaacgggataaatttctgatggtaacactaataggatgttaatttatatatttctcaagatactgtatagtaagagcaagtctccacatttcagaaaattgtgctttccttgcaacaaacggcacttggctagtgtacatctaaaatatcatttctagatcaccatctgtatcgctcgtttagtatgattacaacaatatgcaatttcccccagcaacaaacacaaaaatttggcactgatactactatatcatcctggtttcttctactgttctactcctaggattcaagaaagccaaaagaccgttctttagcagtaacacagaaactaatcaattccacatgaacaaaacaatagtaacttgctaagatttgaccatattatcacggtttcttctactgttctactccagggctcaaagaaagccaaaagaccgttctttagcagtaacacagattagaaactaatcaattccacatgaacaaaaaaataactaacttgctaagagttggaccgcatcatcctggtttcttctactattctactcaggcttcaacaaagccaaaagaccgttcttgaacattaataaaggttagaaactgtagtactaatcaattccacatgaacaaaactacaattaatttgctaagagttgaaacatcagttaatcaagaaaggtagattgaaccgaacgcctcacctagcaggtttcttctcggtagcaagacgcgtcccgctccatgggaacttccccacttcctctccggctctgtctttcaccttggtacctccattcctcttcttccccagcctcccggggttgccgtacaccaccttgccgcggccggccctggagaagcccaccttctcatcctccatccagtgcttccccttgccctccccttccacctcggcgccctccaccgccttcctcctggcggcggcggcgctggccttgcgctccctctcgccgaggacaagcccaatggggaagaggtcgggggagacggggagcggggcgcggagggtgacgtaggccttcttgtagtccggcttggcggcgaggaaggggcccccgcgcaacttcttgcccttcatgttgagggtgcggacctcgccgacggagaagccgtacatggactcgaggcagcgccggatgtcgaccttggaggcggaggggacggtcttgacgccgaactcctgcacgaagaagacggcgcggaaggaagcatgagcttgaggggaaggttggcaaagtggatcacgcggcgacccagccggctccccatggctgtctggctggcnacggcggcggaaggttgggtgtgncgnctgtgaccgtgggtggccagcggcgggaggcgtagggttttaggatccggcgggtccgctgtctagttgcggtgtgactttagcccatatccaccgtccggctcatccgacggaggacgtttggctgtgtgttgtttcgaacgatgtttcatgcgtcgtgcaaaaaaatgtttcatcgataaaaataaggtacataaacttgctcggcgagtgtaaataggtataacaacttgtaaattgctcgttttaatacaatagcttgtctagtttatacgaacctagtacaaaacaacacacatgcaaaattgatctaatgtgtagtactaaataatcatagtgagacatatccacgctagcagttgtttgtacttgtgcagacctgagcacactagcttaattttaaacatatcagtcacaacgatacttatattacaatctcttgtaggctgcatgcactactgtaggatcaagatgtcgactagaggggggtgaataggggatttaaaactaaatgacacctaatcaaaactaacttaagttgctaggcttagtgagggtcaactctaactaagcaactaagttatgttttgcaaacctagggtgatagtggctcaattatatctctaggaaagtaaatcacactcctatgtcaatgtttagcaatcctagggtgaaatgatctctagtatgtctctagaaatgtaaattgcacaaatataaatacaacaagtaaatgagacaaggagacaagagatttttcaccgaggttcggaaactcgccagtttcctactccccgttgaggcgagcccaactccaccgctcaaccacgaagccaccgcacgcccccttcgtcaaggggtgggcaagacgggagcaggcccacggagaggactacccaagcctcggccactagggtagttcttccttcactccgaaggtagtgaactcaaaaccactcacaaaccggcgccgggcctcctccacaatcttcttagagaggtcaccgggcaactcctccacaagccgtctaggaggcggcaacctccaagagtaacaagcaatgacccggcatggagatgataaatcaagtgccacactagctctacaaatagaagcaaatgtacttgactcttgtctagaacaatctcaaccactacaatggatgaacactaagctcaaaggtgtgtgagagaggtgcaaggggtgtatgcaattgaattgggtgccaagagagccctcttgctgctggaaggggagtatttatactcccaccaaccaaaactagccgttgggggcgaaatcccccagctctgtgctctgccggtctgaccggaggtatgtggccggtcagaccgtgctactctgcaacggctagaaaactagccgttgtagccctgtcagagggccccatcggcctggccggtcagaccgacgttgagtggccggtcagttcggcctcggctcggtcagaccgccatcagctcggtctgaccgaatacggctccgtcggctctgtatcggccaccccgagcagcaccatcccggcctccagggggccggtctgaccgcgcatgtgccgccggtcagaccgccgtttcgtggccggtcagactagccagggcacgccggtcagaccgccactatgtggccgatctgaccgcccctggtcaggccgaacccagtgaaaaaaaaagattgtgtgtgtgagatgaaatatgagcacaagtctaaatgcataatgacctaatgtgtcaattaaaatcatctcattgctaggtcattacccccttgatagtacggcgaaacaaaaaaataaactaacaaatttgatcgcccttcacctcgactaattttaaaactaaagcactagttttaccgttttcttttcttcgcttcgcgccatcaaattttaatccatcgatagtcatccatgcgcacacatgacgtggacctaacttaaaatatatctcaatagcaacggttagtccacaattagcgcttgtcattaattaccaaaattaacaacgagggcctagatgcttcaatctgcccctttttggtaattgataacaaacaccacgaatatatataatcaaacatagaacacatggacatatactgtaaaggaaatcaaaagctccccctaaacatgtgcataacaatcacaaatggcaaatatggagccaatgcacatttcaatttcacaattcaacatatcacaaacacaagagcaatatctcaatgtgaacttcaagaaatattcatccatgagcataagatggtcatatatatatcagtatcacatacaccatccatcattgcacaagttcacatcacttaaccattcaactcacataagtcacaaatcatcctaaaagggctcacaaataaacataggctattacaagaccacgaagggtccaaatgacatagagttcaacaaaacgataaagaacacacaatatagagtaacagcccatacccatacataatatagctcaaaccaccttaacctattagatatgaggacactaacctcactaccattagtcccaacccacaatacataaagcacacctaaggacatttttctctcccttttggcatcaagtaccaaaaaggtcttaattcttgtggaggagaaggaggaagcgccaaagaggaaggattaggagtatcacgacgacgatgatatacaaaagcttgggtgctctccaacatttggactcgagaatccaatgcacccactctagtgtgcaatctccccatggaagcattcaagtctccaacatcggtgcgcaagccacgaacatcctcatgcaatgcttcatgcctggtagacaagcgttgaatgctttcacttaaggtattaatagccccaagtaccgggttgaagtattcattgggttgcattccaaagtaagcatagtgaggatgaaagaagcatttggatcatacccatgaggaggaggaggtgctgggcttgagctagctccagggtgagaagagggcaccgtcctaggagcacggggagctctaggctgaaggcggggcttgtactgcttgtgcttcttcaaattttgcccagcagccccaagcttgttcttgaatcaacctcatgatgtaaggggcataatagattccctgagtgaatgtcctcttgaagatagcaatctctggcatcatgagagacacaa

SEQ ID NO: 9658 - DNA, 5945 bp, Oryza sativa
  unsure (1)..(5945): unsure at all n locations
tttaaccacactggggatagtcctcaagccggcaaccttcccatgtgtgtaccgcactccatcttcatagaactgagagagatagtctatggagagcggattgtgagtgtgctcctcatgcaaatcatctccaaagtccaagcgaatgttgaggagctgccggaattgccttcgagagatagaacactggagggtgtcggacatccacttcatctcactctagtctccagccacccacactgtagcatagtactgccggatcaaatcttcattgtagtcttgcttgagggtcacaatccggtcaatgccaacagtcttgaagagatcatgcaagctctcaaactctggagtctcattgatgtctctccaagaaatccacttatgctctacaaatgttttccctgcataaacctgctcatacacagtcttctggaaagcggtgtgaaaatggggatccggggtgtcccgaggcctcaagaactgatcatgatgccttaagatggtatactgcgatggattcctcatgttcaccacaaactggatggagggatcaatgttcatctcatcactttgttcatcctcatcctctccacttccactgacatcatctccacttgcctcctcactagccccctcaacattggcctcaacctcttcatcactttgagcgtaatcctctccgctcgattcctcaggctcactcatgggatccagagtgggcgcacgacaaccatggcgagtgcggggaggcatcactgtcaaaaagcaaaggatgataggatattagcaataattctagaaacaatttggagaggtgaaaatttgcctatatccagtggagggatggtcagaccgcagccagtagggcggtcagaccgacagcatcaggccggtcaaaccgcccatggtggccggtcataccgcccatggtggccggtcagaccgctcactggtggccggttagaccgaggctgctggccggtcagacagggcgcacacgccagtcagaccggcggctgacccacggtcagaccgcctgtggctccgggcagacctcctcccacaagttcaagcatccaaaaaattttcacatctacacatttgagtctaaaatttgctggaacaatatagcataggattggaacatgaatatcaaagggttggacatatttcatcaagattggaacaaaagaggaaactacccttaaccctagaggttgaaatagatcgatttgagtgaatgcacaagagggagagtgatttaccggttgaaggagttgaatcacaccaagaaactaccctctattggtgcaaatcgaagaacacctcgtgcttcacctagggttccatgccatgaatcaaaaactcaacaaaaacacaaaccaatccatggaatagagagaggaagcggaggagaatcacttacggtgtaaccggagagaaatctgcggtcaaactgaggggatttggtggaggaaagagttagggtttgaggggaggtgagagagagagagagtttttcgggttgggggtgaatggggatgagatgggagagggtaggtgtgggatggagaagaaaaggggcaaaactgcctgggcccacctcggccggtcagaccggccctatgtggccggtcagaccgccgcacctggccggtcagaccgcgcatatagcgccggtcagactgccaggccccctgccggctgtgcacagcccttgcacaagccggcaacccccacacaataaaattcaacaaaaatttgatttttggagcaatttttgaaatgtgtgagtttaaatattgctaaccatccacaatatttgaagattatgatgatttgcaacaaaactcacttaagtgctatgaggtgaccttttatggtctataggggtttttgggccaaattggttttcaaataacttttgaatgatttggtttttaaaataggtttgaataccaaaaacatttcaaatcttcttctctaccaactttgttttgaaaattttctcaaattccttctcaatctcattttggggataaatctcattttggccaaaactaagaatctagtttcttcaaaagagggccaaaatggcattttcattcaaaaatcatttttcttgcaatgtgaggcttggaaaacatataggaaaacttttgaaacattttccaagagatagttttcaaattacatttattttacaaaagttttgacttatgttgacttggacattttgaaaatactactagcaccactatagttgatttgctcacatataaaaggaagtagagcacatgcaagagtgcaaaactcccccttaatgtgacatgctccatttctgcaatgaagaaccaaatggcaataaatccaaagcataagtgcgaatgagagcaaatatacacaatgcaaaagaagcaaccatggtgcaccatctcaagccacattagagaaatctatgacatttaactcatttctcaacttgcaaaagcgggtttcatcaagaggcttggtaaatatgtcggtagttgatcctcggttcttatgtggctaatgactatgtcacacttggcaacatggtctcttaggaaatgatgacaaatgtcaatatgcttggttctagaatgttggaccgggtcattggctatctttatgacactatcattgtcacatagnaatggggtttggtgaaggatatggcatagtcaaacaatgtttgtttcatccaaagcaattgggcacacaacttacccgccgaaacatattccgcctcggcggtagagagggcaacgnagttttgtttcttggatgaccatgacacaagggatataccaagcatttggcaactaacggatgtgctctttctatccactttgcaaccggcataatccgagtcggaatagccaacaagcttaaatttagcaccttttgggtaccacaagccaatagtagagaaatgctttaaatatcttagaatccttttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcgagatgcccgttggttgccataggtgtcttgatgggtttcgcatcctccaagccaaacctcttgagtagatccttgatgtacttggtttggctcacgaacgtcccatccttgagttgcttgatttgaagtccaaggaagaagctcaactctccaatcatggacatctcaaatcccctagacatcaaatcaccaaattacttgcaaaatacctcattagtaaaaccaaatatgatgtcatcaacataaatttgacacacaaagaaatcatcaccaatgatttttgtgaaaagggtggtgtcaacttttccaattttgaaatcctttgacaaaagaaaatctttcaatctttcataccaagccctaggagcttgttttaaaccataaagagcttttgagagtttataaacatggttaggatttttaggatcttcaaaaccgggaggttgttcaacaaagacaagttcggcaatttcaccatttagaaaagcacttttcacatccatttgaaatagttttatatcaaagcatgatgcaaatgcaagaaggatgcgaatagcctcaagtcttgccacgggggcaaaagtttcacagaagtccaaaccttcaacttgtgtgaaaccttgtgccaccaaccttgcattgtttcacaccaccaacccgttctcatattgtttgttcctaaagacccactttctccntatgacattgtgatctctaggtcttttaccaatgtccacaccttgtttcttgcaaagttgttgagctcttcatgcatagcatttatccaatccgaatcacaaagagcttcatctacatgttttggctcaaggcaagaaacaaacgagtaatattcacaaatcgaagcgacacgagatcgagtttgaacacccttactaatgtcacccaacacttggtcaattgggtgatccttggaaagagcggtgtgtatcctttgtggcataggtggatcttgtgccttctcctcctccacttcaacttgagcttgacttggcgtagcggaagtagatggctcatcttgagtgaaggtggatggtttgtcttccactttaataggcttgacatctctaatagacatgttcttcatagctctcatcaagccttcatcacctacatcatccaaattctcgtgcccctcttgggagccattagtctcatcaaaatgaacattggcggtttcttccacaatacctttgttcttgttgtagacccggtatgccttactatttgaggcataacctagaagaaacccttcatcacaccgacttgcaaatttggttagtctaacaccctttcgataaatataacacttgcaaccaaaaactcgaaaataggcaacatttggcttcctcccaacaattagctcataggaagtctttttcaagagatgatgcaaataaagcctattggttgcatagcaagcggtgtttatggcttccgcccaaaaggaatcggaaacaccatattcatcaagcatagtccttgccatctcaatcaatgtacgatttttcctctccactacaccattttgttggggtgagtaggtagcggaaagttcgtgtttaataccaagatcatcacaatagtcctcgatattggtattcttaaactcggaaccattgtcacttctaattttcacaagagtgcaattaaattcattttgggccctttttgcaaactttttgaaaagctcggcaacaatagacttgtcatgcaaaaaagaacacccaagtatagcgagaataatcatcaacaatcacaagacaatgactattaccaccaatgctcttataggttgttgggccaaacaaatccatatgcaaaagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttactcaattgattcatgctaacatgagctagcctcctatgccaaagccaacccaatgaagtttttacaactaaacaagttttcaaatttgcttcactagaattgaaatcaaccaaataaagatttccatatcgaaaacccttgaacacacaagacttgtcaagaaggctagaaacaatcacctcttgagggaagaaagcacatgacaagccaagatcacaaatttgagcaaccgaaagcaaattgaaatttagagatttaacaagagagacattatcaattgacaaataattggagatagcaattttacctaacccaattacctttcctttgctattgtctccaaaagtcactttctcttgttcattccctcctacttcaaatgtggtgaacatagccctatcaccggtcatgtgttgagtgcatccactatcaagcacccaatggctcccaccggtgcggtagttcacctacaaaagaagatcaagctcttttaggtatccaaacttgtttgggtccttggaggttagagaccaaagctttgggcacccaaatggcattctttttaccactgagtataggggaacccacatatctagcaacaatgctaccatcatgagccttcctaagcatataatgagaatcaaacatgcatgtcttagaaggcttaccatcggggaaatcactcaccaaatgcccaacctcacgacacttggagcaatacttaccattgctcttgacaaaacgagtggcacggtgagaaggtttcttacccttctttggaatgaatccaagtccctccttgttaaggatgca

SEQ ID NO: 9659 - DNA, 860 bp, Oryza sativa
tcaacttcggcttggagagcaatgcacttcttggaaggtgaggcttcctccatctccttcttcttcaacttgtacatgtcattggtgttgatcttccccaagaggcttgcgggtgtcatccttgacatgtcggagttgatgagcatggtgaaaagggtctcataattctccggtagagccctaagcatcttttgggcaacctcaaaatcggtgtagtttgccccaagccccttgagatcattcacaataacattgagcctcccatacatgtcattcacgctctcatgaggcaacatggagaatgtctcatattagatcttgagaaaatgaagcttggcattcttgtactcgcttgtgccctcatggatctccgccaacttgttccaaatctcatatgcggtctcaaggttgctcactctatcaaactcctcttggctcaaagagttgaacaaggcattcatgcttgggcattgagttggaggttgcggtgatcaatctccgtcaagggtgtgccggtgatagcaaagcctacatccacaatactctaaatatggaagctcatagctttgaggtgagtagacattttaattttccaagtagagtagtttgtgccattaaacatgggagccttccctacatggttcacctcgttcgacatcttctctctaggcggtgaagctcaatcaagagagaccaagctctgataccacttgtaggatcgagatgtcgactagagggggggtgaataggcgatttaaaactaaatgacacctaatcaaaactaacctaagttgctaggcttggtgagggtcaactctaactaagcaactcgggtatgttttgcacaccctacggtgata

SEQ ID NO: 9660 - DNA, 14959 bp, Oryza sativa
aggagagagctcgtaagagatggcttttacgttagttgtatacatggagatatgtcagacatgtgtgactgagtctgggagtgatgcagctagtgcatgcgctatggagacaaaagggagtaggcatcaaaaatttacattaacgaacgtccgatacatggttgtgcccatgctaatgttatggttgcggccaggggcaaatccaacgtggggtgctggggggctttgagtcccctaccctcgttggatcccaatggagagaaggtgaggggaagggggaagaagaggaagatgaaaaggagtagggggactgaaaggatgaaggagaatatgagccctccctccccccctcgaaatagatctatactagggatgaaaatggtcggaaacggtcggaaaaaccctctaccatttccattttcattttattttctcgaaaatggaatcggaacggtatactcagaaacggtaacgatatcggtaatgtcggtatatcgaaaacggaaccgtcggaacgggaatctaccgatgtctgtcggaagtcaaaaattcatgtcggaaatagcaaatcgtggtatcatcccacatttaactatgtatgaagatgaccttataatttcacccttgcatgatcatgctgccacaccccacacaacaccgttatatgatgattaataagttgacaataaggtcgacaaacaatataaacaaagttcaatgatacttcaacatcaatgtggctaaagcatacaatgtggcttacatgataggattactgcataactaatattgtccgactttttttaggatatagatttgaagtcttcgagaacactgaacaccaagctcacaagctggcatggcttcagctgatcagctccttgtcaaacatcattcatcatttcatcatcaattgacatagctacatcgtcgtcctacagtggcacattgcataagaacttttatgttgacactgtataactaccattggaattaagtttcacgctagcaaagaaatgaaatttgtacttacctcaataaccaatttgtttgccataagctcagcaagctcaagatcaaccacaattgactgaatggcaacacgatctgaaaaaaaacaaatagaaatatattagtaaaatagttattgattgttgcacataaataaaatgtctaaactgttgtaattcttacctcttcttactccagctatccaatctttagtacaaatcaatgcttgtgccatttcagaatcaagacgactgcaatatggatcaacgacacggccaccagcgctaaaggccgattcagaagcaactgttgaggcttgcatagccagcacatcacgagcaagtaaggagagaacatgataagtatctttctggttcttccaccaagctaaaatatcaaatgtactttcatttgctttagtaaccttcaaagtttcttctgacaggtacttctccaaatcatttacttttgaagaagtgttatgtgtttcagcacgatatagatacttatcaagtgcactaacaaactcagttggatcttgatttgcatctggtgtatcaataggttcaaatgcattatgatttctaggaggtgcagcagaagcatagcagtcatacatgttccggatgatattgagaaattcagtaaccttaattggatgcatatcctagtgtatgaactccatgcaaaattgtactattctcatcttgaatctaggatcaagaaagcttgccacagcaagagcagtgttagacttattccaatatttgtcaaacttagcaagcatagcagttgccatccttctaatagtaatatcagaatccttgcccttactccaatcagtaagtataatcttaatgtcacagaatcctttgtaaaacaagtttgctgtaggatataaagtaccagagaaaagctcagtaagatcaaagaatcttttcaagaatgcgcgaattttcattgctttctcccactctgcagctgaagggcacattttctcatacctgcgccgatcataggatgtaagcctgtcaaaagcagccctataatagatagcatctgccaacatgagataggttgagttccaccttgtagaaacatcatttaatagtcctttggttgtgtccaacccactttcagaagcacacttcattaactcctcccactgcaacggagagccctttacagcattgacaaaggatttaattttctcaattgttgattcaatttcttgcaaaccatctttagcaaccaaattcagtatgtggcaggcacatctaaaatgaaaaaacaggccaatacatactaagggactgtgcttcttaagttcagaaattatatccttaacagcaacaaattatatccttaacagcaacatcatttgcagatgcattgtccaaagtcaaagaaaacattttcttctcaacaaaccatctcagcatacttgtagtaaaaccctcagatagtctaacaccagtatgacgtccttccacatgggaaaaggtgacaattcttttctgaatacaccaatcatcatcaacccaatgcagtgtgatgcacatatatcctttgttttgattggatgtccacatatccatggtcgcactaatgcggcatttcacagttttgagatattcatacaacttatccctttcctgcatatagatgctcaatatttcttttctaactgttacacgggatttcaatggaaagttagggcgcaacgatgtaatgaaatcacgaaaatattcatgcccaaccatattgaaagggtactcatgcatgattattgccacatataacttcctcaagctagcttcctcatcatacttgtaaggttcaacaacgttgatgcccttctcttggtccttctgagctttgagttgttgctgccctttgacaacactgtgatgtaatttcagatggctccaaaatccgcttgttccagtggcactctcacatctacctttgtaagtgcaattcttgaatttgcaatgtgcccactcctgtttatagatcttaccattctcatctatactcactttttccttgttgaagtactgccagacttctgatgtcaattttttccttttcacaggacgctcatcattgtcatcaaccctattaacatcagcatcaatctcaattgtttgtgaggtacctgtggcaatggttggaggtaccgctgattcaggtgtagaggatgatgcagtcacacccacatgatgacttccactggcacttccagatgcagcagattgagattttaaaaaaatgaggaagtgattaacgattaacacaaggctcagctatacatctaaaaaaaacatgctcaaggattaagctgtacatctacagaaatcgtgcttgcacacatcaacagaaaatcatgctaaaaaacatcaaggctcaggcattcatctatacatgtaaaaaaatcatgctcaagcattcaagctatacgcctatacggctatacctggggtggtggtggtggacctagcaaacacaacggtggcgaactcaatgttcctctgtctctgttgttgccgtcggatggatccagaagggtgcggcgttttcctccggcaggtgccatcttgcttctccggcaagggacgcggcgaggcgcgaggatgcgacggctaggactagcaagcggcggtgtggcggcgtggacacgtggttgcggcggtggcggtcaccggaggtagaggcggcacagagctgtgcgacagtgtgagacagcgagagtcgcgagacagggagagtatgagaaggataagtgacacgccggctgacgccctagggtttttcttcccagcctaaatgcctaatgggctgctcctgctccagctatacaggcccagccggcttccttctttagaagtttgtcgaaaatttgacggaaattaccgataaaaatggttaccgacaaaacggtcggaaaaaagcccatatcatttctactaccattttcggaagagattactgttttcatttccgataccgacaattactgataccgactgaaacagtcggtgcaaaccggaaacggtagccggaattctcggatatttctgtgccgttttcacccctaatctatacgatagttgattccttagttctacttaaacaaggggatatctgaaggtataaatacaaggccccctagaaagagagggacgaaatgaaggcatatctacataaatccaatgtagaagccccaaaaaccgacatgagggatttagagctaccttcaatctcgccgagttcatattagaggaagaagactacactagccatcaaccacatgtgagagctccatgccgctaggccgatagggattagattaggtcatcccatattctgtactcgtgagatattaatatacaaaggcaacattggctttgcccaacaggaacagggctattacccatcaagtagtgggtccgaacctatataaaaatccatgtctaatgtcttttttacctcaatctcacgtataccctaacaccaacgatcaccattctctttgaataccataggcgggcatagtctgtcagcaataacttgtatgtaactaacaaataatggcgggtatccgatttgctagcagctttgcactgaaaaatctcaaggtcgtgcgcttgaatcctcttgcctgcgcaataaatctagcaaaaaccatttgataaacctggctaacatgcataaattgcatatgatgtatctaatacattttgttttattttccacatattcgttttggaggaattttaaaaaatttaaatttctaaagattaattcctataaatgctgttcggttcataaaaatgttgacatagaaaaaccaaaagaaaaattcctttcctacaagttgtacagaaaaactataggaaggttttcatccactcaaacctcttgaaaattttctatgggttgaagtgtgcatacattgttgatctttttttttctccaattcctttggaacgacttggcccttgctagccaagtcactttgacaccttgacccgattcaaacaagggttaattggatacatgccattaaaaatttgctggttttaaaatataccactagtattcatgtatttgaaaatatgccattgtaatttcacacatattcaaaagataccactacttacctcttggatgcatttccagaaaaaaaatagaccaaactgccccttttcccttcttctttcttcccctttctccttcctcctctcttccttctcagcggcgcgttggcggcagcagcagcagatgcggcgcggcgacgacagcagcagcagtagcagcatcgatgcggtggtgcggcgacgagcggcggcagcagcagcggcgtggcacagcagcagtggcggccgcggcggcagcagctgcaacaaaaggcggcacggcgacgagtggtggcagtagcagtagcaacatcgacgcggcggcgcggcgacgagcggtggtagcagcaacagcggaaccagttggccatggcgctctcggcgttcggcagcgtcgccgcggggctcgtggcagtgccggtcactgtgttcggcactggcatcgacgaagccgtgctcgccaaatcattcaagaccgatgtgcccacaatccagaagctcaaggtgaacctgagtacctgactccacccaacaagccctaattaagcacgcttgctaatcttctctcgccattgtcgagtggctgcagtagtagggccacggcggcagcaatgagctgtagcgacggtgagcggcggcatcgcgaaaaacattaggagtggtggggatggaatgagcggcgcagcgaggggaaagagttgaggggtagaaaatggggaagagagagaggtagaagatgagagcattttcattcaatacatgcaaaatacgtatctcagtgacaccactaagatttcaaacaagtagcagtggtatcgttacaaatatagacaaatagtaatgttatatttcaaaactgctaaaattttaatggcatggatctaattaacccttcaaacaatgccccttttcccaacccctttctctcgttttccgcgcgcatgtttttcaaactgttaaacggtgcatttttttaaaaaaaagtttctatacgaaagtagcttaaaaaataaattaatctttttttaaaaaaaattagctaatacttaataaatcacacgttaggccatgtttagttccaaaataattcttcaaagttccaactttttcatcacattaaaactttcctacacacataaacttctaacttttatgtcatatggttccaatttcaaccaaactaccaattttggtgtgaactaaacacggttattgccccgttttccaggctcaagcagaaccagcgaacacaccgtccttttcttacagaaaaagcctgcaaaactgcaacaaagtagtcctccaactccaatccattaatctcaaccgcatgtaaaagcacattcaaaggtcaaaatatgacaggttgctttacatcacgtcagtttagcctttaatttaacgttatctgttcttccattcccattaatccgccatcaatatggagcttttcgttaatcaactccaaagctaccatctcgtccgtccgatcggtacggcgatcatcgtccaccactagatcgatcagtgaggcagagacctctcaatctctcgcgtccctctcgctctcttcccgctattcttctcgtccagatctggacgtcggagcaccgcccaccgctcgtccccaccgcggccggtgcctcgccggcggccggctcgcccgcactgcctctaggtcgtaggagcactgccagctcgccagtgcggccgaagagcggcacgcactgccccctcgcttctcccctcctgccctctccgcgcacccgacatcgccgccccccacccaccacagcctccacggccgcccaaatgtcggacggtgaggagaagagggagatcgccgtctggttcctctccaacgcccccgccggcgagatccactacgtcgccaaaggcaatccccccaacccctcttcctgaccctcgcaatccaagctgtacagccccgtgtgtttcgttgtttgattcctcttcggcgtgggcgcgcagatgtgcgagcgctgctgggggacgaggcggtgtacgaggccgccgcggcggaggccttcccggagcacaacaaggcgcacctcgtggccctcgagctccctgaccgcagcggtgatgtgagcactgggccatctcctctccttgccgacttttgccgtcgcgtgttctcacgtgctcgaaattgagtgtgttctatctactgtagggttgtgcttgttgtagctcgtaaatcagcggttaagacttagcaaatctggcttttaggtagtgattaataaatcacttgtggctattgtgtttgttactttacttttattaaattcagtaagctattggtgtttctcattggtatgtttatgagcatgagactataggatgatgccttaacactcgagggtgggtgcttgctggccagacattaaaacaatgtgtcctcgcgcgcagataattatcacaacttatggggagcttgacaagaacaattatctggatcctaggactgctcaagttgctacagtggaccatattaaacaggtaatgctgcagactttacatctgcttatcctggatttagttcttaagccagctatgcatatttaacatagaatcttttaaagtaagagaacatatataactactaaacaatggatggtcatcttaacttatggtctatgaactatatgaagcagtttcacgtctgtaatttaatatgcacagtatcttgagcttgatggtttgactattcttattcatttgatgaatattaattgagaaatggatccaatcacaggatattgatactgaactatctttcttgaagaacatgttacattgaatatagtccacatagattagtattgtaactgaactctgcatgtaaaagtttgatcccacaagtttctactttttttatttacagtgttaactgaggaataaattatgaccataattatgaattttctggacatagattaagttacctattttcaatggaatagcatagatgtaggtaaaagagcttttcattatacctcaaatagtacatccagcagcagctgtattaagcttcagtaactagtattacaggtttctgcccaatccattttgtattaacttgtgttacctctagacaatggctttcattctctaacaccgggttagattgagatgtttggttaagtatttgtttttgaaatgtctatagttttctttgttcatttgaaacatgatgtgtctgctttaatttaagtcaccatgttttttgttttacatgttaaaagaaatgtacaaaattgaggccagctgctgatgaggagcttccttcagcatacattgaagatttcaggtaccataattatgctattcttttccccaaatttcttgaactccacattgccttgctagtcaatttatgttctgcaccttttgttatgggtgcaggagtgccctggatgttgaattatccaaatatgttggtgaagcttatccaaaaggggtgtgtgctgtttattgtaccagcggaaaagatatagagggaccaggagttgattttcgttttgcagcagttatttctgctgctaaacgcagcccacaaaacttttggtatgttgtctgagtctgcattttctctgttgttacagatacttgcctagttttctctaatcttgaacttgtttatatgtccattttgtgtatctcttctatacattttagatccttattgaggtttctagaaaattttggcattcctatgagaagctatttcatattcaacttctggatcataggtttgcacatctgtgagtgtttaattctttattttccctttgaactaatcatgtgttttgtgggtaccctctttatcatcttcccacaatattatggtgtctttagtttttatgcagaaaagtttagaattgtgctttggctgaatccttgcttcacataatctgttactagagtcgcttaagtcctctcgtcatagtttgacatttcattatttattcactgatggagacaactttgtattgagtcatccagcaacggcaattggcgctcaatttggactctggaattcatagatggattacagcttgtcgaaattaaagggaaaatacaggtttgcttttacttagctagcgctaaaacatggttaattattgttattgtaattgaagttggtaactaagatacatgtgcatataccaggtaggtgctcattattttgaagagggaaatgtgcagctggatactaacatcgattgcaaggattccaccatattgcaggttagttcatacaatacctattttttttatcctggcatgttatgaacgattgatggcatctgcttcttttgacctcgtgcagtaatccacacactatttcatcgtttgttgttttgctgctttaggtttacgtgctaagttcattctactgttcaatatattttggagaaaattttctcctgctttggtatgatttgctactgagttttagagaattatatatacatgtataccctgtaaacttagttgcgcatgcataagtatgtgctctgcattcatggatgaagtacagtttatgttactgatagattttcatagaaccttaaaaaatttatatctgcactatgcttaattgtgttgggttggtgcctgatactttgagttgttgtcgatattctattgatgcaaactgttaaaacaaacaaagttgaaattttatttatcctttttatttcctggggtgaactgaaaggatcaacttatgattgagtagattttttaatataaaaattgcacgggtaaattttgcccctatttcatttcctttttggttctggagtttttgcatgtgcttgtccggagcatttgtgtatgttaagcgtaatgttttgtttagagctgcattatgcttgcatcattttgcttgctttgtttttgcttgtttttaatcttcaccaggctgaaaaatgcgaaacccttaactgttcttttcatgtgctattactcgtgtttcagtctcctgaggaatgtgcagtatcaataactaacatcattcggcatcatgagtcagaatatttgtcatcacttgaggttgaaacctgtccctatttgtttattcaagcttatatgttaacataatgagtaatgccattcttttcacttgtgaacaggaatcatacatgaatttgtctgatgcaaccttcaaggtacaccaaggaggcagtaacaatttaagaatttgcatgatagttataatgctagtaaattttgttgctacttttacctatcctctgctcagttgtgtttactggttatatatgtgcacaggatcttcgaaggaaacttcccgttactcgtactcttttcccatggcacaacacattagccctcagccttacaagagacctcaccaaagaactggctataggaaaatgaagcttgtggaggtcagttcattagattagctttgatatggatttttttttatctccatgctatgtgttgttctgtagatcctgcaattcatatcctgtagccagcaattctcttgttttgatttctgggcttccacatatcagtgtaaatcaagaacatgcacttcttgtgaggaagttacatttcaagaatatatgatatctgaatgttgactgtgtcaactcatgttaactcttgctgccgtcatgaaacaaaccgggcaagcctaaatcgattctttgagatttgttgtatagaacattggtattatttgcttccgaaatagtggggtttcctgccaaaaattactgtgtttttacagccccattgtttcgcttattagcaaataaagaatcttttgtgagtaaaatttttatacttgtggctttagtgactcaaaagcaaatgctataaaataaactatgatgaaaaaaaaaaccaaagaatcataatcaaaattaagtttaaaattcaaattttggcttataaacataagtataagaaattgcaggttttagggattagccatttattatcttttcactgccgccgaggtgctgagccaaatacgtcaccacaccattgctgctcgtacggacggtcatacgtcccaaaggctcaagcctaaacctccaacgatcgtcctgcacgattgttttacccaccatttgttttggtatcattgggctgggccatgatatttgcagcggtgtcaagcatccgacatcaacggcggctgcgtagattgcatatctcggctgaggctctgccgtaatttcagccccgtgtagctatgccgttaaaagcacttggctgaattcgaggttaaacagttgtgctcacagtatgaagttatttttgtgatactgtgtgatcaaacaattcagcatgaatgcattgatctcatgaaattgaaaagatatatatcctgatgagcaggatgaggctcgtagcaaccagcaagctaggatcacagggaacaggaaaacaatatgcttttttcccctttaaattcacaagatttggtctcacacaagttacacacgaatcaaatgagatattatcagacaagctcatcatatcgtacaacaaatatgtacaactccgaatatgcaagcagagacacgccagacggccggccggcgtcgttcaagcagcagcggtttccgggtaaggatcggcccaggacgcgtccgccgccacggcctccttccatctccggttgaatatctgcatctcggcgaaggatcgccgcctcaccgcgatccggccggccgacgccgaccacccgccgccgccgccgagcgaggggatgcccctgtgcatgacgtactcgctgtcgacgacgccgaccttcatcgtccggtcgccctgcgcgcagtagccgagcttgtagtcgaggccccacccgtggacgagatcgttctgcaccatgccccaggtgcaccgccacgccgcgcgggagaacaccggcaccatcctctcgacccaccccgtgcacggcggcgccgtgctgccctcgtcgcaccgcggcctggctcgcctgtagaaccgccggtgcacgtcgccaccttctcctcctcctccggccacggtttgtcgggcggtgatgccgtggtggatctccgagccgcgcgccagcgccggctgcgagacctcgagcccctccctcctgacgatggcgaggtagcgggcggggtcgaaggcgtcgacctcgacgtcctcgtcccacaggaagatgtagtcgtactcggccaccacgtcgggatggaggaaccgcttggcgaaccaccacttcgtctgccccgccgccgccacgtgcaccgcgcggccgtgccactccaggtcgccccactactcgaccgcgccgtcgtagtggaacagcatcaacgcgaactcctcggcggggaacttggacaccagcttgtcgacggccgccttgttcttgatcccgacggggatcgccaggaggctcttcgacgccttctgccgcccgtgctccgggtcgccgaccatggactccatctccaggttcgactcgccctgcacgatgcccctcgggagaggctcgctacggccgccgccgccgtcgctcgacgcgggtggcgcttcagctcgcttgtcgtcgcgcagcatcttgcgcgacagggtggatctttcggctgccgcccgtgaagtcgacgggctgatcgggcgccggtccttgtggtgtaccgtgacggccgcgcgggcgcgaacaaggagaccgagaaagacgagcgccgccaccaacatgtgcggagtggccggcttcatctgcggccgcggcggcgacgagcccatggctgctgtcaagtaatcgtcgccgctatgttgcaccatgattgccatagagtccatgcattcaactttatactgaggatagggtcttggaggccgactccgaactggacacgtacgacgtacgcgacataagctgactccgaacgggatttggactactcttaagtaatcgactgataattctgtcaaaaaaaaatcgactgataatactcgccatcggtataccgatcgctcgattattatcgggtgctccaataacaaattaagcaactgctctttccactccattcatacgtatctcgctctaatttactttttttccctgagcttatttttttgctttgagaggtttgtcaaaataatctttctcctaaattatttatccaacatacgatttgattacaccgttatattcgttgtaattaaaatctttacattaagatatcacatgatcatattatgatgaaaaaaaatatatctttcaatccatcaacactcgatatttcatatgcaatagcaacatgttttcaatgtgtgtttcaccatgttttataaaatttacccaactagctacttgcccctactctcacctctctctccactgcatccatccatacatgcatacatttatgatgctcaaaacaattttttttctcctaaattacttatacgatctagtccaatcacacgttgtatttcttttaattcaatttttacaaccagatatatattccatgattatattctaataaaaaaaatcatatgtgtgaatctgttaacactcgatgtttcatacgcgatagccacatgattcaatgtctttattgtgttcccaaaatttttaaatgtttcattttttttatcaaatataacttaatgttttaccgatggtcaactgaaatatttgaccgtccttttttttgacacaatcggacatccgatttggagtttcctcctaaattgactactaaaaattagaaaaagtaaattttattttgggtcaaatttattggagtttcatgatagaagtaggtacaaagtactgcctctgttcacttagagcgtatatattttgactgctcatttagaacgtattttgatttaaaaagaacatttggaatattttgaccaacactaataaaattacaagtatattaatttacttacaaaggtgaccaataaattctcacttcaatgtgttttcacacaatattgctttcataactatttaagatgacaaatcagtggtgaacgtttgcccttgaagatgttttggaatcaaaatatgcgttacaacaggcttgctaactttgttgctaaactcgtattaaaatttctaattctattatatgaaccaagggcttgctaacctactacgaaaaccatttttcgtggcggccattttagatttttgctggcggaatttgcagccgacacaaagcaaaggccagtgaagatcaagatcttcgctagcggttattgaccgccagcaaaaatacattttcgctggcgttggcttaagacggctgccagcgaaaatggatttttgctggcggctgtgttaaatcggccgccaacaaaaatggatttggggaacaaaaaaacacgcatgcagctgcccagccgccagcgaaaatacccatgtagccacccattagttcattaattttaaatttcaaatctacatctagattcgctgctcatttccaaattcaaacacgaaatacaaaatcatcatcagcacagatcaaacatcatttacacaatcaaacatgatctacacagatccaaacatgtgcatcatctggaacaacatgcaaaaagaaaaagaaaaaaaaaatcaaatctagccgacggcggagcaaggtcgacagtggcggatcccgcctccccgcggcccggtggcggcggatccggcctacccgcgggccgacggccgctcccgagcgccgtcgcgcccacgcccacgcccgagccggcttccgctgtcgtcacccacccgcctaccgccg

SEQ ID NO: 9661 - DNA, 2721 bp, Oryza sativa
  unsure (1)..(2721): unsure at all n locations
ttttggcatttctccgccagcgaaaatcatataccaatgccatgaaaaatcgtttttctagtagtgtaactttgttgttacttttaaccctacaaaatcgaatttggtagaattagatgtgtgtcgacggactatacccgcagacgatatttgtagagtatgatgatcgttggaaccagggtatacatgagattgaggcatatgagacgaaagacagagatttttatacagggtcagaccccttaactggcaggtaatagactaacagccatactcctattggttgaaaccggtgttgcttttatatatcagtatcatacaagttcaatatttgggatgacctaatctaatctagtcattgtcggcttggaggcatggagctctcacatgtagtcgatagctagtataggtttcttccttgaatatgaactcggtgaaattggagatagctctagatctctcatgtcgacctctgaaactcctacattgggtttgtctatttctgtattggcttgtattccgttgaattgtcctctcttctcctaggggttcttgtatttatagcgaagatcattttcctctctaagttgaacttgaagaaatataacaggatatagactaaggagaccttatcttccccaactaggattctaacaccttttatttcaggaagataatttccttctttatccgccgtattttcttaatcaaagtatatcttctcatatactattagatatatagtatttttgtatatcacgaacccatgtataagaggtatgccttatccttgacactagccatgtgttcttaaagtcttatcaaagtttttaaagtttttaagagtgaacttttgaaatttgataaaatatcaatattaagaatgtgtttattttgttgccctaccaaatttgaaagtgaagttggtaacaaagtgaaccacctgcaaaggattaagcaattcttagttaaaaaaccagttaaattagtggttatgaagcctaagataattgataagagtgcttaaagtgtacaaccgaataaggccttagaaattaaacaactcctatttttttttattttaatatataccctcacattatattggctttgttcggatgatatagttccagtagcgttgcggctgtgctgtagccagctagccagcagttacatgagttgcttccatccagtattgagcagttgcttcttgcagctgtgtgtctgtgtagctgaatggctagaatgtataacataggctagaacgctgcaacaatggtctaccgaacaagcctattatgtttaaagatttctagctccatttttgttttttttaaatcactcttacaattttcagaataggttttttttcatggctatcttaaaaaaattaaggctcacgacaatgatataaacatgtgaaagatttcatttttttttataagaaacaaatcactacctcatgatgtaattctttggcaacgtgtaagaatgaagccggcaagaagcgaagctcgatggtcagcaacgacaggacacggctgctattccgcttctttccgctcggaccagcccactaccggcccactactgaagtgaaaccaccctccgccgccgcccgnnncgtttttcggggcccccccgggtttaaaaggtttttcccaaaaaactgtcgcgcaccctttattccagtgctacctccccgccccgccgttttgccgcctccggctgaggcgaattttcagtttccaagcccagtcggaccatantcaagggagaggaggaagccctaccttccattttcgcgcttcctaacaccctatnagngcacgataagaggggaggagtaccactgccacgacttcgagtggaaggacctccgggcggaggtggaagccaaccctgccttttcctaccacctctccccatttcccacgaccggtcggcacccgggagacgccgccgccgccgccgcccttggaggcctgaacgagcttccaccgtcgccacacatgcggcaagtttttcaaggtttcaatctccgctctcctccctgttaccctgcgcagatctgtcgtctactttttttttccggactgcgcaaatcgttaggaattaggatttctattgtgcgagatagatgttcttcgtcgtggagacctccagtcctccacacttgttgaagctgcgttgttgttgttgtgatgtgagctaggtaggcaggagatcgagggaatgacagtgccaccgtgttccactgtttctcgaggcatgaaattagaacggaactccccatggtaatgcaatcccttgcatagatcgacacgatggcctgtaataaattccatacatttgttaccagatcgtccaatcggagatgatggtttggaataatatgctgctctgttattctcccatgttattcatggcttgaggggcatatatcatgatggatattacgggccttgtggacctcttcgcagcgcagcatcttgttcgtatgagttttgactctttgagtcctacactagtaactcataccacagggttgctatttacatcaatcgtgtttcctttgtgttaggtgatctagtgtttttctccacattttccacagattgctgctattgtgcttgggtacaatgatatcaagaaaatgtgacctagactttttctgtgaataggtaaggataatatgaattgatgtagtaagacactata

SEQ ID NO: 9662 - DNA, 2770 bp, Oryza sativa
ttatgtagttcatggtttaagtgattgcctcgtcataactactaatgatgacatcgttgctatctactctttctacagctctagtccaagcacaactgtatatgcttgtgattgtagcaaagaaactctggagaaggcaaatgagattgtttgcagcacaaaaggagttgaagtcaaggataggttccatccttttttactggatgcttcgaaggaaacttttccagattggttgttctgcaaatcctgtcgaagtccatgtgcgaaggatgttgaccttttactagtttaattaattgttttgaaattttcttttacccgaattatctactccaataatgtttgattcgatggtaccttttcctttcaggctcaagtaattgtaatatgatagaagaataccctgcctttctcagagacaatccatgttgtgttgatggtgtggattttatcactatggttggtagcactatctttaccctattttttgtcaaagcacttccattagcattataatgttgccatgctgtgagttctgaatgtatattgtaaaagtcaaaccccctatttatgctcttgtttacatcaagtttgtatgtacgcttttcagatattcacattatcagccataccttttgacaatatgctagctacactagagcgttgtgtatctgttctaaaaccaggtggccttgttttgtttagggactacggtaatgccctggccatactattgtattatatatcattgatcaataatcttgctgacatctctttattgtattaggactctatgacatgacaatgcttcggtttttacctcaccaaagagtgggattccgggaatacatgcgctcagatggcaccctttcatacttcttcacattagatacagtgagagaactctttcatgcctctggactactagaggtaactcggattgttttgacatgttctcagttttctagttactttccacctttctttgcccctgcatgtgcccctcatggtagcattcaatattttatgaattaaagatgtatgccttagtcgattgtttcgttccttgttagaacttctgtgcagatcataataaatgcatcagaattgctcttatcactattaaaattactttgtaccaaaccaatgtatcataatttctgtttcgctccaaaataatccagctatatatgattaaaatcatgagatatatttcaggcttctgtatatttgagtcatctgaaatttttacatttttgtccttttcgaaaacttattttataaatggacccctggaaaaacttattccgggagtggtcttttttggtgcaccagagtgttggcgccgtactccaacatagcggcgctagccaccctggcaccgtgaccgtgccaccttggcacaagggcaagcgttgaaggggtgacgtggcaaatgggggcgccagccactttggcgccgcccctcataccatggcgccagtcaccctggcgcacccctcctagggggccaagctctaaccttctgacttaggcgggaggtggcgccacacaccccaagcacagcgccaggttggctggcgccggccccccacccacccccgaggacttctgcctcggccgaattgctggcgctgcccctcgaagcatggcaccagcgtgcttggcgctgctcccccaacccgtagatcttctgccttgggcgggtggatggcgccgcccctatagacgacacaagggtgactagcgccgaccaccaccccccgaggccttctgcctcgaacgattagctggcgccgccccctaacacggcgccagggtggctggcgcccgacctcttcctccctgccaacttcaaatttcatttggacagtttgcaaacaatgcaaatatcgacaccaaatcacagtaaacatacatatcacaaaacaggttacacagcaaatattgacaccaaatcacatatcacatagtccacaagataactagattgacgaaaaagtccacaagtccacaactccatcacatattccacacatcaaacaatactacaaatccatcacgtacttcatacaaccaacaagtccaaaagtccgtgaaacaagttaacatatgacacatagatcaacttcatagaaatcactttttccgttggcgccgaatagcttgtgagcccggagtgtatctacatttgaaaaaccaatgtttaaaacatttaaaaaacaaagtgagggaaatcaaataacacttgagaatggtaagctcattttacctctttttcgctggccgagtggatcacaagttgtattgggtgggctgtgatgcatgaggtgcatcggagactgcgacatgcctatctcctcggcgtctggtgcgatgtagccctcatcctcctcctcctcctcctcctcgtcgtcgccgctaggtggagcctgtgccttcccctttccccttccctgtggaatgcgtgacgacgacgaaccaccaacttgttcacgctcttctatcctgatggagtgtcgagcagtacttggacacacggattgaggtagtggtggtggtactctccgcggttggtacacgtcgtccaatccaaccgacctgtaacctaatcttgcagcaagtttgcggcacctttggcgaactttttgaattaaaaaaatagaagtttgttaggcataagtcaagtaatgcaaagtgttaaatcatttttacctctaagacattgggaagtgtgttctccgtatcttcaccaccccttggagatcag

SEQ ID NO: 9663 - DNA, 7080 bp, Oryza sativa
ctctcctctccttcccttgctctaaccacttcattagcaaactttaaatgttttcttctaaattatttatttttcaattaaacccttctattatttgcaatttcatctttataacaatatattggtcgacgggttatatctgactatgatatttgagggacgtaggatatggctcataccaacatatgcatgagtatggaataaaaacatgggagacatgagttttatactggttcaggctctcgtaaagggtattggacctctccaatttatatgtattgagctagggtatatcacaaaagaagaggaagcaggctagctaatctagcctaccaaactaatctcgatgagcaagacaactggtaatactcggtggctagcagaaaaggcttcctcctagtgtgaactcgatgtggcctgatggaaagcttataattcgatacccctcctcggaggccctatatttataagaacatgacccgttgtgtaagtagaactcaggatcccaaataggatatgggcagataagaccttatcatccatatattggactacactgtccctcattaagtggatcagattccttcattgtccatatttttattcatacgtaggaacaccatatcgtataagaatagataaatacggtattcctggtgataataagtgcaagtatattaggtatgtcatatctacaacattgacaatatcacacaattatatcccgctgaaaatgatataaatatttcaaccgttataattcgttaaaattcaatgttccatgtaagagagtgtaatatttcaacataaatactaatatgtttcacacttaatgtttttgtagtgttcttttggatatttcaataactattttctatgttcttgtggttcctgtggatattttataatgtttcgacaagtacaattcgatgttttcatgtataatataaaatacttcaactagaaacataataattttttatccaaaatatatttatgtgagatcttactgtaaagacttatttacaataatagaacagtgtagttagatctcatatcagatagacaatatagtaaaaattagtttaaattttgcttaataaattattaagggaaagaagagagagaatggaagtggagacaagccgtgtgtgagaagtatgcatagcctgatgcacgcagaagtcatcatgcaaagagtggatagagaaagaacaagtgcagggagaggggtgggacaaatatttcgtgtttttattaggccaagtgtgtaggcgtctccgtgaattaatgagcgagatgattaattcgtgttgtgactagagtcatcaggccttcatgcccatatacatgcaatcatttagaatatattaaaagttatctaaataaaatttctatttgcaagacctttttgatatatttgaaaaagaattacaatattttagtcattactgaatatttttaaaatttgggtaaaattttgtaatagatactttttccaaaataaagtttcattttaaatttacaaaattcaattaattttctactaaaattttaaattttcaactcagttgttgaaactttcaactcaaaactcaaaatttgaaaaactctacccaatagttgattcttttcactccaaatataaaactttctaactcatattttaaaacttaactgatatttttaaaataactactatccgttgaggttggaaatggaatcggtattggtatagcgtcgaaaagtctgatgcgcagtcgaacacggtcacaacaagagggggcgaggtggaagaggagccgcactgctagtatgggcatgcataggtcaaggttcacaacagctgctgagctggaacagaacggaggggggtgcaccactttgccgaatatatgggcacattaatctaacatatagtgttttttttcatacatagaggggataataatgctctaactaatggtattttttttctgtagcaccacattgctctaactaatagtattcttgtacaacttttaacataaaaaattgaaatgtgataagcaagaaaaattcttaccaaaaataaagggtagaaggaagcctcgaaggaaaacaccatgaagagaaatttagccagtgcaggttgcaaaagtcctgaagccaggggcgaagccaagataaatgatcgctagggtcattactaaccgggtctatgttttcaaccagaacggattgaaaacaacgcaatttcgatgttccaacttgggacaaaagtagattttgagtgaaatttggaatagtttttcaagaattcaaatttgaaattgtaaaattaaaccaaattaataaaaaaatatcaaattttggtaaaaaaaaaagccatattgctatatttggaatctaattttaaatcgaattggtgaaccctgatacaatctgggtgtgttcagacctagctacgggatctgaacccttccctcccagcacgcaaaatagagcgaggttaccacatgattaattaagcattattagcttataaaaaacttgaaagataatagattaatatggtttttaaaacaattttctatagaaattattttgctagggaatttgaaaagttacgagccgctggccttatgcatggtctcaaatctcaaaaactcaaagtatatgcatattcggctgacatataaccataaatgctaggtaattttctatttgctgctgctagtattgtttctagttgtcaattggaatttaacacaacaatcaacaattaatgtcaccggggtctaatatttgttttcaccggggtcatagctggtaaaataaagaggatatgagaggttaaaataaaatcatcggggtctactgaccctggtaattgactgtacctttgcccctgcctgaagcagatgccttcgtttataatcttacaccagttatttaataacccaaatttagatgttcaatagttcaaaccctaacctataatatggataaaacgaaaaagcactatcagtattcagtaatcacaataccttttgatttttgagatttatttggaacaaaaagtaaattagattagaagaagagtagaaagtcgatacctttcctgaaaacttttgggcttttggagataacactagaggatgtcatgacgagttgagattagagaacacgatgatggagatgtgtatagcttgagatgtgtctaaccacgagatagcaattgatttccactactcggcgtcgacggcgatggccgatcagggctgctgatgtcgaatcgacaagcatggggtcggcgacaggaaacgattgaggagagcgattcaagtggtatagaaggaagaaaaggagaaaaaaaaaagagaaaggtgaatgggcgggcggtgcggggcggcgcgacaaagtcgcggggggatcgaggcgtcgctgccctctctggacgaccacaagatttggtgcttgcgagcccatgcaccagtgccttttgcttatgggaaaaaagtgcacttagactcctttaattgttcaccgaatctaattcgttacccttaactgtaaaaccgggtagaatgactccccgaattattaaaaccagtgcaatttgactcctccagtggttttggagagcggttttgcttacgtggcgctaatgtggcagtgctaacccggttttcattacacgtggcgcttatatagcatttagaattaaaaaaatatatgtggggcccatccgccattcaaacgcaaaatatatcatgggacccaccgacatatggaccacgtgtcatccttttttccttcccttcttcctcctccctctctctctctcccttctctctcttctctctcccccttttctcttccccctttcgaagcatcggtggcggccgcagccgggggctggagtggcgacggcagggtgcgggcgagggctggaacggcgacggcctcgccaccgcttgccccgtctccaagcagtcccgccgccactccccctctaggcccggccggtgctcggatccagcgcgaacccggatgttggaagcaagcagtaattatgcatgtgctacttaattgaatgtggaaatgtagatgaaatcgattttttttgactgaaatgaaatcgattgtgaaaatggatgaagaagcacacaaacctgtgagctgcagctgctgacgcagcgggcaatccgggagcagacagggacgacgagcttgtcgaagtggtgctggtcgaggatctcgacgatctcctcgagctcgtcggtaagcagcacctccttctggcagttggtcgccggccagtggcggaggaagatgtcccggacgacggatgctgccgtagtaggagagctggcggtggcatgtgtgcacccaccgcgtccggtgtagcggcagcagcacgcgcgccatgaacgcccggtgctcctccttgagcggcacgacgaagccattgatgatgctgccgcagatctcaagcagctcgccgacgccgcagtggcgctcgggctccgccggggacgtgccgtagacgaaccggagcagcgcgacggccatggtgcgctgcctaaacgcgcgctcgacggtgagcttggagtagagctggtggtagacggtcttgaggcggtcgcgctcgcgcgggtcctcggaggcgaagagcgccacgaggccggcgaggaagctccggtcgacgtggttacggagcgtcctggcgtccgcggcggcgaccgcggcggtgagcacgtcgtagacgaggtggaggtgcggccaccactggtggagaaaccctttgtagtcccggttcctaacccccctttagtcccggttttcaaaccgggagtgccaatccgggactaaagatcgctatctttagtcccgggtgaaataaccgggagtaaagatcgatctttagtcccggttggtaatcgttctttagtcccggttggtatcaccacccgggactaaagatcgagctgtcctttttttttttgcatgcccctgttgctgcatggtttatatatatatatatatatatatatatatatatatatatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatatgtacacatgcatatagaaacatatatagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttactttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactctttttttccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagagtcgatgaacccagtatcgaaaaccctccgccgtcgggccctttgaatctccattctacaacgataaaagggagtatattattttctatggtctactaatatacagggacctaattaattaaaggagacgtatagtaagaaatctaactgaacgatatacttacaaaatccagcaactcataatagagtcgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgacttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactaggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgcccgaaga

SEQ ID NO: 9664 - DNA, 639 bp, Oryza sativa
ggcatggagatgataaatcaagtgccacactagctctacaaatagaagcaaatgtacttgactcttgtctagaacaatctcaaccactacaatggatgaacactaagctcaaaggtgtgtgagagaggtgcaaggggtgtatgcaattgaattgggtgccaagagagcccccttgctgctggaaggggagtatttatactcccaccaaccaaaactagccgttgggggcgaaatcccccagctctgtgctctgccggtctgaccggaggtatgtggccggtcagaccgtgctactctgcaacggctagaaaactagccgttgtaaccctgtcagagggccccatcggcctggccggtcagaccgacgttgagtggccggtcagaccgccatcagctcggtctgaccgaatacggctccgtcggctctgtattgaccaccccgagcagcaccatcccagcctctagagggccggtctgaccgccgtttcgtggccgatcagaccggccagggcacgccggtcagaccaccactatgtggccggtctgactgcccctggtcatgccgaacccagtgaaaacaaaaaagattgtgtgtgtgagatgaaatatgagcacaagtctaaatgcataatgacctaa

SEQ ID NO: 9665 - DNA, 588 bp, Oryza sativa
accaattccgtagtcaataattacataccaagtctaattacaaataaagtaatattatattaaaactcaaataatattacatgctaagactaaaatagtaatgtaatgctaaagtgtctcgtgcgtatatgctaagtctaattaagactacaatagtcaattcctaggagtcgcaccaattacgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaaatccttctagggctagctcttccactcaggcttgacggacgaatccgacaacacgtcttttctgcaagataaaaaaaatgtattaggataaatgcgaagtaacatatatatatatatatatatatatacatatatatacatgtatatacatatatatacatgtatatatatatatacatgtatatatatatatatatatatatatattgcatttcacgttaacg

SEQ ID NO: 9666 - DNA, 648 bp, Oryza sativa
tgtgatgcttgtatgtaaggtatattggcttggcgtgtttgtacttgagggatttgaatatgtgggatttgcatttgtggtacgttggtttgggtttgggggatttggttttgaggaaaatgggtctggttgtaaaactgtggttgtatgagttgttgggtttgaatggaagataggttttgagtagtttgcaagggttgagtggattgtggaatttgggtggaaagtttgttttgaacagattgtgggatctgagtgggaagttgattttgaaccggattgtgggatctgagtaggaagttggttttgaccggattgtgggatctgagtgggaagttggttttgaacggattgtgggatctgagtgggaagttggttttgaacggattgtaagctttgagtgggaagttggttctgaggaacttcttgcgttggcttatcaaccggagcattccctacttggggattctctttttcctcatttccaacatttctttgggtctctttcccgacttgattcggttgacctttaccagtgtttagtgtctcttcctctctaccagatcctcctgctcccatggtttgatcatgcaaaacctttgcaattctctttgcagttcttcatattgttctttgttcaccataaca

SEQ ID NO: 9667 - DNA, 1898 bp, Oryza sativa
ctgctctttgccgttgcagcagagggggcggcaacggtgggctcgcggcactgctgctcctactcctcactgttgcgtaagagaggaggaggcgacgaggggagtatttggccagctattggcaagtggctgtggctaaccaaatttagccagccgggaggaatatttgtgttggcaacttttttgacaagtcgacaagcacgatcgcaacacctaaacgccttgcggtgatatggagtcgccaaccacctcgatctagccaaagggccaaatcaagatgggttttgcaaaaagaaaagctaaaccagctagcggagccgatttagagatcaaaatcagcctctaggccgatttagattgatatgaggataactacccgtctcgtgggcacaacggaaggttttcaggacaaacctacaaagaggtaccgcactctcgtagcggcggcagacggtttacggcgcaaaccgacaaagatggactaaaactaaggtaaaatagaaaacatagtaaaagaacgattcaaatagattgtattcgggggttttacaatggaccggccttgtcccttaaataggggttggtcttgctctctacaggcccttctctacatccaactcgggatagaaaccaaagaaaacacaaaacctgccttcccgagtaaggaaacccgtcactttccaaactttaacaattttcccctatttcgtccataggtgccaaatttaggtgtaaacaatttggtcagccatatagtctagctagctggatggagatgttgttgaaggctaattttttccttcgctagataaaatttggcttggagagccccttaggaaatgctcttataaatattatgcacgtgctaactaacttaggcgtcaacgtcaacgtgcacgttgattttctagtatatagtctggttgaaaactgagttggtatagctagagataaaaatgcaaatgagtatgacaattttcaatcgaagttgcgtgtcaattatttatttttgggtcggacgttcccgggacaaaggaagagtcaaactgcaaattaagctggaatttacaaagacacgatggtacatttattgaatcacacaatggcgggcgtacgacgacgaccgattcatgttgaccgaccctgccggtcgtgaggtgaccaaattaagaaccgatggattatccggtcccacgaaacagtgacttgagcttcctgatctccaggtcgtccagcacggtgaccttgctcaggacatcggttgggaggttgttggcgaagagcgcgaagtccatgatctgcaggccggggttggagctgctgtagaaggagaccgccatggccgccgtcgcgttgttgccgtcgccgccgccaccgttgtcgttgatctggaagtgcaggaggccctgcgggaacaccatgaggtcgcccttgcggagcgtgctggtgtacaccttgttggatgtagagctgatgaatccggcggacagggtcccctcaacgacgtagatgagctcggtgccgctcgggtgggagtgcagcggcacgatgccgccgggggagaagtcgacacgtgcggcggagatgtcgagcccgttcacgccgggaaacctggtttgcactttcgatttcggtcaaaaatttcggtaacattttgaattttacaaaattttagtacttttaactaaatcttaacaaattttgatcaatttaaaaaaactaaaaaattccgatgagataatcattaggatagggggaggagccaggtgtcctaatttacgataatttcgagccgaaattgtaatcatttacctagtggagaaggccgaggacagggcgatgttgaaggggttgacggtcgggccggtggtgactaggccgcggtagcagaagtcttc

SEQ ID NO: 9668 - DNA, 8455 bp, Oryza sativa
gattcattcggaaagtttccccctaacttcgccggcgcatcaatggcggccggatcttccgcgggcgattccccctcatccggccgttctctccccctcccaacactatataaacactccccgtgcctccctccaccgtttccgccactcgccgctctctctccccgtcggaatcgagctcgcgccgtcgttctctctctccgccgtcgccgccgagctccggtccccgccgtcgtcgccccggaccctctcccgtttcggcgtcgccttcttcgggttcgccgcaacctcgccgacctcgtccacccctctgtttcgcccgccgaccgccggaacgccgccgtcctcgtcgacccgagccgcgccgccgccttcctccgctccggtcgccgtcccgtcgtcgccgtcgacccggggtgagccgcggaccgccgttccacttcccccttccctcccctctctcgggcgctgctccgccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccagtccaccgtggaccgtgaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatagagtttagtagagtaaaagccgtttcttttccgttggtcgtgtagacgctgcagcttcggaagatccgctcttcgtggaggttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattattgttattgttattattaccttgttcaccctagaataaacaaaaccccaactagtggaccctctactcatggtacccctagtataattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgtccaagccgagcaatgtacccaagttagtgttttaattcttaaaatctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgcatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaatagattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagcctttgcagtattttcgaaataaaaatcctctgttatttgtgaaaaccctctagtctttctctgtcttgctgcttcatttatcgccaaaatctgatttttttttaaatgttgcttttctttttgtttttgtttgtagatggccggtagcgtcacccgtcgtggtttggacatgactggtttcgtcttggagctgcggggcatgtgcgttgtcctggggtatccacatggagtggactaccagggcaggccgcttccggagcaggagggtgacgaagcagagccccacgctgcttgggaggtcactgcagtgatcctcgccggctctcccgagcggacttcgctggcagtcaccgcgggtggagattctttccccgccgcttgctagagcgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctagcgcgcatggtggaggcgtacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacctgcttcgtcgagacccctcgtgccgagtccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgccagctctctctatttgctggttctgtgtggggttttcagatggtgacgaccaggagaagtgctaataccggtgatggcaaccaacctgaaggcagcaaccatcaccaccagggcagcccacctccacctcctcctccgcctccaccaccaccaccagacaccaacgccattctcacccaaatcctcgcccagcaggccaacatgatgactgctttcctccaccacctccaaaattcgccacaacataatactccaccaccacccccacaacactctaaactcgccgagttcctacgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcaacctattacttgggcccgtttcaccgccgctttccggagaacccatgtgcccgccggagtcgtggcccttaagaaaagggaattccgagagttaaagcaaggcaaccgctccgtgatggagtatttgcatgagttcaacaacctggcccgttatgccccggaggatgtgcgggaagatgaggagaagcaagagaagttcttggcaggaatggaccctgagctgtccgtccgtctagtctccggggactatccggatttccaacgtctggtggacaaaagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcatggtgcgcgtcccacagccgcagcagtagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataagtgcccaaagccgaggcgtcagcaaggccaagcgcctccccgctccaacaacggtggtaaggatgtcattcggggtcgtgtgaaccatgtgacggccgaggacgtgctgacaactccagacgtcatcattggtatgttcctcattcattccatccctgctaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtggtggattgtgcgagacgcactgtcactctgtaccgagagccggaacaaccggttgttttctttgcacccccaacctctgtcagtagttcagaactccatcagataggactgtcagaaatccccatcgtcagagagttcggagacgtgtttccggaagaactacccggtatgccgcccaagcgagagattgagttccggatagatcttgctccaggaaccactcctctgtacaagcgaccctaccgtatggcagcaaatgaattggccgaagtcaagaaatagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaagaacaagtaccctcttccccggatcgatgatctgttcgatcagcttaaaggtgccactgtattctccaagattgatcttcgttccggatatcaccagttgcgcattagggaagaagatattccgaagaccgcattcaccacgcgatacggactgtatgaattcacggtgatgtcattcggtttaaccaatgcacctgcctttttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgttaccgattggaagcaacccaagagagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaaaagctggtttcctcgctagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccccacccatgatttggagttagctgcggtggttcatgctctaaaaatctggcggcactatctcattgggaatcgctgtgaaatatataccgatcataagagtttgaaatacatcttcactcagtcggacctgaatcttcggcaaaggagatggttagaactcatcaaggattatgatgtgggaatttactatcatcctggtaaggccaacgtggttgccgacgctctaagtcgaaaaagccattgcaacactcttaatgtccgtggcattccactcgaacttagtcaacagatggaagccctgaacctaagcatagttggtcgcggattcttggctgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttaatccatccaccctggcagtacgaagatgtacttagacttgaaggagaaatactggtgggttagtatgaagcgggaaattgcagagttcgtggccctttgtgatgtgtgccagcgtgtcaagtcagagcaccaacgaccggccggactcctccaatctctccaagtacctgaatggaaatgggatgaaattgggatggatttcatcaccggacttccaaagacccaaggtggatatgattccatatgggtagtggtggatcgattaaccaaggtagctcgatttattcctatgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagacagatgggtagaccgagcatctaaatcagatcctagaagatatgcttcgcgcatgtgtcctggatttcgggaagacctgggataagagtctcccctatgccgagttctcctacaataacagataccaagctagcatacaaatggcaccctatgaagcgttgtatggacgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtataccttcgggtcacgccattgcggggtgtacacaggtttcggacaaaagggaagctcgcacctcggtatgtgggtccttttcgtatcgttgcccgacgcggagaagtcgcttaccagttggagctgcccgcctccttgggcaacgtgcatgatgtgttccatgtgtcgcaactcaagaaatgccttcgagtgccatccgagcaggccgacttagagcaaattgaagttcgcgaagacttgacctacgtggagaggccagtgaaaatcctggacaccatggagggcaggaccaggaaccgggtaatccgtttttgcaaggtccagtggagcaaccacgccgaagaggaagctacctgggagcgtgaagacgagctgaaggcagcccatcctgatctcttcgccagttcttccgaatctcggggtcgagattccgtttaaggggggtaggtttgtcgcgtccaaaaacgactctaaaatacatcctcaaaattgtgcatagaataagtaaaatccatgtgaaagcctccaacaattaaaatgtgcaaagttaaa

SEQ ID NO: 9669 - DNA, 1433 bp, Oryza sativa
gcccgccaccctcgctgacggggggggcccaccggtcatccccttcctccagctgctcccgccgcctcgcccgtgccctagcgccgccgccgccgcgaatcccgccgcctcccgcagtccccgcgcgcaataaagagagggaaatcactccccgtgattccctccctctttccccccacttttccctctctctctccctcggattcgttcggaaagtttccccctaacttcgccggcgcatcaatggcggccggaccttccgtggccgattccccctcatccggccgttctctccccctcccaacactatataaacactccccgtgcctccctccaccgtttccgccactcgccgctctctgtccccttcggaatcgagctcgcgccgtcgttctctctctctgccgtcgccgccgagctccggtccgccgccgtcgttgccccggaccctctcccgtttcggcgtcgccttcttcgggttcaccgcaacctcgccgacctcgtccacccctccgtttcgcccgccgaccgccggaactccgccgtcctcgtcgacccgagccgcgccgccgccttcctccgctccggtcgccgttcccgtcgtcgccgtcgacccggggtgagccgtggaccgccgtttcacttcccccttccctcccctctctcgggcgctgctccgccgctccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcataaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccatttcttttccgttggtcgtgtagacgctgcagcttcggaagatccgctcttcgtggaggttgaagccggcgtttgggaaagcgagcaaggcaagtcacatcattaaaagcctaaaatgcgtaaataaattttagtggaattttcagagcacaaataataattaagaagaaataaacaaagttaaaaaggttttataaaaagaaaaaacctaaaaagtctttttccccctcctccccctcttgggccggctcggcccatctctctccctctctctcctc

SEQ ID NO: 9670 - DNA, 8164 bp, Oryza sativa
  unsure (1)..(8164): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgctccggattttcactatgtgtgtcactgaagccacaatgtgggctgagcgactaaagtttgatgatcgtcatgtagtctcggcttggaaatctcttttttcttcttctattcgctctcttgatgtataactgaacttcctgttcctattgcgtcctaatgatcaatgaattcaagtggggaatctccccccccccccccggtgaattttctaaaaaaaaaagataaggaaaaaaaaaccattcttcaagatcaggcaagaaactagtaccatatgtaactctactaatacatatactactactttaacatgttaatttaataccactaaactcttatcatattaagcatattatgtagtagaaaagtcatatttttcatgattaaatctcttgctacatcaccatcaatcttaattgttagctcaactttagttctatgaaaccatccaaggtggagcattgagaatgcccttacctatgcttggacatctgcagtttgtgaaggttctttgaattgtttttgggtacttttcattgttttctgaattttacatgttccaaaatgactttaatttgattttaaaattttacttgtgttgttccaaattctctgagcatggtagtttttttttaatttttttaattattttaacagtatttttaatgcaatatatacgtttttattaatttggtggtttcgacctaatatttgtttcaatccaagcccatcgccgtggcactgctttctttgaaaagcacgtctcattcaaaatcgcagaattaatttcaatctattttttccctcgacgcatttattatccagccttatttttatgtttgctaataagaaatcctagcttaaattattattgaaaataacatttcaaaatcttatctttttagggaaaaaaaagctaaagtggggctaatatgatgaaaaattggataatgtgccattgtcaaaactgggtttcgccgaaatgctaccccgcaaaagagattcgttaaaatgccatttttcaccccgtggctacaagctataatgctatccgagaccaaattgcccttgccttcctctatcccccatcttctcttccaactccggctatccctgttttcctcatcctctggcgcggcggtgcagatggggaaaaggcagcaccgagcacgtgcgttggctggcggcggtggtgcaaatgggggaaagaatgctgcgacgcagatagggggagaaggcagcgacgtgcgtgtgcttcaggcggcggcggcgcagatggggaagaagggagcggcgcacgtgtgcatcactggtggcagtagcacagatgtgaagaagacggtggcggcgcagatggggaagaaggaagcaactacacatgcctaggtaagaagaaggagaacgagggtaatttggtcccgtatagcattgtagcttgtagtcatgagttgatattggcattttaacaaatcccttttgcggagtggcatttcggtgaaacctagttttggcaatggcagaatgtccaatttctataatatgacatgctgagatagctaaaacgcatgtcattgaggccttatcttttcgctcatgcttatcagcggaaactaaaatttgattgattttaggtttttttatcatcgtttattttcccgtttttttgcttttaaatcattaagaatacgtatataaaagttttattttaaattattttttatttataaatatgtcgcttgacttagttcctgaaataagacaaacgatcgggctgtgaagttgtatgtaatgaaagcaaatcaagtagggctatcactacagtagtaccaaaagtaaaggagaaaccgtacataatttgaaagaaagagaaagtcagaaaaccacataattatgcatggctctcgctgcaacttggtccgtgacccacacgagtcctattaaaaaaaaatcaaaacagcagtagttgagcttatttaaaaggggagattttcttttccttttcatttcgagtccacatacgtttggaggcacagaaaaaggaaaaaaaagaaaagaaaaacaaaaagtcagaacatctgcacttgatttcttattcacgcaactccattaaagtctaaccattgacttttttcccctgcccgctcttacacggcacgtctcattcaaatatgaactctcgcacagtgaggaatcccaaattgagaaggaaaaaaaatgaaaacaaatttctttttcctctgacttgtagctctacaactacgcgtcgttttctttattatttattcgtgtataaaaacttttcctttcttaattcttgccaaaaaaaaaaaactggtcacgaataatcgtctcctaaaaaaaaaaagtctctagtctcagcgcgataattctcccgcgaactgcgcactgaccccgcgtgaccaattgacatgtcggccacccaacaagtgggcccacctgtcagtgactgtgggatcagggagcgtctggttcgctcggtacgcgtagcgcgatgcggtcgcttgtctcgtagttggaaccaactagcccccgtgaccccacaacgcgtcggattctgattgggcgagacccacctcgtggccactgttgcatggtcaactttcccacccatccgagccgtccatcccatccaacggcgcgtacggatccaccgcctgacgccggtggcgccggtcgacgatccatcccgaccgtccgatcgggctcgcgcgttgactataaccggtccacgccgtgaccgccaccggctgctcccggtgaccgcgtcgcgtcgttttataaccccgactacgttagcctcctcccacttcttcttcttcttcttccccccatttctcacttactccggcgatcaccgtggttgagcgtcggcggcggaggaggaggcgatgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggtaaaaatcttcacgactccctccatttcccccacctcgaattgaactcatcggaattaattttccaggaagcatcgggtgaagaggacgatccgcgtgccggcgataagctcgaaggtggcggacatccccgccgacgacttctcgtggcggaagtacgggcagaagcccatcaagggctcccccttcccacggtgagcaccgcactgccccgccgtctctcctcactccgtcgacattaacactcaaaactaatcgtaatcccctcatttttgcagaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcctgagatacccccggtgaagaagagtgagaattagcttgtcggtcatcataattaccgttagaaattatttttttcgtttttctctctttttttttcttttttttactgcatcattgtagaactagcgtgtaaaacaattttaggagactttgagactgagcttttactgaagaaaaaataaagcagaacaaaaaaaaaagagaagaaggcgatcgagactatcagtagagtagagagtagaaaaaggcgtgccggaattgaagattttgaccgcgcatgcgaatttgtttatcaactcgggttcaatcccgcggattggggtccggtggaggtcaaaaggaggtggggcccggggtgttgaacgttgccccccgcccacggtcctcgtgcggggcccacgcgacagtgacggggagggtccctcgtgtgtgtaagtgtggacgacgcggtcaaagaacgcggcgtggggtggggcccaccacggccttggcctccggcgtccgcctcgcccgcgctgccaacgttgactcgtgtcagccaggctggaatcggattcgctacgcctctctgtctcactctctctctctgtgtttcgtatcatttcgaatgggacattcgagttcgatatcttgatgcgctgtttggagaaagttttataatagaggaaattatcaactttaattaagtatgataatacaaactgatattataatatggagtataaacgcatacgttcacaatgtctcacatctatgattactcacgcacaccctacccttacatatccagaagactttggtgatatattttatattgatgaaatcatcgtagacgtctgatcgtcaaccggtgcattgctaacataaaaactaattaccataaatatgaatacctataataagtgtagaaattgaaattaggtggactggttccatcacaagaaaatctaaccagttgacccatgctataagaaaatatgtatataaagttcttttaaaaaatacatttggatggtttaggaagtgttctcaccataaacaaccgagttaggaagatttaaacgtaattacactacaattattttatatttatatttgataaattttatgaagaaaaattgtcatcaaatgtattgaaaatttgatggggattatgtattggggtgttgctgtttgtttatacctgtaggaccatgatgtgttacatgaaggattgtcaatatcccgatcctgactatcttggttacatccctactacgtttaatgaatggagtagatcggatcggaaaaaaaaacctcaatcattgtctagggaagtagggattatattattagtatactactcccttcattccaaattgatctatatatagtttttttaaggttatttttaaatgatctacgacatatttatgttcatttattaagtctattcgttatttgtgcattggagtaaatggacattaatgcatgcatccatgcatataagtatttataacccacatgcaatatcttgatttgctattggttaggaaatagtatggatggtgtatgcattgagtttgttgctaaagtaaatatagtataagggcacctacaatggttatctatagactctctacaagagatccatgtcagcatattttcctactggaaagagattaaatgaagagagagagcaaaactatctactaatctggaaatagtctatagagaaaaacgaggcaatggattagagcaagttcaatagtatagccaactaccagctccaattcatctatagccaatctaatagctcattcatacaatagttacatgctacactattaatatctggtcccacctgtcatgcacacactgtgtcttggagtccgtgatacagctggctacaaatctgtagcccgctgcccttctctctcttcatttatcttcttaaaatatgtttgcagctggcttatagcctgctattgtacctgctcttagagagctatagatacccatgtagacatgtcattgaagtggtttactattaatctagtctattgctgagatgtacatgttttatagatagcaccttactttaccattgcaggtgttctaagagagttattagctcttttttttatcttggtgtacctatgaaatatgtagatcaatttgaaatgggggagtattatcatggtgattttgctagatcttgacagagattttattgattagtggagatgttgctaagccatgagattatacgtggtgtttactcatcaacctcgttcctaattcccgcattacgcgtgagatctcctccggatggagactgtcaccggcttcgagctataatgacgtgatctctccgtttcatattataaaccgtttgatatttttctagttaattttttttaatttgatgaagtttatagaaaacatagtagtaacataaaacaaatatattataaaaatatatttaatgaagctaatttgatattttatatattactaaattttttctataaacatgatcaaacttaacatattagaaaaaatgttaaatggcttatatataagatggagggagtagtatgaatgaggagtggacaagtgaatgataggagagagatccaacagtgttgagaacggctgtttgacttggctgggaggcagcctgcatgggtacgtgtccgtatgcccactttgatacatctccgttctaaagcacgtgacgctggtcccacctgtcagcgagcacctccccttttggtttggcaattctggtggggccggaggatgctagggagataggttgggtttggattgatttttgctttggaatttggtttgtggatggaagcggtggcaacgttggaaaggaaaggggatgaaaggaggagatattggtgttggtggtgggtttgagagagcaaaagtcaaaacggcatctttcatctttttgtgtccagaggggaggggggcaggtgggtttgtcccattgggtgtgaaactgtgaatgtgtgctcttgtgtccctaccaccactatgctttggaggctggatctgatgtggccttccgccttcgatgccgtctaacctaccactatgagcaagtttaatagtatagctaactactagctctaaattatttatagacaacttaatagttaattcatacaatagttatctataaatatatactacacaattaatatatagtcttatctgttatacacatattgcgtcttagaatctgtgttgcagctagctataaatctgtagcccgttgcgcatctctctcttctttaatcttctcgatatatgtttatagctagtttataatatgctattgtacatgttctaactgcttgttcgactagtcatttttgtggttgtacctgtggttagggtttactccctccgtaaaaaaaaagacaaaccctgggtttttgtgtccaacgttggaccgcccgtcttatttgaaaaattataaaaaatttaaaaagacaagtcacgcataaagtattaatcatgttttatcatctaacaacaatgaaaatactaattataaaaaaatttcatataagacggacaatcaaacgttggacacggaaacccatagtttatctttttttgacggagggagtatcttttaatataaaaataaaaaccgcttctcatggtttatcgaaaaccgataaaaaactgttaaatgtggatagaaatgattgaacgagagagattgagcgagagagagaattgaacacaagtagagcgaatcgatggatttctcattgatcaacagttcatttatacaatgtgaagcggtgtcaaccgcaagggacgcgatgtttgtcgagagggacgccaaagggagagagaggagcgatctcctcttctctgccagttagtttaggaaccgttgttcctactttcttgggtggatgagatcacccgtcgtttcttaa

SEQ ID NO: 9671 - DNA, 1605 bp, Oryza sativa
cttccatgaaatagcagttccaccctgtaaaaatacgaatcctgtttgtgatctggcgttgtggggatcagatagatagctagcatcagtatacccaattaaagtcgaatcctggttctttttaaagaaaagtccaagatctcttgtgccattaagatatcgaaagacattcttaactccagtccaatggtgtttggtaggagcagcgctatatcttgctaatagattaaccgagaaagcaatatctggccttgtactatttgcaaggtacataagtgcgccaatacactaagatatggaaaatcaggaccaagtacatcctctccatcttcctttggtctaaatggatctttctccacgtctagagatcgaaccaccatagggattttggaaggatatgacttgtccatattaaatttctccaaaattttctgggtatatgcactttggtgcacaaggattccagaaggtaaatgctcaagttgtagacctaagcaaaatttggtttgacccaaatccttcatttcaaattccgtctttaaatgatgacgtgcttcattaatatcttgtgtattgccaatgatgctgagatcatcgacatataccgaaataatacaaaatcctgtgggggactttttgataaagacgcacgggcaatcatcatttttagtgtatccctttagcgaaaggaattcacttaatcggttgtatcacatcctgcccgattgttttaagccataaagtgacttctgcaacttaacacaatacatgttacgatttaccttctgattcgggatgtcgattccaccaggaaccttcatgtaaatatcagaatcaagtgacccataaagatatgctgtcactacgtccatctactgtataaatagacgattttgtactgccaatgatattaaatatcggaaagttataccactcataactggagagtaagtttcattgaaatcaacgccaggtttttgcgtaaaaccttgtgctacaagccttgctttatatctcaccacctcgttgttttcgttccgtttccggacaaaaacccatttgtatcccatagggaagataccacgaggagtaggcattacagccgagaatacatctcttttgtaaagcgaggctaattctatgtcaattgcgtccttccatttgttccagtcaaagcgcttttggcactcttttatagacctaggttctggatcaacttggaggcattcagcaatttgttcagaaaaattagtgtcgacaattgtagctcttctatcaaaagattctctagtttcagagtaattgatggcaatttcatcaacccttatagactcattgtgatctcccgaaacaatgtgtctatggtcttccgaattcctagtctcagcattgtgcaccaccgagctaggttgcagactatcatgatctgcttgacatatagtatcaatttggtgtgtaccaactaaaggttggtttgcatttaccgtctttctttgcttattagcaattgtttctcgctgagtggccatacttcttctctctttttagtgagtggaagttgagtggttttatttggtacctccactctttctggcgcattctgag

SEQ ID NO: 9672 - DNA, 2891 bp, Oryza sativa
gccccgaaatcagaggatttgggaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttgtttcgttaagagaagaaattcttctcgattatccatatgagtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgctcccagcgatagtcaaaactttgccttctctctttttgagagtttgaaagtatttgatctccctaagtatagagtttgtggtaccactgtccacaagacataattcctctccaatcggagcgatatccttagacatctataatgaaagaagaattgcatgattaagaattctttatccaatatatatacatacatacaataattaaaacatcaaatacatagtatgacgtttacatatgttaatagtacatactctaatgactagcaagccatacaaccttacaatacaagggagttcgtacttatctacttattacaaccaatattatttggcaaacttataggatatcaatatactgtttcaatcacactgagataagggcagcttcatctccaagtgggacgcaccgagatcattgcaaatctccaagtgggtccgttgagcagtattcgatgaacatatcgtccatcgtagagagtggagcgacatcttctgggagaacattgaggttgctctctggttcagcaggagcctggtgagaacttgcaacctcagggtgctcttcatgtgtgagattgaagtgtgcttcaaatcttgggttctcagaagattttttgtccttgagggatttttggtacaagaggacaagatgtttcgggatgcggcagtctttagcgacatgagtgtcagatccacacctgttgcaatgcttgttggtattgctacgaggttgtggtgccttacccttcccttttcctttctttcgacccttgaatttgcgcctgttgttggtgcgtttgcgctttccagtcagattcttaggattattcgaagaatttcccttgaatcctttcttattctcagcattattctatacattgaagtgcacctcaggcagtggagcagagcccggtgggcgctgttgggcattctttaaagaaagctcagggtgcctttctgcctgagtcaatgtatgtataagcagagaatgtttctgaaaattgttagcgcgatactgttgagtcagtatcctgtcctccggaagtatagttgatagagttttctctatcttctctgcctccgttggctcttgttcgcaaaacttcaacctggaacaaatgttatgaacagcatgattgtattctgccacagtttgaaagtcctgtaggcataaatgaacccactcataattagccttaggccaaatgagttccttttgctgatcataacgctcttttagagctttccaaaggttgagagggctcgtctctaacatgtattcatgtttgagatccttgtgaatgtagagtctcaaaagaaaaagggctgtattgagcttcctgggctcaattgccggatccccatcattaggctcctcaattgtatttagaatctcccgagaggcaaaattgattttgatatcagaagcccagatgggatagttagtcccatcgagggcgagttcgtcgaactcttttgttgccatgtccctacaatcatggttaacattatcaatttacagaggtaaattaataaaaacatgatattaagggtgtaatctcaatgcgaaatgtaaaacttcatattctgtaatgtttcgaaagatgtaggttatggacctgacaattttgagttagaattcgaaattaggtggcacaatgtggataatctctaagtaattaaacagtggagtagatctcttaatagtgggcaagttatacttgctgcctaaaacacggtctccaggcaaatatattctggtgaatataccgcagccaatgtttaggactccactaccttgtgttcaaccaaatttcaaataatctcatttctcaaaacatattcttggaaaagaacacatgtgggtaataatcgtgagatgtagacctctgtgagatgggcgaggtgctcgccgcctaagttatgaccagtgcggccaatttctaggactccatcgggtaatcatctcaaaatgtagaccactttatgatgggcgagatactcgctgcctaagttatggtcgatatgaccaaagtataggactccatcgacatgtgattaatttctaagtcaaagtgtgaagtggaacatgcattaaatcctccattaattatgttggacataattaaaagaatttgctaaatcaaaatacaaaatttatagaattttgtaaattaataaagcgagaaagtagagcgtgtcttaaaataatatgcaaaagacatgttattaagacaacaataaatttagtgaaacagagtatttaaataaacacctatgttaataaacacataacatcagtggtctataggaccattacataattgtttgtacaactgatgaactgtttcgactaaattacataaaacatagggactaaagtgaaattgttgctgcaaataaaataaaaaaataaaaactaaatttaaggggtaaatgggtggcccccccccc

SEQ ID NO: 9673 - DNA, 1837 bp, Oryza sativa
gtattgggccggccaacaaggggcagcggggcgctagggcgcggcccattaggcccgacagcaaaaagggcacaggggggcgtcgggggggagttagggttagaacccttaactgccccctcgcgggatttctgccgccgccgccgccgccgtcgcctttccgttgccgatgccgccgtcggagccgctgtcgcctgtccaccgtgcccttcccctgccgtcgctgcgccgtccgtcgtcgccatttccctgtgcagcttcgacgcgggacgcgccgccgccgcatcaagatgcgtcgccgccgccgcctccatttccaccgccgccacacgccgccatctcctgcatccaccatctgccgcccatcgccatcgccatccaccatccaccgccgcctcggccgcccctccgtccgccggcggttggccggccggattaggccgacggctcccgatcctcatcggagtcggaaaccggccgagccccgacgccattccccggcaccccgttagggagtgtacggctaggagagccatggggaacggcgatgaaggtgtggcggaggccgggacggcgagcggcggcttcgctggcatgacgacgagacgaggacggattgaagaatggcggctcccccgtgcgcgcagccatggtaccggtccaaccggaccccggtggcgcgggagtgggggaacggcgtcggcgtcggcttggggtcggtagggctggtgaagcagcggttgatggtggcggcagcgactccatctccggggaaagatcgcatggctcgccgggcagagtcaccactgccgtccatccgtggtgggcgcagtactgcaccccttgcacacagatacggcgaggcactgcggctaccggagatggaggcggaggaggagcaaccggagtagcggccaccacgatgcgtcggcgagggtggtggcgtcggccaccagccctagcccgacgttcatggtgttggtggcggccgtggtggcggcggcgactcctctccgatcgatggagaagatggggaaggcgacgagcgcgctgattgcgagaaaggccgagaacggcatccataatccaatgaaaggtaggcatcgtaccttctcagttgattcttctgttcgcttttctgttagatcaaaagcgatgtttcttcctttcacttcgcgatctccttcgcgagagcgaaagtgctgataacatgttaaatgtggatagaaatgattgagcgagagagattgagcgagagagagaattgaacacaagtagagcgaatcgatggatttctcattgatcaacagttaatttatacaatgtgaagcggtgtcaaccgcaagggacgcggtgtttgggaacatcgcgtcggttgtcgagagggacgccaaagggagagagaggagcgatctcctcttctctgctagttagtttaggaaccgttgttcctatttccttgggtggatgagatcacccgtagtttcttaacaaaaaaaccgtaagttttggtcaacaccgtacaaaacccctaaaaaaccgtctaatactaatacggatcgattttgacaaaccgagatgtaacggtttcacgatgatgagttccgtgaaccctggccataaacctgtactcctatgttgcagccactgacacaagacaccacaacagctgcaaaagtcaacagttgaaaggcgtggtagactagtagtaggtggtgcagcatgacgggcggagaacctcaaaaaagttacactaacaaaagaaaataagaaacctcaaactttatttaagaatacaatatttcattagggaatctaaagtaatgaaagaaataac

SEQ ID NO: 9674 - DNA, 16759 bp, Oryza sativa
ggaagtcaaatttctgggtcacgttattacagctcaaggcgtggcagttgatccatcgaatgtggagtcagttaccaaatggaccccacctaagaccgtgtcacagattcagagttttcttggacttgcgggttattaccgccgattcattgaaaacttctccaggatcgcccgacccatcactcagttgctttagaaagatgagaagtttaaatggacagctgagtgtgacaagagttttgaggagctcaagaagaaattagtatccgccgtagttctgattctgcccgactagacaaaagacttccgagtctattgcaacgcatctcgccacgggcttggatgtgttctaatgcaagagggcagagtggtcgcttatgcctcgcggcagttgcgtccacatgaagggaattatccaactcatgacctggaattggcagcagtggtacatgctttgaagatctggaggcactatctgattggcaaccgctgtgaagtatatacggaccacaagagtctgaaatacatcttcacccaaccggatctaaatctccgacaacgaagatggctggaactaatcaaagattatgacatgagcattcactaccatccgggtaaagccaatgtggtggcagatgctttaagcaggaaaagctactgcaatgccctatgcaccgaggacatgtgtgaagaattgcagcaggagcttgaacgtctcaacgtgggaatcgttgaacacaggttcgtagccactctagaagcacggcctacgctcgtggatcaagtcagagcagctcaagtgacggatcttgagatagctgaactgaaaaagaatatgagggtcggaaaagcccgggacttccttgaggatgaacatggcacagtctggatgggagaaagattgcacatgcctgatgacaaagagctgaaggatctgatactcaccgaggctcatcagactcaatactccattcatccgggtagtaccaagatgtatcaagatctcaaataaaaattttggtgggccagcatgaggagggaaatagctgaattcgtcacgctctgcgatgtttgtcagcgagttaaaacagaacatcagaggcccgcaggactattacaacctcttcagatcccggaatggaaatgggaagaaattggaatggatttcataacaggtctgcccaggacatgatctggccacgattcgatataggtagttgtggatcggcttaccaaagtcgctcatttcatcccagtgcacactacttatacgggcaaaaggttggcagagctctacctcttgcgaatcatgtgtctacatggagtacccaaaaagatagtatctgatcgagggagccaattcacttcaaagttctggcagaaattgcaagaggaattgggaacccggttgaatttcagcacagcctaccatccgcagaccgatggtcagaccgagcgagtcaatcaaatattggaggacatgttaagggcttgtgcacttgattttggtggagcttgggacaaaagcttgccgtatgcggagttctcttacaacaacagctaccaggctagtcttcaaatggcaccgttcgaagcgttgtacggccggaagtgccgcacacctctcttctgatatcaaacaggcgaacgtcaactgttcggaacataagtgctaacggaagcggaagagaaagtcaggaccgtcagagagaggctaagaattgcccagtctcgacagaagagctacgcggacaaccgccgaagggagctcacttttgaagccggggattacgtgtaccttcgtgttactccgctccggggagtacaccgttttcaaaccaaaggcaagttggcaccacgcttcgtgggaccatacaaaatcttggaacgaagaggagaagttgcttatcagctagaacttccattcaatatgatcggtatccatgacgtgttccacgtgtcccaattaaagaagtgcttgagggtacccgaagaacaagccgattcagagcacatcgatatccaggaagatctgacctacgtggagaagccagttcgcatccttgagaccagcgaaaggaggactagaaacaaggtcaccaggttttgccgggtttagtggagccaccattcagaggaggaagcaacctgggaaagagaagatgagttgaaggccgcccatccgcacctcttcgccagctcctccgaatctcggggccgagattccgtttaagggggtaggtttgtcacaccctgaagttctcctcccaagcctaaattgaatttataaatggtcccaagaaaatatcggtgtaaaagcaagagtaaaccctaataaaccaaggcaaataataatcggaattggcatgtggaatttttctcgagttctacatgtcgaaatttgctaacaagatttttagtggaattttgagagccctagaaataattttaaccaattaaaattgagcacatgcaattttaaatcccaggataaatcctttagtccttttctttttcttttccctcctttttcctcttcttgggccgtcggcctagtccgcccgccgctgcgcgcgctcttttcctccttgtgggccggcccaagccgcccctctctctctccgggacgccgacaggtgggtcccacctgtcgaggtcgtccccttcctccggccgcccgccccaggtcggcaaccgccgccgaaaccgccgcacccacctcctccgctcctgccgcgcccacgccgcgccgtccccgcgtcctccccacgtcgccgccgtctcccccgcgtctcccggcccgcgcgcgcgctcgcaaggggcgggattcgcattttgaatccccccattatctctctctccaccccacgtcgcaggtcaaaaaggaggctttcccggccgtttccacccatcccgcacctataaatcgctgccccgagcctcctctttccctttccgctctcgccgctccctcccgtgcttcctaccgagctcgcgccgctcgccgccagcgccaccgcttgccaccgcactacggccacgtgctgcccccgctagagccgccgccgcgctaagccgccgtcaccactagcttcgccgccgcaagatctttcccagccgccgccttgcgttgccgaaatcccaccaagaccacatttccctcgcgtcgccggtgagtcccctctccctccgactccggccgacatggatggccaccgtggggttttttcctttgcgctaattcctgtcctcccctcccctaggtgtcgccgtcactcgtccgcacctcggcatcgccggacttcgccgcctccctcgttttctgccgccggtcgccgccgtcccctccggtgaggaatccctcccccttcctttccttccccttcccgcgtgcgccattgcttttggccgcgccgctgctccggctgtgcgccgccgccttcgcgccgtccgccgccgccggtcgccgccggtggtcatgcacgccgccgcctctagccatggccggccggccggctttgaagccgagccaagcccggcggctgctccctgcgccgtccgatcggcccgaggccgatccggaccgtcggtcccgtggaccggcggtggaccacccgcgtggccccagtccacggtggaccggccgctttgtgccgctgacccgtggggcccacgtgccggcgccccctccctctccccttgcgccgctgacatgcgggccccgcatgtcggcgccacccgctccctttgatgacgtcagccctgggcatttattgcgcaataattcaattaaggatttttctgtttatagtaaaaacacagtgaatcttctaaaattcataactaattcatccgagctccgtttaaacccattcaagtcttagtaaatcaagaaaaatatgtagaatccattaaaattggttttgttctctgtttcagtagtattatagcgtgtttgtattgtttgctatgtatgtcacttagattccggctcttccgacgctccggtgtacttcgagatagtcgtcgaggttcctccagcagtagagcaaggcaagtcatgccggtcacttgaacatgttgatcctatattgcaaatgttctaatgttttccttcaaatactgcattgttttacaataatactatgtgatgtttacctactgttacagccatgctattttggtaccatgctcctttgttagcttgggttataacatgactagatattggactagggattgcttagccatgctttgttcaactagcacacaaaggggaaaatcctattaatgtatagactgtaggttctaatggtaatgttggattagtgccaccgcttcggtgttggttaattaaaataaatcacatggtgggctgtgggtgcatgattttgttggtcgcgcccatggcagttaaggaccggttcacaggatgccctggaagaacttatcgtacttaccacaagctagtgtgggcaactgctgggcttgtagtgtagctttcctctagctgacgcatctaggcaagggtggccgtgatggagtttggatgggtcctgcgacggcctatgcggcttccggattcatctaggcacgagaggggactgcccgctgccttgcgaggagtgggggtgatacctgaggtgtggtgtgcttggttagagggggttatgcgaagggtcctgtcacggcctctttccggtatgtcgtggtggcatgccggcgcacgaaaacgtgtcgtggggctgtgtcttgtgggtacagttgtacacctctaatcagagtaaaactattcgaatagccgtgcccacggttatgggcggtcaaccagattcaccgtgattagtctcaccctagtttagtctgatgaaattggatagtataggtggatggttgggcctgttgcaacatggtatagcgttggacagtggatgattaatattgattaattgttacaactgctttactgctttcaacttctgtttataaatgctcgttttatgcaaatgaaccattatagctatcccttgataattccctgcatcatacccctattccggtatgacttgctgagtacagtgggtagtactcagtcttgctctattttccccaaaccccagagtttgagtatgcgtcagatggtggtttctccgaggagtaggcttcgtccgtgccatcgaggatgcctgtggagtggtgttcccgctgcagttcaagtcaaggcttagctccagttatcttttgtttttccgctgtatttatgtaagacttttataatgtttgtaagacgtggatctgtatgtcaactttgtcgtttgtgtaccccggccggtcctggacggggattttaatgcacattctgcttggaattctattcgggaatttctgggcgtgacaagttggtatcagagccgaccttgaccgtaggacaagccaaatggaaaacctaagagccctctgaatccttttcattgcatatgttctttgcaattggatttgttccgtgagaaattgggatctgttcttgtggttcaagggaaaaatcttggtcgctcgtttaagtgagatttgtcgaaacaagtaagtctagggttttagtaaaattatttgagatatattcgacagttagtcgggatttgatgggtggtatgcattaggtcctagctcaggaatatgggttgcaaggtgtttatgcttttattgttattattagtatgtacctaattttctcactattttatcgctatgtaagtctgtcttatttattcgctctcatgcaaatgatctatgcataaaattccgctcttattcgcttctcttatttgagtcctttactgctttatttaaaattggatttgagcatgcattgatcctacccctttgtcttctctagatggccgagcacccacccaaccaccgcggagaaggcatggatgattttgtggcagaattggctcgcatgacactggtggtgggctaccccaacgtgccagagtactcgactgttccaccgctcagtggcgagcttcctcaccgtgttcgcctggaggtccatggctatgtgggtacctgcctcgctaacattgtggttgaggcatccggaggcacagcagatcacgcctgtcaggaggcagcatatctgctgatggccaggcttcgtgatcagcacaactacatcttctgcaacacggtgtaccgcttccaccctcgtcgagcaagtggcgatgatatcagcaccttccgcccgatagctggtgagaacgacaccaccttcggccacatgtgcaccgtgatgaggggaatggacaggatgcactcggatctgcacaaggcgtctaaggccttgaatggtgggaagctcgtgaggatcatagctctgaaggatgagatagcacgcctgaagaaggagaatgctcagttgaagggtctccccgcgccaagaggagtcctgatccgcaccacgcccggcaagtcgacgacggcacccgtgtgcattcaacttgcgcccaggaacccacctccgcctgcagctcccgcagctcctccagttctgccccacagttgccgcagctcctgcagctccagagccagtcccagctcatgttccagtgtcagctcccgtgtccgctctctccttcgctccagcatcagccgtcaggggcccagccagtggcaacggcggttggttgcctgccactcccagtggcagccgcgaccacagcagcagcagttccagtggctcagagccgggcagcggcgagacgtatctgccagactccaggagccgctcagagggacctggtgacaagcaggaggacgccttcgactccaccgaccgcaggagccgttccgagcattaggctcgctttccattagtttatcgactgtttagtatttgcctgttagtttgtgtgtttaggtctgctcgcttgtgggtcagtcgacggtcgatatcatgtgcctatgatatggctgtcttaataaggattttgcttgctgttttaagtgttttaattcagatcagaacaattgcagtttaaattcctatataataaagcttagttcctgagcatctgtttttcttcttttctacccccccgtctgctcttcctccagatggtctacaccaggaatggtagccgcacaacaggcgagggcagcaacggcaaagaacgcactgacggtgtgcatcccaacagcgattccagcaatggtccgccaccactccccgagaatccgactctggcccaagtaatggctcatcagactcagatgatggcagccatgatgcagcagcagcaccagcagatgcaccagaggatgcagcagcaagacgagcaacagcagcagcagtttggtccccctccccctcagtccaagttgccggagtttctacgcgtcaggccacccaccttctcttgcaccaccaaccccatggaggcgaatgactggctccatgccatagagaagaaactaaatctcctgcagtgcaatgatcaggagaaggtcgcctttgccacacaccagctccagggttccgcgtcagcttggtgggacaatcacatggccacccgcccgccaggcactgaagtcacttgggcggagttctgtcgcagcttcagaaaggcgcaggtgccagacgcggtcgtggcacagaagaagagggaattccgggcactccaccagggcaacaggacagtgactgagtatctccatgagttcaatcgcctagcgcgatatgcaccagaggatgtccgcactgacgcagagaagcaggagaagttcctaggaggcctggatgacgagctgaccaaccagttaatctctggagactacgccgactttgagaggctggttgacaaggcaatccgtcaggaggatcagcgcaacaaaatggacaggaagagaaaggcggcgcagttccggtccaaccaagggagccaccagcaaccgcgcttcactcccggacagcaaggtggacctaccaccatgatcgtcctccagcaccgccctttcaactcaagcagcttccaccagggcgccagtggcagccagaaccaccagggaggtcagcccaacctcagtgcagctccgcgcccaccaatggcaccagcacagtcagttccatccgctcaagccaagatggaggctgggacaaagccagggtcctgcttcaactatggcgagcttggccacttcgctgacaaatgcccgaagccaaggcgtgccgggctaaggtttgtccaggctcgtgtcaaccacgcgtccgcagaggaggcgcaagcagcaccagaggtcgtactgggtacgtttcctgttaactcaatccctgcaatagtactttttgattctggtgcaacgcattctttcatttcaaagaaatttgtggggatgcatgggttaagaaaagaagagcttagtactgtcgtgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtttcttttccctccccctctccctcttgggccggctcggcccacctccctccctctctctcctctcccccgcggcccaatcggccccctccccgcgcgcgcgtgccgctgacgggcgggcccgcccgccaccctcgctgacgggtggggcccacccgtcatccccttcctcccgccgctcccgccgcctcgcccgtgccctagcgccgccgccgccacgaatcccaccgcctcccgccgtccacgcgcgcaataaagtgggggggggggaaatatttcccgtgattccctccctctttccccccatttttccctccctctctccctcggattcgtttggaaacctctccctaacctcgccggcgccatcaatggcgaccggatcttccgcgcccgtttccccctcgtccggcagctccctccccctcccaatcctatataaaccttccccgtgcctcccttcaccgtttccgccactcgccgccctctctccccgtcggaatcgagctcgcgccgtcgctctctctctccgccgtcaccgccgagctccggtccgccgccgtcgtcgccccggaccacctcccgcctcggcgtcgccaccttcggcttcaccgcatccccggcgacctcgtccactcctccgttttgctcgccgaccgccggagcaccgtcgaccccgtccacccgagccgcgccgccgccgcaccgccgccttcctccgctccggtcgccgtttccgtcgtcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgtcctcgggtgcggctgacgcgtgggaccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttgatcgtgtagacgctgcagctttggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattgttattgttattatttccttgttcaccctagaataaacaaaaccccagctagtggacactctactcatggtaccactagtatgattttaggtagatgcttcgctatttaattaggtaacattaggcggttttacaactctagactttgggatattcatatcacctggacactttggaattgttggagtattgtggaattggattcacaccgccccctctattcaaaatccccaaaaatggttttaggctgggctcggggtgcatggttttgatagtagcacctcggccaaataaggaccggtcttcgggcctctgttgcaaagcactaccgtactttcacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggtcggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttgcatgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgtatagttctagaatcgtgtttacaaaatagctttgagcaactaagtatctttaaatgctgtttactgcaaccctaaccctttatattataactcccttgtactcccttgcatttattatgcacttgtgggtgtgtcttgttgagtacggtggttgtactcagtcttgctcaatttttttcccaaacccagaagaggagtctctggaagatgaaggttttggtgtctagctcgtgcctgccgtcaaacgcctgtggtcgtcgccctagtcttccgctgtttctcgtttgtctttgtgtgtgctgggccttcgctgcccatgtaataaattaactatttacgcttccgcttgttgaactctgatctgtatcaacttttggtgtaccttgcctcctgggacaaggaataatgcactcacgtaaggaacgcccgttgggttatttccggtcgtgacatacaatctacttgaatcgttcttttactatgttttctattttaccctagtttagtccatctttgtcggtttgcgctgtaaacagtctgccgccgctgcgagagtgcgacacctctttgtaggtttctcctgaaaaccttccgttttacccacgagacgggtagttatcctcatatcgatctaaatcggcctagaggctgattttgatctctaaatcggctccactagccggtttagcttttctttatacaaaacccatcttgatttggctctttggctagatcgaggtggttggcgactccatatcaccgcaaggcgtttaggtgttgcgatcgtgcttgtcgacttgtcacaaaaaggtgccaacatgatttttggcgactccgctggggacgagatccgttcatcgtcaactcgacttcgacttcgccatgacgaagccatcatccagaacggaggtggagccatctaatgtgatgccggtcacattggatgacttcgaaggagaggatcgtaaagctgtggaggagtacatcaacgagctcacacgggaggcgttgatgagattaactactaggactcatcaagttgtgatcatcaagcccgggccacgtcctatgctcgctcccgacgtggtaagtaatgacgaggtatcgcaatctatcaacgaacaaattgcatctacaaaagattcatctatggctaattttaaagatagattagatttaatgtttaaggagaaggttgatgggtttttaaggagtaggctaggtgcttttatggatgattacacattaaaggataaagcctataccactgttgatcaatctcctatagatccgatgggtagtaaaaccgacgcgacggtattcacggtcggtccgaccgggcctgacggccggtcagaccataacatagccgtcggtccgaccggccagacggccggtcagaccggctctcaggccggtccgaccgcgcaacaggacgctggtcagaccgggccctgggccggtcagaccggtgcaattgtcccgattcagggtatagatccaacgactaacgctagttatttgtaccactttagaacatttgatcctcctgtatctactgctactattaatcctcaagttcccccacatattcctaatgcttataatgatgtttctaggggatatcctcccgatactaggcaaggccaatataatcatattgcgccacaaacccagcctattaggctaccaaacccaccaccaaatccacaagggcctaataacatagagaatgtgattagtgatattatgagaaatagattcgggattgaaactaggaatcgtgctagagcttacaaaaagccatatcctgattattatgataatgtgccgtttcctagaaattatagagttcccgaatttgccaaatttagtggtgaggatggtaagaccacatgggagcatgtaggtcaatttttagcgcaatgtggtgaggctaatagtgatacttttaaattgcgcttgttttctttatctttatccggtaatgcttttacatggtttacttctttaccggcaaattctattcatacttgggctcaattagaagaacaatttcatgatcatttttgcactggtaaaactgagcataggttgtctgatataacatcggttaggcaaaaatacaatgaatctgtcgttgattatattgaaaggtttagagaaattaaaagccgatgttttagtttgaaaataactgacaaagatttggccaacatttcatatgatggattgcttgattctattaaagagaaattgaatggccagatatttcttgatattgatcatgtgttgcatgaagctctgactcaggaaagccgagtggatgacaatagcttaaatgctagtttagatgatagtgcaataacatgtatagccgaacctagcgataattcggattgtgttaataatttgtgcaatgatgccgtgacaagtatagccgaatcaaatgttggtccggactgtcttactagtttggatgataacgcaataatcaatatagccgaaccaagtgttggtttggattgtgtcactagtttagacaatgatggaatagccgaaccaagtaatggttcggattgtgttgctagcttagagaataatgccatcgaagatatagccgaactaaatgacggttcggattgtattacaagctcaagtgaaatagcattgtcacctaagaccgaattacaaatcggtcatgtagatgttggaaaagatagtgacaatgtcttgcaggatagtagtgagatagaatccaaagtaactatgcatacatatcaaagatcgtatcctgaacacgtagattcggtcccatacccgcaaggatttaaggtgcccaacttcacaaaattcacaggtgaggatgctagaacaacaatggagcatatcggccaatttattgatcaatgtggtaaggccggtaatgatgatttgcttaagttaaagttgtttcctctttctttgtcaaactttgcatctacatggtatagtttacttgctcctaattcaatttctacatggtcacaaatggagcatgagtttcatggttatttcaaagatgcaagcttaatggagcaaagaccgattgatacttcaccggtcacttgtgaaactatttcggttacatctatgcctaagaccggaattgttagtgattctctccctgttagtcctattgatgtagacaaaaagaaagggaaaagtgttattattggggatcttcggcccaagaataggataaaaaatgcgaatgccgaatatcataaagttgcaaaggatgggtcatctaattcccaaaagaccaaaaagccgaagctcacttttgagatgcttatggctaaatacaagaaaggattagccggttaacgatttgataaccaaactagtgattcgaaaagaccaagatcatctcgtaggaagagatttagtcaaacattaaagcaatcggagccatcaaccataccaactccatataaacctccggttgtgatgccatggtatccatatccaatgtcaccgtttggttatccttttatgtattacgtgccgtggatgcatcaaccacttatgccgcattatcaggagtggaaggaatcacctaggacagtgccaaatcgttcatctaactcaagacaagactgttttccacaagagaatcggtccggtggatcaaaggtgaaaaaaatgaaaaaggtgaagaaggtgtgggtgaggaaagaagccaaagctccggaggtcgttgctgccaaagaggagtctcaagaggttcatgtacctactggagatgcggtggaaaccacgcaggcaaaggagattgaagctgatgccgtgactgccaacattgggggtctaaccgagacagctggccggtctaaccgccagtctatggccggtctaaccgaccttaccggccggtctgaccgacggcttgtggccggtctgaccgggctcagaggccggtctgaccggggggcattggagaagagtgggaaaattgagagcaacataggagcttccacttcgacaaaaaatatcaagaatcattgtttagctcctggaaaacaaccacagccgaagtggataccttctggcttatctcgctctcaaaagaggaggctacagcgtcttcgggccataggtcaaaaagaaaaggaggccaaagatgtggagaacaaaacatgtaacaatttagagcttcgaacgacacctaagcaagtgtggagatctaaagaagtaaaagttaagagaccggtgatttcccatagtagtagtgataaatccaatttgatgagagaagaatcatcggtcattagagataagtctccttcacatgatgctatggatgttagtacggtattcatcttgccttcgaaatcgtgcaatcaagaaagccgattttgcttggggggcaagacattaatatgctcgtgaaggaaccaagagaagatgaacggcgatggatacgacatcatatctttgagccgccgtttgttggatgctaaggcaagatatgggtttattgtgtttaccattatattatatgcctatgccatgttattagaatattgcttgctatctagaacatgtgtgtttttgcttatcaaattgatattatacatacatgttgcaaatgccagttctaggaagtagaattggtaggatggcatataatttgtttgaggtatgatttggctcatgactctttgatatttatttaaagccaaatcatatgtgtttttatggatcaccatataagatatagatttcatatttattgcaccatgaaagttttgcctactagtaattcggctaatatcaatggtcactgtgatggtttgctctagagtggttttctttaggaacattggcattgttaatattttgcatacatgctcaagccgattacttacatttttagtttattggaatctatgcatgtgacacatatgactttggtgattcattattgatcatacttcaattggctaagtgttgtgatgccatgatgattattgtttcaacagccaattgaattagtattcatctagacatattagttgaatgttatgatttttcatatgtatagagagaaggaattttggtccaataatttgatacactaagcatctggctattatgtgaagaaaaattatatactaaaggccgatgcttgatttcaaaagtttggatgaagttggcaaagtcatagatcaggggtggtctgaccggcattgcacggccggtctgactggtggtacccgcggtctaaccggctctgcatggccggtctgaccgggcagacagggtggtctgaccggcattgcgtgtccggtctgaccgatcccagacaggaggctggggggcacgttacaattgattaaaaggccgaattaattattcggacatttgtgcccatgagttagaaatagcttggagaattcctttgattagatatttaaaagatcctacacttaaggttgatcgaaagattcggtggcaagtgttcaaatattgtatcgccgaaacatagatggtgtcttgttaaagtgcttagatgaagatcaatctaaagtggctatgggagaggtacatgaaggaattcgtggaattcatcaat

SEQ ID NO: 9675 - DNA, 1294 bp, Oryza sativa
gcaattaatgggaaatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgtcgggtttccttcactagggccggtcagaccataggtatgtgggcggtctgaccggctagtagggccggtctgaccgcagttatgtaggcggtcagaccgtgagggtctgagtccgactctgttttcgtcgggtctcgggtttccttgctcaggaaggcatgtttcgtgtttccattggtttctatcccgaattggacgtgaaggagggcctgtagagggcaagaccaacccctatataagggacaaggccggttcattgtaaaacccccgaatacaatctacttgaatcgttttttaactatgttttctattttaccctagtttagtccatctttgtcggtttgcgctgtaaaccatccgccgccgcagcgagagtgcgacacctctttgtaggtttgtcctgtaaaacttccgttttgcccacgagacgggtagttatcctcatatcgatctaaatcggcctagaggctgattttgatctctaaatcggctccgctagccggtttagcttttctttctacaaaacccatcttgatttggtcctttggctagatcgaggtggttggcgactccatgtcaccgcaaggcgtttaggtgttgcgattgtgcttgtcgacttgtcacaaaatgttgccaacacaaatcactagtctcaccaaagcaaggggtctccttgaatcagattgaggtggaaatcccagtggtcaccgaggggaagagttcgaggaaattggaagatatccccatagtctgcgagtacccagaagtgtttactgaagacctcactaccatgccacccaagagagagattgaattccggattgatttggcaccgggaaccgctccaatttacaagagaccgtacaggatggcagtcaacgagctagcagaggtcaagaagcaggttgatgagcagctgcagaaagggtacattcgaccaagtatttcaccttggggtgctccggtcatttttgtggagaagaaggacaagacgaagagaatgtgtgtcgattaccgcgcactcaatgaggtcacaatcaagaacaaatatcctttgccgcggatcgatgatttgt

SEQ ID NO: 9676 - DNA, 549 bp, Oryza sativa
cggcacgggcaggtcgaccccgccggcagcgtcgaggaagccgcaccgcggctgtcacactgcctgtacgacctgatcgtgctcgacattgcgctgcccggacgcaacggcctggaatggctgcacgaactgcgcagcgaaggctacggcggcgacgtgatcctgatcaccgcctacgccaatctcgataccgcgatcgacgcgctgcgcggcggcgcctcggatttcctgctcaagcccttctcggtggcgcagatgctcaacgcggtcgaacgctgtttcgaacgctcgcggctgcgccgcgaaaatttcgtgctgcgccgcgaggtcgaggaacagtccaccgccgtcgagggcgtgatctgccagcggaagcgatgcagggcgtctgcgaccgcctgaagcgggtcgccccctcctcggcgacggtcttgctgaccggtgaatccggcaccggcaaggaagtcgccgcccgcgccctgcacaagatgagccggcgagccgaaggacctttcgtgccgctcaactgcgcggcgatctcgtccgaac

SEQ ID NO: 9677 - DNA, 1570 bp, Oryza sativa
tttatcaatctccccttcctccttcaacttgaatagttgttaagctttctggagaaacttgaagatgccaaagtcaagtcaagtgtatcgtggaacaagaagatgtggttgaactgaaactgaagtatcgagctttcgagatggaatgaagttttggatactaccttagaatctaaaccactcttttgcaagagtataacatttgttgcttggttgtgtgtaggtatggtagcattttcatcattgacgagcgtgtaactgtactaggttgtttgcttaatcaacttgaacaatataatattttacacacatcagaccagtggaaacatggttaaggtcttatctttagtgtaacccctctccttctaccctctcaaatctacaacagatggtgaacactcgcgccagtggaaagtggaaataataacaacgatgagaacccaaccatcacacaagtcttggctcaatagactcagctcatgaacatgatgatgtagcagatggataaccagtttgaccaaggtaacaacaatcttccgccccagaaaaagttagctgaatttctttgtgtgaggccacctacattctctagcactaccaaccttattgaagctagtgactagttgcatgctatcgagaagaagttgggactgctccagtgcacggatcaggagaaagtcatttttgcttcgcatcagttgcatggacctactttagaatgatgggatcacttccgaatgaacagagtagaagaacaaccaatcaacttgactgacttcactaaaggattcaagaagacatacatacctgcaggagttgttgctttgaagaagtgcgagtttaggacactaaaacaaaaggatcacactgtgagagagtattatcttcacgagtttagctgtctagcatgttatgctccaaaagatgtgcgtactgatgaagaaagatcggagaagttcttggagggactaaatgataagatgtcagttaagttgatttccgatgactatatatgcgttgatttccgatgactatatatgctgatcactggtggatagctgcaagaggggaatgttggtttcaaaggaagcacagggtagtagccagaggcaacgtatcaagccactccaaattgaggaatcaagttctacctctcaagaatagtcgcaatagttcaagaatggtggtgagatcaactcagagaataatgcgggcaatgaagtcagcaacgagcaaactcctcaatcaataccagcttagccaaattagcctcaagaagacaacggtaatggaaggaagcagttggtgtgtttcaactgttatgagtcaagtcactttgtaagagagtgttcgaagctgaagcatcagatgtcacaaggtcaagtcaacaacattgtcgtcataggagccaatgtcgtgccaattgcgtcttcaagtgataaaactcagccatcagttccaaagcagcagtagcttccttttggccttagaataattattagagtaatgaaataagatagaatgcagtttacatatgcccttttctttctagttgttccaaatctctgga

SEQ ID NO: 9678 - DNA, 3310 bp, Oryza sativa
gatctagagatggcttcagctacactcccataggcagcttaagtgaggtataagccaaatgttttttgcttcgctactttcttcaactgaggtttatttattattgcaagagtgagcacatgaaatactcagcaagccacacaaatatgcaagtgcacaggaataacaaaggatggcataataaagggttcatttgcaaaagtagtatttagcaaatatttgagagtagtaaacattagagtaattaatcatcaatattaatcaacactgaagtacaccaatgctgcacaggcctaaccatctctgaacaactaaccccagttgcacagatctaaactccataacagtagctaacaaattataatcaccaattattattattaatgaatagtgcggtactaatcacaaaaaacattgctaggcccacccatgaccgtgggcgcagcaattcgaatagttttattttggccagaggtgtacaaatttacccacaaaacactaattctacacatgttgccatgccccgaaataccgccatggtattgcaaaggggaaaactttgacaagaccatttgcataacatgcccaaccgaatgacacccactaagcatctgtctccggtagggatggccagttccctaacagggagactacctaatgcccaaacagtggacttaattgtctatcacctatcacctgtggacttagttgtctgccacgataaaaacacaacataccgtggcatctgtcgtgggtcatattatactacagatctaagtcgttgcctattcttgctcgtggttaatatggttaatgcttcacaacactagctcgtaaactagtccttagttgtcatgaggacgtccaacacactatgtgctcacaactcaccattagtaaaattttatttgtcaagttaataaaccaagcactaccaatcagcactaccaatcgtcacgagatatcactaattaatcatcattaatcatgagggaagcattaattattcccacataaatgacactaaagtgtctaagcatggcaaagcaaattatactaaatactccctccatctacttttgatagtcatacttcatcttgacacacagaccaaggataagtgattctacttatcatccatttaaatatgctactagtaattcctcgtaaacaagcgattcattaatatttacatttctcgatgctcatgcaaccaatctggtgtggaagaatgaagagtcatgcattaaatctaagaaagtcattaagatgataagttgttggattgaatatgcctattaaaaataaaattttcagatttggaaatatgactatcaaaaatagatggagggagtatctagttggaccaatgtataaagtccaaactagtcaaagtataatctaggttaacaaggaataaggtaatcagtacaaattagctatacaaaggaatatgtgttcacaccacacaatgacattaaaaaaatgaacatttgaaataaatagagaatttaaatataagatcaacatgctcaaagggattgtatatgtttgggatctgtcttgcaataatcggtcttcaattaatcttctgaaactcttccaatgcactcataaacctccaaaacgacagaattaaatgacaagctaacaggcaaaacgagaaaaaagaataaaaaaactccaaataaatagtacataaaaagtaaacaaacatgtagagcatgattttataagaattataagacttgaacagcctcattccaacttcatatgaattagttatgaattttacaaggtttaatccaattaaacctattaaagaaaagattacttcaaattaattggatggcagagggggaaaatgatgacggcagagctcggtttgactaagttgacagagtatcaacggattagatcactcgaggatggatgaagggctgacatcgattgactggattttgactatatcggacggctcagattgaactcgatctagggtttagagatggcgccacatggtgacaccggattttgacctatattggatgggagcgacgtaatggcggtgacgtggacagccacacaggctcgatggccggtcggctctagacccacacgataatttgaaaaacaacataatgcatataatttgaaacgagataaatttgtaagttgggatcaacatgttcaaaacatgttcaagggtatatttgcctttacccatgggattttcacactgaacttcacctgcaatagcaacttcctcggcggcaacgtctacatgatcttaaaagggataaaaacaaataaacaaaaagaaaaggcagaaaaataacaacaaataaaataactaattaaatcggaagatagagctcaacttttgaagaattaacttaagaaaataaacaggtcaattcggagttcggatggaggagatataacaattggaagattgaattttgagataatttggatggaaaggtaaacgaagatttgtggactgtctctttagtaattctggaacaagatattatttttggagaactgatgagcatgatccacccatcagtgggatggtatgtgcctaataggtcttatcgggaaaaaatagtggatagaaaatttggaagacacagagcacgatatgtcactattagaaaattagttgttgctgacagtcaaaatagagtttcgctggtggccagaagtgtcaccagcgactaacggccagtgaaaataatgcattttcactagcggccggctggccagcgaaaattgagtttcgcaaccggacatgcttaattagacagccgctagcaaaaatggtgcggcaagctaaagaggaccatcggtgataacaattttggggataaaaaaaatcaaaatcggtgttgcaggccgccatagccgtaaccaccactggtcgccatggctgcaaatacagcccgcgtggccaccgcctgccaaagcccacaccgcggtcaccaggtggtagaggggaggggattggaggagcccaggcgtcatcgtcgtggtagccgtcgtcgtcatcatggcagccaccgtccatggaggatccgttgttgcggcccagcggaaaagaggaggacgacgcaggaagcatggcggagaggaggaggccacgcgcccgcggtgggaggcaggggaagagggagaggacccgaggggcagagaggaggagaaccgcccccgccgccagatctgtgccaccgtgaccaaccatggtcgaggtcgcttcatccatcaccggaccccaaccctaaccaccggatccgtgccacagtga

SEQ ID NO: 9679 - DNA, 4810 bp, Oryza sativa
ttcctgcagcccatcttcattgacagtcctcttaacttggccgccaacgaagatccattttcgctaacagtgctaggtgaggaagaaaaagctgagaatggaatatggctgcagaggcagtggtgcaacgatgggtggtcaacgacaaggaggtggtgccaatggacggcctatggtctacggttgatgatggcgtcgactgaaatttcggaggtagcagcctatgctctccagatgatggcaaacagcgagagacagcaccagatggtggaggtgaagccggagggttggaagatggtagaggtagtaccaggaaaaaaatggtggtggtagtgccaacaacgacgtggtttgggaacagtgaagtggcggcggtttgacaacgaggcgttggcgaggataacagtggtggcatctccgatcctttggatagtataaagaacaatgatgcacacaaccactgggatggcgttggaagaaacagagtggtgggcctggttgatgaaggagctactgctatcggaagatggaaacttagaatgaacagggaatatttttagaatgttccactggaatttctgaaataaaagtattatttttgcatgagattaatataggaagaacaagggaccagcgggtaggggtgacatagtgacgatggcacaaccaccggtagtttgatggtgctaggaacaaaagaaaagaccgacttaaggaagacaacaacgtacggtcgctagatgagaagatggaattgactaagataatgtcacttagctatgacagtggcgttgatcaatgatgtagaagaaggaagatgggagtagactgatactcaccaacgatgcaaccgccatggacgacgtgtggggatgacaactgtagcccctggcagcaggacgacgtgcgtgcgcacgatgcgtcacggtataggcgcagaaatggagaggatgcggtggcactagtcagctgatgaagatggcggatggcataggcagccaaggggatgaaggcgaagcaacggactgagtcgtcggcacatccgctacatcgggacagagatgcaatggcagcttggatcaaggcggctctagcgatggggaagaagctgacgacatctcagcgtgcgttaataaaaagaaaagggcagcagcactaggaagagaagatagcaatagggtaatcaccggtggtagaaggaacttctggagttgaggtgtcaaggctgcgttgggtgctgatgctgacattgccaaggaggagaagatcgaagggagaggtagtagacttaaaagggggaatgttcgtttaagtgggccagaatgggccttgtaagcgtgagtggttattcgacccaagtgccagactgtaagcgtgtgtggggagtgagtgggagtgataaaactgaacacgcaactcctgtaaacctttttatcgatttagaacttggcggtggcgattggcggcggcagcggcggaattcgttggaaatccccgtcgatataccttgtgtgtctccagttctgaatcctagtttaggcagctatcaatttggtatcagagccctcagatcttcttggtttcttgaattcccttggtcgagccgtaaaattccatgagataggtggggatccgctgtttacagtgatattccgcaaaagccttttggggctcccttgatctggttggctagattcggggtaggaccagcgatcatcctggagcgacctcggtataccactaagcaagcggctcaaatcatggctcaagatgggaaactcgatctcttgttgaagatgatggaggaggccgagaaggagcgggaggagatggataggaagcgcgaggagtcggaggccctgaatcttgtggagttgcagctgttgaagcttgcgatggagtcccgcatacccttggtggagaaacaggtgagcgagttggggggttctgcgaatgatttggcgaagagggtgaattccttgcaggcaagtgtggagaaatgtcagcgggaagttcagcagaacgcgctatacaaaggggaatccagccaaggaccaactcaattcccaaatgatgatgacctcaatggaaactcaccgaatcctttcctgttcacaccccaacaaggatggcgaaatcctccgcagttcaattctgtaagcccatttactcctgagaactcgggttgtccaatctttgattctggaatggctagtattggtggcaatgtcccttctatgtcttgccctcagtttgatggagaaaatccccagatgtggagagataactgtgaaatttattttgaggtctatggggtacatcctgctaattgggttaaggttgctctgctgaatttcactggaagtgcttcgttctggttgcaatctgttaggaatgagttggtagggatttcctggttggagttatgtgatagagtgtgccgtaagtttacaagggataggcaagaaattcttattagactgtggtttcatgtagcgcagacaggcagtgtgactgagtatgtggagagatttgatagtctcatgcatcagctgttggcgtatgacaatgccctacaccaaggtacttcctaactaagtttgtggatggcttgaaggatgacattagaggggcagttatgcttcagagaccggtggaccttatggagcttgcttaatggcattgctacaggaagaaatattggaaggaagcagaaaaccaagttacaggaaatctgatggaaccaatttcaacaaggtgttttcccgacctactcagccaactgtttggccaaaaagtcctgctcagactactggagatgacagccagctgattgagtcagggaagataaggtcttggctctgaaatcttacaggagggctgaagggttgtgttttacatgtggagaacgatggagtaaggaccacaaatgttcccaaactgtgcagttgcatgtggtagaggaattgttggaagcatttcaaggtgatatggaagaagaagttaatggacttgttcctcccagaaagactccttgatggcgcttttggctagtgcttgtaacggcacagattctactcattctttcagagtcaaggggttgatacaggggactaaattactgatgcttattgactctggcagttctcattcttcttagatgagaatattgttcagacaatgcaaggagttacatcccttccacaacctgttaaggttaaggttgctagtggtgaagtttctgatttgtgacaaacaattaccggattatgcttggtggcttcaggggagatgttatagaaccaactttaaattgctttccctgcctgggtatgatgccatcctggggatagactggttacaagggctgggagtcatgagaataatttgggttcaaaagtggttggaatatgagatcaatggaagtccagttaggattcaaggggtgatgcccaaggttgatgcctgtcctctaatatctggagataaactcatgggcttgtgcaaaatgggagctcttatgcatctgtttcagattaccagtgaaaccgacatacataaacctgagattcccattatgatacaagaagtgatgaatgaattcaattcagtttttgaagaaccacaaggactgccacctaggaggcgttgtgaccattccattccattaattcctgggtctaagccggtcaaccttcggccctatggatacaatccagcccagaaggatgaaattgaacagcaagtacgagatatgttaaagtctggagttattcatcctagtgttagtccgtattcatctctggcattgctagttaataagaaagatggcacctggaggctttgtgtggatcatagactgcttaatgctatcaccatcaagagcaaataccccctgcctgttattgatgaacttttagatgaattggccggcacaggttggttttctaagttggatttgagggcgggatatcatcaaatcaggttggttgctggagaggaacctaagaccgcctttcaaactcattttgggcactttgagtatcgggtgatgtcctttgggttgacaggggcacttgcaaccttccaaggagctatgaatgaaaccttggcttcggtcttaaggaagtgcgccttggtgttctttgatgacatactgatttacagtccaaccttggaagctcatgctcaagatcttagaactgtcttgcaactcttgcaggatcatcagtggaaggtgaaattgagcaagtgctcttttgctctgaaggaactcaattatttagggcatactattggagtggctggagtttccactgaccctagcaaggtacaagatattgtcaattgggctattcctactaccttaaagaagttgaggggattcttgggaatagctgggtattatcacaaattcgtgaagaattttggtgtgattagtaaaccactcacaaacctgttaagaaaaggggttgagtttgtgtggactccggaggtgcatgagtccttcgagcaatttaagaaagctttggcttcagctcctgttcttgctcttccggattttactaaaccttcgtgtcattgagactgatgctagtgagatcggaattggtgcagttttgtcccaggataaacaccccattgcttatatgagtaaggcattgggtcctcgtactagggggttatccacttatgaaaaagaatgcttggcaatcctattggcaattgagcattggcggtcctaccttcagtatgcagagttcactatactcactgaccacaagagcttgatgaatcttactgatcagcg

SEQ ID NO: 9680 - DNA, 15167 bp, Oryza sativa
atcggtgggcattccggatttcctgtgacttatcgaaggatcaaggccctttttgcttggcctggtatgaagaaacagatcaagctcaaggtgaaggagtgctctatttgtcagcaagcgaagccggatcgttctaagtaccccgggttattgcaacccttgccggttccattgggagcttggcaaattgtcacgatggattttatcgaagggcttccaacctccaggcgattcaactgtattatggtggtggttgataagctatctaggtatgcccattttttacggctagctcatccattatctgccgcagacgttgctcagttgtacatggaaggagtttttagactgcatggtttacccctggccatagtttctgatagagatcgcatctttactagccacttttggaagcagctgtttaacagtgtgggcactaaacttcatatgagtactgcataccaccctcagacggatggacagactgaacgtgtgaatcagtgcttggagacttatttgcgttgttttactcattcctgtccaactaaatggtccacctggctatatttgggctgagtattggtacaatactagctatcactccacactgaataaaacccctttcgaagtattgtatgggcatattcctaaccaattgggcattactgttaactcttgtgaacttccaaatgtccagcagttgttgaatgaatgagggttaatgatacaactcttgcagcaacatttgaacagagcacaacagtttatgaagagccaagctgacaagaaaagaagttttagagcttttgcagtgggagattgggtctatttgaagttacagccatatgtccaaacttcagtagcagccagggctaatcacaagctgagtttcaagttctttggtccttatgaaattcaagagaagattggtgttgtagcataccgtttagtccttccggcgagcagctctattcaccctgtttttcatgtctcgcagctcaaagcagctcaaggttttaaaggggatgcttctgttcatcttcctgttcagtcttctactaaacaagttcctgtggctattctggatactagggtgcgcaagtcaggtatgtctgttattcctcaggtgcttatacattggtctgatgatgtgatcgccaatgcaacttgggaagacttggaagatcttcgtactcgtttcccaagagcactggcttgggggcaatccagttttcaaggggggaacattgtcaaggctgcgttgggtgctgatgctgacattgccaaggaggagaagatcgaagggagaggtagtagacttaaaagggggaatgttcgtttaagtggaccagaatgggcattgtaagcctgagtggttatcggcccaagtgccagactgtaagcgtgtgtggggagtgagtgggagtgataaaactaaacacacaactcctgtaaacctttttatcgatttagaacttggtagtggcgattggcggcggcggaattcgttggaaatccccgtcgatatatcttgtgtgtctccagttctgaatcctactttacgcagctatcatgagggcgagagggtggcaccattccacgatggcagcagcacctctgcacgaaggcgacaaccaccacacatgggagaggaccgggattaaccactgatgaggacattgaggtggcagctatgttggaaactgggcaacgatgatattgtttgtgatctgcgaatataaccaaaatggttttctcacactagatgatgattagggaggaagaacgtgaaagcggcgcaggtgcttaccacgatagagaggtggcagcaatgccgggtggttgacaacaagttgatggcgatggtggatggcttgatggaagacggcgcaggaagtggggaagacgacagaggtggatggcataacagtgctgcgccattcgctggtaattgagagatctcccaacgatggtagcagtgctggaaatgagacgaccatcatgccggctcgatcttcccatggagcagctcgtgcttgcgatgacagcggcaacattggtgctcactcgatcggactgcaacacaaccgcgtctactcgatgtcccgaggcaggaacctaggccggattatagtgagcagcaatagcagcaagacatggtccggtggacgacgatggagagagaggcggcagtgcaagttcgcagcgaacggccggtggagggatgcaggcgtgtcgccggaggtgaggaagatgcatgggaggtggccttggccttggtgttgaccggcggcggcgacggcacggtgtggcaggaacggtggtctgcaaagggaaaaggagggggtgctggatctacttatagaggaggacagggagttgagcggccagccggaagatgtttattcatttttttagctgagacgatggaaattgaggtgactgactgatgatggttactcattttttggctttggtggagaaaattgatggaggggtttcgccggggatttggctggtgatgtgatggcacggccggggctagctgaagcgcgcaggcgggctggttcgaactgcatgcgaggaaatgagatatggggcttcggcctcctgctgatgggacttcggcctcctgctggccagaggaagaagatgaccgatcgagaaggaagaaagaaaagatgaacagccgggagacaagatccaactcatcaaaagagattcaattttcggcattcaacaagtgaaattgatgatggagaggaaaggattagggaatttctgttagcttcagctataatcatgtgtcgtattatcggttactgtaacgtgtctagtgttgtcgtttcttcagtttcgtcagactctgtttcggcgtctgtttctctgtttctttttcctgtaagccgagtcttccgggtcgtgcgtcgtgtgcgagtcatccggatttcagtgtcgtggtcgcatcgtcgtggatgatggcgtagtggtgtcagtttgagtctgtacatatttgctatatatatgagcatcagaaaacgtcgctggttggttcgcgacaccaaaaactctgttcgtgttcatcgtctttccaattcagagaattcgcgtgagagagagagtgaggattcacaatcttgggctttgctatcatttggtatcagagccatgtccgctcccgccagcggttcgtctcgcactcaccggcgaacaggccgccggctctcgccgtctccgccgcgcgtgagcgggcgacagctcgtcgtgcagcggattgttaaggaagatggctccgtctactatccaatactcagacgctcaaattactccgattgggcggtgttgatgcgagtcaatctccaggctcaaggtctgtgggatgctgtcgacaccggcgatgtcccgtatcaggaagattgccaggcgctttcagccatcttgcgagcggtgccggctgagatggtccggccgcttgccgagaaggacagcgccaaagacgcctgggatgcgctcaaatccatgcgagtaggcgcagatcgtgttaaggagtcccgagcacagaagctgcgccaaacttttgagtccatgcgattcaagaatggcgaacacctggaggatttcagccttcgtctccagtccttggagatgatctgtctgaagagaaggttgtttgaaaattgcttcgcgtcgttccccggaggtatcgccaaatggctctatcgattgaaaccttgattgatctcactgtttgatgaatttttataccaaaattcatagaaaaaataatatatcattgggcattaatttgcagcccaattttacgaaatacacgtgaaacatgtctctacgacatgtgggaccagaaaattcaaatatcatacaatgttcaaacatattcaaaattggactcgttttgttgtatgttttgattggaaaataatggttccaacagaattcatatttgatatatgattagggagatataaacatttgaaggagatcaaccagtgttaacctcgtatatccttaatttgtttgctgctcctcaccggttggtaattatccttatggcagtgtttggcaaatgtctaaaggaaatgatttcccactcatctttaaatcctaaccatttattctccctcatccatttaatcctaacccttcattcatttcctaatcccaatcccacccctcatttcccattatccaaacacaccctatgaggtgtgggatccaccgtcaattagccaagttaatcctcgtgattatctccagcacacacacgttctttttatctggagcacaaaattctttttatcacgcgcaggtcgttggattaacagacgcgctggcttatccagagaattaacgcttgatttcgctggcttgctgaaatctcggaagggattaggcgaggactccgtcgcctctactcttatataaggcgctgtccctcacgacgcaggaggtgggagaaaatccccggcgcagaggcggctggcagaggagaagacgtaggtaggcaactatgctgtgtgctctgatctgcttatagtttcacaaacccatatccaacatatacacaatttacacgtcgtcaccgagaagcacacatagacggcggaccgctgcgcggctcagcagcaatatgccttagagagccgccggcgctgatggcatctctgccggcgagtcgtccgtcctgaataacaagcagatcgatcttgtttttcgtcaagaaaatatcatcagtggtgtgcagacgagtccgatcctcgtggggttggaccgtctaagttatcaaatattggagttggatatttatttgtataaacttaggatgagtttgagccttattggcatcagaccaaccatgatttacacatatttatattctcgttcatgataaaaaatcggatgcgcatatttataaacttgggatgagtttgagccttattggcatcggaccaaccataatttatgcatattgatgttctcgctcatgataaaatatcggatgtgcatatttacttgtataaacttgggatgagtttgagtctaatcggcatcggaccaaccatgatttatacatatttatattcataccggaacaattatagatttgccttgtgcatgtcatgtgcgggagcaattccttctctctctaaattctaccagatggatgggagcaactctcaaaattcttgaagacaacaaaaacaatgctcgccaggagggcaaggcatgcagatttacaacacacgtggacatcatggccgagtgtcgacgagatgaaatggccaatttatcaatatttgtgctatgtccgagaccgacgagtccggataacatattggctaaagctgacaaggctgcagtcattaactcattccatttgtctatgaccgacgaggttagatgaaaccatggccgagtgtcgacaaggccaggtcactatactattaacacgtctaaaatggacgggaactggatataccgttgctgggcaccgacgaggcaaaagcaatcacaaaatccatgtttgatgaaggccggggcacatgagtgggcaccgatgaggcaaaggtcacccgcttcaccaaattccctccgtatactaacatgatgatagtgtattgtgactgggttttggcaaaacaaagccatcagttccacattcactatattcaccgttaaatctgaaccaacctcaaccttcggcgagcaaccaaattttgatgttgacgatcacaaagcgcagcttaatcggaggtgttccataggctcgctcctatagatgtaattaaccggccgcctcattgctagcgccgggaatcagcggactgcacggaatctcctgtcaagatacctctccattaagcattcctcacgaaggcaaaaggcgaactcctacaggagccctcatgtatttgtaaacattcatgttaatgaatcatgattaataaaaaggcaatacagggtttccctattttctgtgtgttcgttgttttgttttcatcaaacactgaccttgctttctattgaggatctgactggccggcttctcaccgtcgacgatcaccccgactctgatggcgaggacgcgggtcaggtgctcttcagcgaaaaggaggcccctgctcactcaaacaaggaagctgggcagaactcagccggggggagggcgtccagctcacggcaaccacaccgcagcaggcgcgagcgcgacggcaacggctccgacggcaagtcaggttcgtcccaagcggcaaaccgcaatgtgtccaaggacaaatgccggtactgtggcaaacttggtcactgggccaaggactgttgcaaggcgaagcgagaccgcgagaaactggctcaggcaaaccttctcatcaccgagcctgctcaagccgcggacgaaggggagccgacactgctgatggcgcaagtgtgcgagcttgcccctgctaccgatcctgtcattactgacggggaggtgacactgaaggaggaacgtgctcacgtttctcttcaggatgaaggaaagcccgttgatctagactggatccttgacacgggcgcttcaaatcacatgacgggctaccgtgatgtgttctccgagcttcacaccaccgtgcgcggcactgtcaagtttggtgatgcgtcgagagtctggattgaaggacgaggcatggtgctgttcgcttgcaagaatggtgaccactgcgcgctcactagcgtctactacatccccaagcttcggagcaacatggtcagccttggctagcttgatgaggcgcattgcaagacggtgatcgaggatggtgttctcactttgcatgatccacagcgacagctgctgtgtagggtgcgccaaggagttgggcgcctctacgttctccacgtcgagctggcgcaaccggtttcccttctcgcaaaggggaaggatcaagcctgggtctggcacgctagataccgtgtcacgcccagaaatttcgaatagaattccaagcagaatgtgcattaaaatccccgtccaggaccggccggggtacacaaacgacaaagttgacatacagatccacgtcttacaaacattataaaagttttacataaatgcagcggaaaaacaaaagataactggagctaagccttgacttgaactacagcgggaacaccactccacaggcatcctcgatggcacggacgaagcctactcctcggagaaaccaccatctgacgcatactcaaactctggggtttggggaaaatagagcaagactgagtactacccactgtactcagcaagtcataccggaatagggctatgatgcagggaattatcaagggatagctataatggttcatttgcataaaacgggcatttataaacagaagttgaaagcagtaaagcagttgtaacaattaatcaatattaatcatccactgtccaacgctataccatattgcaacaggcccaaccatccacctatactatccaatttcattagactaaactagggtgagactaatcacggtgaatctggttgatcgcccataaccatgggcacggctatttgaatagttttactctgattagaggtgtacaactgtacccacaagacacaaccccacgacacgttttcgtgcgccggcatgccaccacgacatactagaaagaggccgtgacaggacccttcgcataaccccctctaaccaagcacaccacacctcaggtttcacccccactcctcgcaaggccgtgggcagtcccctctcgtgcctagatgaatccggaagccgcataggccatcgcaggacccatccaaactccatcacgcccacccttgcctggatgcgtcaggtagaggaaagctacactacaagcccagccgttgcccacactggcttgtggtaagtatgataagttcttacagggcatcccgcgaaccggtccttaactgctatgggtgcgaccaacaaaaccatgcacccacagcccaccatgtgatttattttaattaaccaataccgaagcggtggcactaatccaacattaccattagaatctacagtctatacattaataggattttcccctttgtgtgctagttgaacaaagcatggctaagcaatccctagtccaatatctagtcatgttataacccaagctaacaaaggagcatggtaccaaaatagcatggctgtaacagtaggtaaacatcccatagtattattgtaaaacaatgcagtatttgaaggaaaacattagaacatttgcaatataggatcaacatgttcaagtgacaggcatgacttgccttgctctgctgctggaggaacctcggtgactatctcgaagtacaccggagcgttggaagagctggaatctaagcgacatacaaagcaaacaatacaaacaggctataagactactgaaacagagaacaaaaccatttttaatggattctacacatttttcttgatttactgagacttgaatgggcttaaacggagctcggatgaattagttatgaattttagaagattcactgtgtttttacaataaacagaaaaatccttaattgaattattgcacaataaatgcctagggctgacgtcatcaaagggagcgggcggcgccgacatgcttggcccgcatgtcagcggcgcaaggggagagggagggggcgccggcacgtgggccccacgggtcagcggcacaaagcggccggtccaccgtggaccgggaccacgcgggtggtccaccgccggtccacgggaccgatggtccggatcggcctcgggccgatcggacggcgcggggagcagccgccgggttcggctcggcttcaaagccggccggccggccatggctagaggcggcggcgtgcacgaccaccggcggcgaccggtggcggcggacggcgcaaaggcggcagcgcacagctggagcaacggcgcggccaaaagcgacggcgcacgcgggaaggggaaggaaaggaagggggagggagtcctcaccagagagggcggcggcgaccggcggcggaaaacgagggaggcggcgaagtccggcgatgccgaggtgcggacgagcgacggcgacacctaggggaggggaggagaggaattagggcggaggaaaaaaccccacggcggccgtccatgttggctggagttgaaggggagaggggactcaccggcgacgcgagggaaatggggtctcggtgggattccggtgacgcaaggcggcggttgggaaagatcttgtggcggcgaagctagtggtggcggcggcttagcgcggcggtggcacgcggctggagtgcggtggcaagcggcggcgctggcggagagcggcgcgagctcggtaggaagcacgggagggagcggcgagagcggaaagggaaagaggaggctcgggggagcgatttataggtgcgggacgggtggaaacggccgggaaagcctcctatttgaccggcgacgtggggtggagagagagataatggggggattcaaaatgcgaatcccgccccttgcgagcgcgcgcgggccgggagacgcgggggagagggcggcgacgtgggaaggacgcgggggcggcgcggcgtgggcgcgggaggagcggaggaggtgggcgcggcggtttcggcggcggttgccgacgtcgggcgggcggccgggggaaggggacgaccccgactggtgggacccacctgtcggcgtcccggagagagagggagggcggcttgggccggcccacaaggaggaaaagggcgcgcgcggcggcgggcggactgggccgacggcccaagaagaggaaaaaggagggaaaagaaaaagaaaaggaagaaaggatttttcctggatttaaaattgcatgtgctcaattttaattggttaaaattatttctagggctctcaaaattccactaaaaatcttgttagcaaatttcgacatgtagaactcaagaaaaattctaatgccaattccgattattatttgcattggtttattagggtttactcttgcttttacaccgatattttcttgggaccatttataaattcaatttaggcttaggaggagaacttcagggtgtgacatacgggcacctcaacttcgacgctctccgctcactggcgagccgcggcatggtgcgcggcattcccactctggagcgggttaccaaggtctgcgacggctgcctaataagcaagcagcgacgagcgccgttcccaacggcggcattgcatcgcgccactatccatcttgatctggtgcacggggacatctgtggacccatcacatcgtcgacacatggcagtaaaaaatacttcctacttctgattgatgatctaactcgctacatgtggttgtttctgttaacatcaaaaagcgaggctcccgctaccatcaagcggttcaaggcaggagtggaggtggagaccggctgcaagctgcgcgttctccacactgatcgaggaggggaattcacctctgtcgagttcgggctatactgcacgaacgaaggcgtcgccaggcagctaacgacgccatactctccacagcaaaacagcgtcatcgagcaccgcaaccaaacggttgtggccatggccagatgcatgatgaaggccaagaacatgccgggggagttctagggcgaggcggtcaccactgccgtctacatcctcaaccgggcgccgacaaagagcgtccgcgacaagacaccgttcgagtcatggcacggtcaaacacctgttgtgcactactttcacacatttggctgcgtcgtctacgtcaaggaggtgaaaccacacatcaagaacttgatgatcggagcaaggtgatggtctttctcggctacgagccgggttcaaaggcatatcgtatatacgacccggtggccaagcgcatcgtcgtgagccgtgacgccgtgttcgatgaggcggcatcatggccatgggcgtcacccggggaggaggacgggggaacgtctcctcaggaaaccttcaccgtgcgctacgaggtagtggcggtggacgtgccgtcccgccactccgactccatgtcgtcgccggctcacatgggaacaccagtgccatcaatctctgcgtcaccgggtgtcctagcggtggagtttgtgtcgctgcctgcggaaacacctgatgtcgacgacgacagcacagggccacgtcgtttttggatggtggccaaaatccttgacactacctcgccaattgagctcgactccgacgagcttcatgtggctgctgccgaggaaccaagcaaccacgctgaggcggcacaggacgcactctggatgcgagcgatgcaggagtaactcaagtccatcgaggagaacaacacgtggactctcgctgatctccctgctgacaagcgtcccattggcctgaaatgggtgttcaagctcaagaaggacgagacgggcgcaattgtcaagcacaaggcccgcctggtcgctaagggttacgttcagcggcaggggattgatttcgacgaagtattcgcccctgtcgccagaatggaatccgtgcggctgctactcgccattgcagctcaccttgggtcgtctgtgcatcacatgaatgtgaagtcagccttcctgaacggagagctagaggaggaggtgtacgtcgcccagccactaggcttcatcgacgacaagcacccacatcaagtcctgcgcctaaacagagcactttatggtctgcgtcaagctcctcgtgcctggaacgcgaagctggatgttagtcttcatgaactcgggttcacacggggcatcacagaacatgctgtgtacacgcgcgggaccgggaacgcgcggctaattatcggcatatacgtcgacgatctcatcatcaccggcgctcactctaaaacaattcagagtttcaaggaggagatgcactccctattccggatgagtgatcttggattactcagctactacctcggcatcgaggttcatcaaggcaacgatgggatcacaataaaccaatccacttatgcgcagaagcttttgaagatgggtggcctggcggcttcagcttccgttccaatggaacccagattgaaactgacgaagaacagcgatcgaccaagtgttgattcaaccttttatcgcggcttagtggggagtttgcggtacctggtgcattcacggccagacattgctttcgcggtgggttacgtcagccgattcatggagtcaccgcgcaatgatcatctcacggcggtgaagcacattctgcgctatgttgcaggtactatgaactatggttgcaaatttgtaaattcaggagaagagggaatccatttgctaggattttctgacagtgatttggggggagatgcgcacgatcggaagagtacctgtggtgctctcttcttcctcggctcaagcccgattgtatggcagtcccagaagcagaaagtggtcgctctttcctccagtaaagctgaatatatcgccgccactggagcagcgtgtctcggcatatggctggctcgattgctagctgaggtgctgggaagtgatccagggaaggctctcctcaaggtcgacaacaagtcggcgatctccctgtgcaagaatccggttttccatgaccggagtaaacacatcgatacaaggtaccactttatcaggcaatgcattgaggagaaaaagttgaggtggagttcgttccttcggacgaataggttgccgacattctcacgaagccactcggacgaatcaagtttcaagagtttcgcagtcaggcgggcgtcgtgcatattgtcacccggcgacaggattagggggagtttgttagcttcagctataatcctgtgccgtattatcggttactgtaacgcgtctagtgttgctgtttcttcagtttcgttagactctgtttcggcgtctgtttctctgtttctttttcctgtaagccgagtcttccgggtcgtgtgtcgtgtgcgagtcatccggatttcagcatcgtggtcgcatcgtcgtggatgatggcgtagtggtgtcagtttgagtctgtacatatttgctatatatatgagcatcagaaaacgtcgctggtttgttcgcgacaccaaaaactctattcgtgttcatcgtctttccaattcagagaattcgcgtgagagagagatagtgaggattcacaatcttgggctttgctatcaatttcgacgaagaagcagaaaagaagcatgtgcaacgaggggccacgaccacgacacaagatggaaaaatggatcaagctcatcaggaatgtttaacttttggtattgaagagagaaactgatggagcagaagaagaagaagaagaagaagaagaagaagggatcagtgaggagattggaagagacgttgctgcttaatttcatgcagcaggagaaacgttccttcattgcagaccaaacagaaacgagtcgccgtgtccctgccgtggcgaggatggcggcatgggctggcctggaaccagggacaggtagcgtgtgctgctgggtgcaaagaagagaaagagagatcgatagagagagagagatacagaaaaattgaacttggaggcatcgggaacaacaagaaaagcaaaaagaaaagaaaataataaaaagagaggaaaaaggtaaggagaaatgaggaacaagaaggataatagggttctcaatctagaaaaattcctcaagaatcccaatcctgtaaattatttggatttgttcaggagttttttggatagagaataattcacataattgagctccacttccaaacttaaataaaaatcaaataactccaattaatgaacgataaaataaaatgtataattagtttatttagtcaaattaaacactttttaattttcagaattttcattaagccatttcagacgaataaacacgaatgtgaatttttgaaattaggcaaattaagaaatacgaaaaatgggacgtaacacggcagcttccactcaggatgggaatggttaagtttggcccatttaaccactgaacctatccacaaatatgttttattgggcctttaggttgattcaaaactctaaatggggcaaatggtttgaacccttgaaacctaggaaacatcggattgatccagaccaccatcaacatcttgttctcgaggacctcgggtcctccttggcatggcggcagcgctccagcaccgtcttgttctcaagtcctcatcctccttggcgtggcggtgacgctccggcgacaagtaggtagtgctagtcctcaagagcgatggggaagaaagggaagtgggagagagaggaggaagaagagttgatcgttgacatgtgggatccatatgggtctcactcgtcacgctagcttgaattagacactataatgtcttgggacctcgagtataccggttttgcaagataaaaatgcattatatatggtactgcggtcgaaggacgtaattcaaacttggcgtcaagataaaggaccacaagtgaacttagtccactcagtaaataagcatgcatagcatacgctgggccaaaccggggcaaccatccatctgatcagtaagcatgcaatattggctactgggccgggcccaaaaaactcatcctattaattagtagtaatatatttcgatcaattttgctatatatttgtcgacaaattttctcctaaaaatttgacagatgtaattacagtacaatcacagtgtaattacactgtaacttgcatgtaattacactgtaactatagtgtaacttgtatgtaactttcaaaaatctctctgtaatatgttatttcggtaaaatagaggttgtgggaacaaatccttacacatatatatgcgctgtgatttttttcttcctcaccaaaacaaatcttgtaatagatttaactgttcaaaattacatgaaacttatatacaagtaacattgtagttacatgcaagctacaatgtaaatacatataagttacagtgtaattacactacgattgtaatataattacatttgttaaatttttaggagaaaatttgtcgacaaatgttactaagaaaatctgactaaagtgctccactaataataaaaaaataataaaatttattggtagttaggtaagtggtgttgaaaacgggagtacaagtttt

SEQ ID NO: 9681 - DNA, 434 bp, Oryza sativa
gaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactcttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaatgatggttatattgccc

SEQ ID NO: 9682 - DNA, 12607 bp, Oryza sativa
  unsure (1)..(12607): unsure at all n locations
gcctcataaccccatttacagcctcttgtaactgatgagtcatatgttggatcatgttggagagttcacccctgttccaaggatgcgtgctaactgcctcgtggagtgttgaagtgccatccatcctcatcctttttctgccaactgaattaccaggtgcatttggtgcaccctcaccggcactgcaaaagaatgtgatcgtggttcggcaattagcaaagtcagcgatataacacgatcttaagcagataaacgcagacggttaactcagcggaattaagagctactccctccgtttcataatgtaagtcattttaccatttcccacattcatattgatgttaatgaatctagatctagattcattaacatcaatatgaatatagtaaatgctagaatgacttatattgtggaacggaggaagtacgtgccttatgtggctacgtaaacattctattgaagattacagagcttcaattctccgtttttatatttgacttttattaccatgatctacatcataatggctgacgcgctaaaacgcatctacatatgcgataacttaaaaagatgttccttatatagaaataaaatttttaaagcgggttacatcatcctcaaattactcttatcgcaccctttttttattagtagtggtcatagtaaaattttaatgcattagttgactattaatccataccaaagggcaaatggacttattatagttactaggaatgtagcctgtgtatacgcacggacatgttgtttaatgttgttagaatttttattacgaatatttatgtgtggatgatatttttgaaatatttatttaatctattttaaacgtgtatttgttaataactggtttggtcgtattactactagaaactgtatatccttaaatttcttagaaacaaacgtgtcacaataatggagttggttcgtagctatttgtattatgtgtgattctatttttaaaatttttcgagtttccgaacttatataacattttttattttgtatgccatagattactttaagtagcattttaattttattatatatttctaaaatatattttctattaaaaatatacttcatccattttatattataagactttctagcattgcccacatttatataaatgttaatgaatctagacacctatcaatctagacacataggtgtctagattcattaacatctatatcaatgtgggcaatagctaatgatactacttcatctagccaaagatgatttatattacttatacttcctctgtcacataaatcggaggagttaaattttattctaaaacaatagaataatttatatgtaactgagacaaagtaattttttaaaatactagcacgataatctccaaagtaccgtattatatttttgacagatatctatagtgtaatgcacgttagttcagtgtctggtttcttttcaacacctattctttctaacgacatgagacacctttagtaatttggagaatacgtatgtacatttaaattagcattgtatattcatcaagtttttttacacctaagatatgatgtgaaattattatcatagcgttaattattacttgtcggttccatatgttttgatgtattttgggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaactagttgggcagcccgcgcaattgcgcggctagcatcaatttaaaatcatatatttttacatataattttatttaaaattttattcccttgattctaataattttatattttctttaaaagccatgctagtcgctaccccttactcttttgacactttttttttgcttactcgatctacctctgtttctattcatcctctttagaactttataaattaggccttatagtttttagagtttattgtcttgttgggtttcgttttcataatttttagaagtatctttaaacatcaccaatttactactctacggccgtccactaccacctctctttattgtcatttggattttaaaattagaatataattattgtttgtattccttttttactttntataagtctcatcaaatcgttagtggcttcgccactatactcatctacagcccgcctggtgcctgccctccttattgttgtagagattttaaaaatccttaattattacttgtcggttccatatgttttgatgtatttagggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaattctatttttaggactcccaatctttttggctttattataagtatgttttctattgttccggcaaatgatacgtaatcatcattgttctttaaatcatatgtacgtatggagtactttttctggttaataagctatatgtttctcatgtatccgtatatacgataatttttttatttttaaataataaatctaatataatggtgtaaaataaaaaaactaaattgtgttgttttcatttctacatatgtatatttaaattagcgttgcatatttatatttgtgatatttgagaccctaaaatatgatatgaaataaaattagcatcacattagaaatagatatgcatatttatttgcgaggagtagcggtgggctcctgctcgtgtgccatttttgagcctggcagacgccacgtcacctgatctaaggggcaaaatgactatcttgtccttcttcttaattcatttctcctccccttcctcagtcccttttacatctttccttttccttgccagtgagctgttaggctccggcgagctccccgccttgtgctcctcccttcctcacgcgactccctacatccccagcccctcctctattcctactgccaacgtcatcaaggatcagcgggcatggctgtccggcaatgtgatgcattgctggtgcctcactccatcatcgatgtcatcgttgtcctctgagcacagagcgtcgtcctcctctcggatcttctccactctcccccgacgtcgacggctgcgtcagacccagccttagggcttcccctgcctcattgttcgctgcccgatgcaggaggtgagggtgcacattgggtggtagaagagccaggggccgttcgtctcctccatagccattcggcagcgggacgctcgaggtcctcttcacgtcgtcctggccttggcttgatggtttggcattggtggtgatggcatcaccagctcatgcgcaggaagaaggttgaaggagagagaccccaagctggaggaagaagaaaggcaaaatggtcattttgccctcatatctggtgacgtagcgcctcaccagctcaaaaatggccaatgagaaagaaatcatctctctccaatggtaaaaaaagcaaagttctttggaagagtggcatttgagaacacgccatccgggaaagtggcaaatagtccaaaatcccttggaccgcagcattgctgggccgcgcgcgcttcatgggctatgtgcgtgaataccctagcaagccggcgggggtccgacaaggccttttttttcctttcgatttttcttttctttttttagaactttctttctttatttcagaatatattttcttaaagggctcatatcatgaaaaactaaaccctaatcagataatatttttatcttggatataatttttgtttacccgttccaacgcatgggcattttttctagtctaattttgaatttaattttgttttaattctaaatttaaatctgtcgacgagtgatactcgtagaccggataagtagagtattggggtacattggaacgagggtctatgtagtacgacatcaagcagacaaaagacaaagattatactggttcagggcccttatcaggtaatagccctagtccagtttatatggaattgatgatgatgagaacacattacaaagagagtagtcgaaacagatggtaccgacgagatcgtagtcgagagattcgacgagatctcccactgagttggctccgtgtactccggcttcataaacttcgggaggtgtgttgaagatgagatacgattccctgaacccctcccaggggtcccttttataccgtggatcatcttgccccccaagaaaagcttgaggatatcggacctggtacagtataacagaaactctatcctttccgagtaggattttggaaatcacttgacccgtagagatattttctataatttgaagtagtttccatgtgacatttacaggaacaatccatatacgcgaaggtatacctaatcgatatatctcgtaagtcgtaggacatgaggtatgccttatctgtaaccctaacaaattcaatcccgagttgggctttagaaggactgttttttttcaactttcgttatttctattccaaatttaagttatttataaattgtatttctacttaattttttttctaatttaggaatttattttattgtttattttgaattttaattaaactcgtgttgtgttcgattattatttcaataatattcttttatttcgaattttagtcatttcaaaattgtattcctactcaaactcttttttttttccttttcaaatcccagaaaaaatattttggattttaattaatcacatattatgttcttatatggactcttttttcagtattgcttatttttaattcttaattcagttatttattagattgtattcttacattgactaaattttagttatttaaaaattgtattcctcttaaactctcatttcttttcctaatataagaatttattttattttttattttaaattttaattaaactcgtgttgggttctagattgattgttttttttcactattttctatttcgaattttagttatttcaaaattatattcctactaaaactctcttttttatttttcttttcataattttctaatttttattccgaattttaattaataaagtattaatgcattattataaggactcttattccaatattgcttatgtttaattccgaattttaattattatttttaatactgtattcctacttgaacaaaatcttagtcatttataaattgtattcgtacaaaaactcgcttttttatttttctgatttaggatttttttttattttttattttgaattttagttatttcaaaatttattcctacttgaactttcttctttctttttctaatttcagaattttttctgaaatttaatttatggattcttatatggattcttcttccaatattacttatttttaatttcgaatttcaattgttttttgattgtatttctatttgtactattcttttctttttcatagccaacatgggaatttctagccttcatagctatcgtgttgtctttttttatatatatagatagatagatagatatgggaatttctagaaatctaaaggcagtatggtgtctctttttagctatcattcacagattggtagtatacctggaagggtctggtggcggaccaattgcttcacgtttcttcttacaattgtcactcttcagatggttgtgtaaaactgacgtccctttgtcggaaccgcacttgaccaccgtgtgacagtggatacatctggccttcaccgcctttccgttttccttttccgtgatatcgaagtcctcccaagccttggatcgttttttgccaccactgctactcgctatgccagcgttgcaactcggtctcgctgcttgctctactccatgttcatccgcgcatgaatctgaaccaagattaaaacgtgcaacggaaattggaatcaagtgtactacctcttttcaggttacaagactttctagcattgtccacatctatctattctatctattatattattaaaatagctctaaaagaagacaccacgttcgctgtgggggctagaaatttccacattaatcgaagaaaaagagaaactattttgatcgttagattatagctgtttagatttttcaatggtgcagattaacacatgaaaaatattggagtccaactagaaaacgactacagaaaattgggaccgacctatattctatatagagtgatggcaagttaattaaacctttatgattaggattaggagtcggacatatttgcatggagatcctgtaatcaaatacagagtacaaatctaaccagtgtaggacacgttaactcaaggtagaaataaaaaaaaatcaaataaccaatacagttggaataaaacaatgtaagaatatcattatgcatgagcaaatggaccaggaacgtaacattaggcgtgcaagtaggaatacattttaaaaataactaaaattcggaataaacaataagtaatattgaaagaagattacatataagaatccaatacgatattaattaaaatttagaataaaaataaaataaaacccaaaattagaaaaataaaggacataagagtttaagtaggaatacaaattaaaaataattgaaattcgaaactaaaaataagcaatattaaatgaagagtccatataagaacctaatacaatattaattagaattcagaataaaatataaaataaaaataacataagtttaattaaaatttgaaataaaaatcaaattaaattctgaaaatataaaaataattataggagttcaagtataaatataatttataaataatataatatcggaataaaaaatatgaaattttcaataaacaccatccatctataaaacgcaacaatgacgaataacaataaagagggaagaagcaacaaagtcgtaaaggaattaagtgacagcagttgatgggacatctaaaaactataaacaaaacccaaatagaatcccaatggcgatcaaaaggagggacgacggataggccgttagtagtacgatcacggtggttggctggatttctagaaagtaaaaaaataaacctcaatgatattaaagagggaagacaacaagggttaaaacaataaacaaaacccccaatagaatcccaatgacgggtaacctgttaagcagcacaaacacgatggttagcaggaaagtaaaaaaataaaccataatgagaatcatgttcgaattttaaaatcacaatgacaattaaaagggaagacatcgggcgggccatataggagtataatggctaagctgctgacggtttggtgggacttctacaaagttaaaagtgaacaccgacgatcattatatttgaattttaaaacccaaatgacgataaagagagaaggagacggacgggcataagtggagtagagtggcggcgtttgatgggacttctaaaaattataaaaatgaaagccaatgagttgattaagtctaaaatttataaggttctattttaaagttcaaaggaggacgaatagatgccgtagtagatcgaacaagcaaataaatgggtgaaaaagagcaagaggtagcggcaagtgtgactttaaaaaactataaaattagaaaaatagagatgataaggttagtcttttaaagtcctaatatacaaggaagctatttaacaaattttaagtaaactcatatgtaaataattttgtatggatactatccgcgcaattgcgtaggccaccttgctagttcatatagatggatgttaaagattctaggcatatgggtaatataaaaaattcttataatatgaaacagagaaagtacgtacgacgtcctgcgttacgaagaagggaagaacaatgtattttttatgtacacgctttacctccttggagctgatgctggagcctgtagtattcgagctcgtcgaccgcgtcgtcggcgtcgtacagcacctcccttagacgaccgagtgatcgggccagcggtttgttcgcgatcgccctccccttgacagcaccgaccaccacctccaccctctcgacctcagaccggagcttttcggtgtcatcggcgagcccgacctggctaatccacgcgccaaacttgtcgttgtccaggttctccactatggtatccgccagccatccaatcgaggactccagcaaattaccttctatctcctccatccgcaaatgagaagttattagtaactcttaaccgatggtctatggttataagcaaaatacgcgaatgatatttgggaacgggagcaccggagcagccgagaagagaagaacaaacaacgacaacaaagtacaattacagccggggggactcaccgcagcccgcatataaaagcagtacagaagtcagaactcagaagtccgacatggttttggaccgagtgagagacgatgactttgctctccccatattcaaaaggataaacctcgagcaagcctttcaaaccgcacgcattttagatttcgcgtcgtcagatttgcatatgttatcattacgcatacgactgcagcaatttgactgaggatataaacattgtaatgaatgaacttttagagttgaaataatccctccccgacacggctgactcagaagctctgcagtacgcaaataaaacaatttggagaaccgcacgctgaaagcggaagatggattctaatccctcaggccttgttcggttgctagggattaaatcctaaggggaagcaaaccagggagggattgagtgaatccccccaatttcactcaaaccctgtggggactaaatcccttgtttcttccaatccctctcttagaaactctgtgttcgttttgacagggactatagcagctattggcagggaatataggagcgtattgctagctctctttatgatctggacttgtattactactattagtacatttggttaccactatttacctaaaaccagtagtgctagtaccctgtgacggcagcgtaggagcaagatcaaaagtaccattagtccatttcagagaaaactagaaaacaatatacacgcatgttacaacttcctggatcaagaaagttgatgccaatgtagtgccagccaaaattacaggaaatgcttgtaatattccaattatatgatataataaaaagattgttctgattccatttaactgcttgaaaggttgttaaagatggctgaatgaactgcattcaggcattgttgaagatctgacatgtcacaatgtcaacaattacacctgatcaagaaataagctattttcagttggaggcatagtgttattatccaaaattaatcattcattcgatggttaattagtggccactggtttctttagcacacacatcagtagacactgatactgagcaagttgaatccatctgtggcgacttcgatgattgattagtctaaatgcacaacaaaatccaaacttctcccaacatccctaaaatgacacatcagtaatacccttcattggatagttaattagtctataaatgacaccatcacgaaactgctaccatcaaagaaattctatggaacatccctaccagtcaatttcaaggagtctgcaaggaaaatcagtgagtagacatcagtttacctatcacagaaatagagaagaaaacaaaactactaccatccaattattctttttccttctactagacataacgcaatgaacattataatgcacaaagtttcagaatcaattgtatagtagatgtgaatcttgagttgcctgaattttaagaagatatagaaatcatgtatagtggatagacagatatatttccgagttgagctcgcttccgtgtggaccgtgtaaaaaaatggcataacagtgaacccaaatccatcaccaattcacaatcggctcaaatctgatttgaggagctgggcatagccgcaaccagcagttgggttcttcatacgcaatcgacaagcagcaccatgttcaaggccttgttcttgatggtggatgaggaggagcccttgcagttggagacggagataaaccaagaaacaaggaccaagaaccaaaccctaggtaggataggaagaagagaggagaaggaagagagactcaaaagtgagaaggtggccagcggaggagacggtcgccggaggggagagcgccgcgtcgtcggagcgccgtcgaatcccagtcacgtccgtgtcaaggagcaaccactgtccgagggcgctaagtcagttgcagaagacgctggagatgatgctgattccggaaggagggaagatgaacttgaagcagctgaaggagaagtggtgcgccgtgcaacaaggcccgtcaagataaacctgaagtactatgggcctgactgggccgtgtaattaagtctaattcctgtaatagttcttcgtgcgagaggggaaagaactgagtaggtgaggaagataagagagagagaacacgaggtgaactctgtctttggcgaccatggtggcgtaggcggcggtggctccattcctgtcggaatcggagaaatatctcagtaatagagttgccaattccttcgtgttctaatccgtgcgttcattctggattgcttttcctgtgcaagttcgttaacaattggtatcagagcctctacgctccaagaattccttggcgcggttgtaaaattccagggggaggattggaattgttcttagaacagattccacaataaggcaacttgccttctcttggttaactgagttcgggaaggagcgggggattctagatctagttgggttcgctcacaaattccaggatgtcgcaggagagtaaacttgatgtcttgttgagaactattgaggagaatgagaagaagagaatggaggcggaggcgaggactcgggatgatctcgctgatctgaagaagatggtggagatttgtcttcccaagatggaggagaaggtggaaaaactcagcgagtccgtgcagacactaagccacaaggtggagctgatggaaggtggcgcgatcaaacaagaaaccgctgcagatgcttcagcacaaggaactccatggttgcatggtaagcggaatcctcctcccatctcacctagtccattttctccggattctactgtgcaatcaccaacttcttctagcatcacaccgatctgagtactagtcttcctcctatgacttgccctaagtttgatggtgagaacccacagatgtggaagagcaattgtgagcaatactttgatatctatggtattaatcctatgcattgggtcaaggtggccacactcaatttcagtggtaatgcagcattttggcttcagtcgatccgttctcaaattatgggtattacttggcaaactctgtgtgacttgatctgtgctagattcactagagatatacaggaagcactaattagaaaatggttccatgcgcaacagaacagcacagtcactgaatatgttgaacaatttgacagtatcatgcaccagctaatggcatatgacagtgctctcacccctgtgtattttgttactaagttcattgaagggctcagggatgatgtcaggggtgcagttatgctacagagaccccaggaccttgactcagcttgttcaattgccttgctccaagaagaaatcctggaaagtaataagtctactacacacagaaggtctgataatcacattgcgttcaggccagtaccaaaactcaacaattatgtgccagtgcctccaggacagagatctgtagctgttagtgcacatgatgacaaaaagggagtggaatctgctaagtccagagaggacaaatttgcttctcttaagtcttacagaagggctaagggtctttgttttgtctgtggtgaaagatgggggagagaccataaatgtgctacttctgtccagctccatgttgtccaagaattattggaagcaatgcgctctgagtgtaattctgatgacatcctgacagctaaagaccctattgaatcagtagaggcaattgatggaggattgatggctatatctcagcaagctttgtgggggtacagaatcatccaaatctattagattaaggggatgggttcaaggaacagagattcttatgttgattgactcaggcagtacacactccttcatagatgagagcattggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgcaggaa

SEQ ID NO: 9683 - DNA, 727 bp, Oryza sativa
  unsure (1)..(727): unsure at all n locations
gatcagttgcntgagtccttccaacgaaatatatctcagatttcggcattgtgatatatgcaaagtagttacaaacctactaaggttgtggtagggcaacactgttttatccatcgctgtcagcttatcagaaaatgagttactcctaatataaaatattccttcgtttgacctcatcgttggaagtgttgaaattccattgatgaagaactctgaaacagtagttgaagggggaaaaggatgaggcacagtgaaatcaggacaatcatcgatggtgaggttgctgaggtggggcaaccatgagcaccccaagttacggcagttctcaaacaacggaaagaccttcagaaccgggcaccttttaatcttcaggatccttaaactggagttgaagtccaccatggaagtgcaagagcacgtatgcaagttttgcattccaattaaaataatatcctgcggtgaacggattgagagcaccgatgcattcttcatctcgatcaacacaagctttctaagcaatgatagcccttctaaagaaagtgtatgcattctgcacaattttctagacgaagtgtttgcagataggtaagtgaagtggaaagccaagttggggctttagttccattgtaccaagatatccgtagatacttgaggttgtgatggggttcaacaccttcaagctcctcacttgctatgtctagaatatgatcgggctgcaggaattaga

SEQ ID NO: 9684 - DNA, 2337 bp, Oryza sativa
ttcctgcagcccaacttgagtcttttgcatactttcctgtagccatggtgctacgaaatattgtaagcatctcaccatagtacgcaagagtttgttaaaataatcagcatcagccttgtgatcattcagtgaaacaaaatttttgtttaagtaattgcaataaaaatatgaatggaataaaccactaggtcaagagtcaagacatttacctcaatatagccattgtagtgctcatcatcaagagtaatgatgaaaattttctcatcccaaccagcagcactcactttcctaagcctatttatctttgtaaactttctttgccatgtcttcaaatgattcttaatttgctcacccgtgagagtactgttgaacctttcattcatagccctagcacatgtgttgagatgcactgccttgaagtcagatgaggtccttgtgccaccggccacaagattagcaaggagtttcagcatgaaagatgacatagctgaggtccatgaagcatgggtgcttcctcctttgccactagtgttgtccatgtcctaccttctgtcaaatgaaccagaaattgatcattcagcaatatagtaaacagaaattgtccattaagcagcatattaacccagaaattaaacattcagcaatatgttaacccataaattcaccatttagcaaatactttgaacccagaaattcagtatatagcaatacatcaacccagaaattcaccattcagcaatacatcaacccataaattcagcattcatcaaaccataaattcagcatacaacaataaatttatccgtacaaatgaaatttagcaaatggagtacaacaagctgtccatacaaatgaaatacataaaaatgttcattgaatactaatgaaatatagtaaataaggtagaaatacaagtagcccagctacatattacattccatgatggctattacggtcagcccacatctgattagctaagccctgcctgaattgaaccatcaatgcatggtcattcgcttggccggttgattcatcaatgtcctcacttgaccaatcagacgaagctataagctcatcaattccgtcatttacgacccagttatgaataatacaacaagctacaacaatatctacttgagttcgaaatgggaagaatggagtggcatcatcaagcactttgaagcactttgaacctcctctttagtgacccaaatgcacgttcaaccatcacacggagggatgagtgtctaaggttgaacaactccttctcattttgtaccggattattcccccattcattcaggtggtaccggacagcacgaaaaggaggcaagaatccttgtttggctccatatccagcatcaactagatagtatttgcctattatatgatggacaagttggtcacattcctaaatatcaacatttgtcatggataatttgataaactatagtaatctattaccttgtgggacacggaggccattttcacgttccaaagcatctcttaaaactacagcatgatgtgctgtcccctcccaaccagccaagacataagtaaaccgaagatcaaaatctacggctgccattacattttgagtggcatgggacttcctaccacgaaaagaagactccacgttcttacgaaccgagactctaatatgtgtgccatcaaatagctccaatacaatcctattttgtgttcaacaacattaaaaattagggaccatatatcaatgttcacataaagataaatttagatagggatgaatctcagaccttaaagtaaggatctcttctagggtttcctgctattttagttggagtgtccaatgaggggggcctgattagttcatctcgtacctcaccgattgcatgaaggactttgttgaaataacggctaactgtttctccagacctatgaaaactagtgcgaactaatctatttctaaggttatgtcccactgtatgcaaaaacatagccacttgttcctcaatacacatgtggatggcatcttcaagtaaaccacgatccctaaaaagcttacagaaacgaaagaaacttgcccttctaagtctaaacatgttgatacaagttgtatcgttccaccaaatttttgtttctaggtagtcaattcttttcctatccctttcaaccaatgggccatatctaataccttatctccttgaacatctctttctttttctagacctaataatcatggccatcatcgacaacaataaatttgtagcagcaatacaaactaaaaccttggtcctcttgtccatctacaatacaacaaccaaaaaaacacatggccatcatctactgtcaaga

SEQ ID NO: 9685 - DNA, 9027 bp, Oryza sativa
ctttttaccgtggtgaatgggaaccccgatgtgcagttggaggctacgaacggccctactcgtgcgccgcgtcgcccttcctcgagagccgccgcgccactgctcgcgcgccggctcgagcgtcgccagctcgaactcctgctagcgccgccgccgcctcgcctctgcgtgtgccgctgccgccttgcccctgctcgctgaccctttgctcgcgcaccgcctcgagctcccgctagcgccgctgccgctcgcccccgcgcgcgccgtcgccgccttgcccctacgcgctgacgagagaccccgggcgtgccgcgccgcctcgcccctgcatgcgcaccggctggccccagcccacgctcgcgccgccgccacccgtgtgttgctaaccctaggaaggaagcgataagaacgggaagagataagaacgaaggggaaaaaagaggtgaagcgaaactttcggtcttaccgcgcgtgagtcgcgagtcacgggcatggggtgggatcgttttgtccgccagtttatgccagatggggttgtcccgaatattgaaggaatattcccttttggaaccatcctatccctccttgtccttcaactaaacagacctaaaaatgggacgatcccatcccatcccgggatatcctcccaaccaaacacatgcttagtgtcagctctcgtaccggtctcatcatggctcggcacagaagtggtctggtgcggcgccggacttggtaaagtaaacagcgacgtgttgccgcctgagtggagtggagcagccgcgccgtgcgtctgctgggccagtgtctgtgctgtctgccgtgtcgcgttaggctccgatccagaagcgatttctcctgcgccatgcgcttcaaacgccggtgttggtgatgctaggtccacaccttcatctgtacccgaatcatctgaattgctaccagaaaattcattagcagtattaggaaaatcaagaacatgatcactctgttgctcgcccccttgatcatgcgctacaaggtcagatggaagcaaagctatttctgctcttaggcgggcgcctgcatttgattttaattgagaaaatgggaagaccatttcaacaaagatcacgtcctgcgaaacataaactctcccagaaagcaacatcaaggcacttaaaccatttatgaagctggctgtaaccaaggaacacacattgcttggaccgcaattggagtttgtgattgttgtaggggcgcaaatgcagccagcaggcacacccaaaggttctaagagcagaataatcaggtttttgatggaacaggcgttcaaggggtgtttcaaaggaaataaccttgctaggaactcggttaataatatatgcggctgctaaaacggattcatcccaatattttagtggcatagatgcatgagctagaagagatagacctacttctactatatgacggtgtttacgttctactgccctgttctgctggtgagtatgcagacaggatacatgatgagagatgcctatttgccgaaagaaagaatggagtttctcacattctccaccccaatcggtttgcatagtgataattttccggccaaacattctctgaacaagagcttggaattcatggaagacctgaaaaaatctgattttgctttaagaaggtaaacccaggtaaacttactataatcatccacaaaactcacataatatttatgtctaccaacagaaataggagcaggtccgtagacatctgaggaaatgagttccaaaggaaattgagaaacactagtagatctattgtaaggaagttgatgactcttggccatctgacacacatcacacacagactctttactagccttgtcatgacaaggtagattatttgtgctaataactttagacgctataggacttgaaggatgacctagccgactatgccatcttgcaaaagatggcgccacaccgtaaacagcctttggagaggatgcaggagatgaaggaggaagcgggtagagtcccttgtatcgccgtccctcaagcattgttgccctcgtagcctgatccttgaccaaaaaatgttttccatgaagttcaacaaatatagcattatcggaggcaagttttgatgcataaactaaatttttggtggcatgtggaacatgtaaaacatttttgaggataagattgcgcataggggtttgcaatatagagcgaccaatgtgctcgattttcatacctgctccattggcagtgtgcacttgatcgttcgccttgtacttgtcgctaaccgtgagcttgtccagttcaccggtgatgtggtccgtggcgcctgagaccatgtaccgattggagtcgactccatttgtggagctgcatctgaaattgcaagtcacatctgcttcctttgcccctttgcccagcaattctggacgacgatcggcattgacccgcttattcaggatgttcgtcaactcggacgtctgcgccccaatggaaacctgcccgagctgcaccaccatgtcttctatcttctctgcttatgggcactatggaaccacagacacgacgttgttttccgcaacctggatgcttcagttccggcagcaattaggaaatgtgtggacgaatgttctctctggtctgaacgtcttaagcctcctgatagagttgtagtttcaatttggaaagggatcttctcctcccccttgcaatctcttcatgtcatgtaaactcagttgtaacccttactctatttatttaatgcaattcaggtggggaacctctcccctccggtgacttatctaaaaaaaataggcgtaggaggctgctgcagcaaggtgtcgctcatctggcacataagaatcatcatacctatgccagcaatctgctgcaacatgtccccgcttgtagcacaccagacacacgggtcgtgtgtcgttgccggagcgctgctgctgtccagcgccacgtcctccacagccggcgtttgtgccagcaccattgaagccgccgcgaccaccacgtccacggccggcaccaccccggttgctcggagcgttgccacggccgcgcccggctacattggccgtcatgttgccttctcgtcgtagattaagcctgttctcaaagttcaatagctgggcatatgtttctgatagagtaataggtttagttttggccgctaaagccgatacaacagaatcataatcatcatctaaaccatttaagataaaagcagtgagttcttcggcatcgacttgcttccctgacatcgctagttcatctgctaaggccttcatcttggcgaagtactctgagatggtctgggttcccttcctagtgctggtgagagatagcagcacgttgagggagcgcgcgcgagtcgccctggagttgaacatctcctggatcatcttccaggcatctgtcgctgtggtcgccgtggcaacctgggataatatattccgtgacagcgatgaaaagaggaagccgagaacctgttgatccgcggcaaaccactctttcgtacgctgggttgtcgatcatgatcttgatcttcgtcttgtcatcttctttcttttctgcttcgatgtgggcggcgggagtgacggtcttgcctttcagatgccccttgaggcgtgccccacgaatcgcagtcagcacttgtgcgcaccacagctgataattttgcttgctcaacttctcagaaacattgaagcagaacaaggaatttgtggaggtggaagaggaggagctagccatggtagatgggatctaacttcagcgctctgataccatgtgggaaaacaggatggatgggaacgtcgtcctttgcactcgggtcgacgatgcgtgttaacctatcgcacaaaacggcgatggagaagatacaaataggcatgcgctatggatagaacggccggatccttattacatgtgatcacaacaacctaagctaatctatagcttaatccaccggccatcctaatccaaagcacacggattacacagagatatactttaacaaaatcgagttgaagaaaagacagaaaatcaaatataaactcacagaatcgaagacaaatagtatctgatccagccaaggtggaaaatcgctctgcttctttcaagtgaggttgatgctggccgggagcggctgcgttgatccgcgtcacctgcgcccaatccatgccgggatggaggaagagagagcagagcgaggagaggaggacagggacctaccagggagctagccagcccatgcaagctcgatctgcgcggccacggacctggccggtccacgctggcgcgaatccgcaccatggattctaccggcggcaagctcttcgactccaggctccagggtccaacccccgcaagcgagaattttcagaatataacacccaatacgcactgctttcaggatttgtcacctaattcgcactactttcaaaatacaacactagagtgcaaattttctttgttccgtgctattccatcccctaccgtcagtcgcgccgtcgttctccatcctcccgacgtcgccgtcatcagtcagccaccgctcgcgcccgtgttagccgcgccgccgcccgcgtcagcccctccgtcgcccgcgtcagccccaccgccgcccgtcggcgtcgagctccggcgactgagctctataccagctcgaggccgcggtggcggaggttggactggcgacggcggctgagctcggggatgacacgagcgaaccgagccgccgtcgctccggtggtcgagctccggcggctgacctcctccaagccaccgtcgacggcgtcctccgcatccccatcgagtcgccctccgccgtcgcggcggctgcccgcggcgacgagcccaccgcgaagcggcgccgcaagctacagccgacgcgcgcggctgtcggcggcccggtggaggcgctggccacggctcctccccccgcgctacccccatcgtcgccgaccccctcctccaagccaacagtggcggctcgatctcaatatccggcacggcggcaagcaggcgatgtcaccggcgaccgtgtggatggtcccgcccagcagcgcaggcgctggtgtggggaggacaagctcgccggcgtgggggaggacgagctcgccggcggtgagggcaaacggggcgagaggaatgaactgacgacgcgcggttttgggatgacagagtgtcacggaacgaagaaaattcacactctagtggtgtattctgaaagtagtgtgaattgagtgacaaatattgaaagcagtgtgtattgagtgttatattctgaaaattctccccgcaagcagatgatgaggtccctggagaactcgttcgctcgtcggtggaagtgggaaagaaaggggaaaaactaatgaggagagagagggaacaattaagtggaaaataatgcagacaatgtagagaggctgagaaatgggccaacaaagttgcatttgcaattatattatttttatctaaggttactaaaatataataattactattttgagaaaaataataattgagaaaatataaggactaaaatattatagggttaattggatcataccactgcaactttggcaaattaaaatttccagtggcatacagcagatatgacgaatagtagttgcatttttttttcttaatttggcaaagttgtagtggcatggatccaattaacccagtataataagagcatggctaaaatacaaagaaatcctcctcattaaattataaaataaagtttaactaaaataaaaaataattatataaaaatattttaattggtgtgtttttgtccgtgttttcgtccgtcatcgcactaatttttcatctatccgtacgagtgcattcgatttccgatttgcgggaaaggccgctttcatccctcagtgcaccttagaaaaatcactaaatcatcagaatcggatacatggaaacacttcccaaaatcagcgcaacaaaatcggatgcacacaccacaaggaaaaaacaaaattcccacagctaggttgttccaaaatttcaaattcccaattcgaaattgaaattctaactaaaaggagaacttgtgaattcaaatcagactctaatccacccaaatagaatcagaaaagagatccacaggagaactctaatccaatgcatattcgatttggactcgaacagataaaaccaaccccataaatacttccacgggattgctacaaaaatcaatcggatctaacctgattttgcggaggtgactttgacttgcagttgtgagctccaagcgggagtgcacggcttcggcggacggtggaagctcagcgctttagtgaggaggcaaccgggctccgatttggcagggatgtcgaggaagcaggcggcggtgacagcttcaggaggcagagggattatgctcggaagtcggccactagaagccttgaacttagcagccggatcggctgcccactgcctcaccgccgctggcatgcttcccaacgccggatccaccacccaccatgctcgccactaccctcgaacctcccccaccgccccctagcctcgccgtcacccacgcgcctcccaacaccggatccatcgcccaccagcgtcgtcgccgcccgcgcgccttggccgtcttagctgctgcggagccgtcaccgctatggccgccttggccatcgccgccacggccgctgtcgctgtggctgccttggccattattgccgcggccaccgtcgctatggctgagagggagtagggagcaaagagaggaaacgaaggacaggaaaggagatcgatctgtgccagccgccacgaggggggagggattggcaccggcccactgcgcaagggagtcggagaggcgccgacgcaagcagaacatacttaggtgcttcgatgaatcatcgaggtcaaactttataaacctagccattatcttgtgcaacgcacggacattttgctagtttacacagatgacccctgctgcccaagtggagagcggcaaggtgtgcgtattttgcactgatatcccttaccaccctctacaagagctgcatgggggtaaatgtaatttttaccctgccaaaaatgcatttttcttttttttttcaacttgtccgtccctcacgtctctcaacttctgtaaatatttttaccagtacaatatttctgtaaatattaaaaaataaaaaatgaaaaatgaaaaaaattcgtctcgtgcccgtgcccttccgacggcggtggcttccaaagttccaacccgcatccggttcgctgagccatgggccgtgggctgtggcccaactatagcggctgtaagaaagagaatttttttcggttttagattttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagccctcagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcaaattttattgtatcagaaaggggaattgagagaccggctgagaggagtgtaccttctataaaaggatggttaatgaggggcttgagagttgatccacagacaagtgacataacagtcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaaggtgattcgtcagatgataagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattcagatgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggcggattct

SEQ ID NO: 9686 - DNA, 15681 bp, Oryza sativa
  unsure (1)..(15681): unsure at all n locations
cagatgaacatggatgatgccgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaaggtgattcgtcagatgataagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttacgaagcatacatgttttctacctggtgttcagaaataccacaggaacattacatgtgcatttgttgcatctgagatgtatgtgcatgtcatcgataatctcacatatgaaccaaggtcaataatccgacacattgaagagacatacaaatatactattagctatgccaaggcctggagggccaaacaaaataatagagatgagatttggaacttgcgaagcctcgtatgacaatttgccacgcctgcttggtgttatcgaggaaagaaaccctgggagctcttacgaagtgaagaaattcccctcaattgaacatcttggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcaacggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagagagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacggcacatgccattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcagcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatattatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcagtgagctactcacggttcaccactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgatcgatggaggccaaagacgcacacttttcacttgtcgtgcggtgaggtagcccataccctacaggacgtatcgtacttgttggggctaccgctcgcgggagacgctgttgggccagtgaccacggctgtggactggcaggacgatctgacggcatgtttcgcactagtacagcgcgcaccgtacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggccgaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccacgttgttggcggctctgtaccgtgcactttgtgagtcttgcacgaagacggatcccaacgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggcccacgtccaggttaggcggtcgtatcctgagtttgttatggagttcgaccgccttctgccgactgacgtcgtgtgggagccctacagtgccatggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctgctgttcaccggttgcttcttgcactacgctttccgttgttgcattaaaatctgcctgttcacaataatttgtaacatctgtcgtttcacactaatattaaacattaattcgcaggtactcgcgcaagggtcaacactcagctggcgactggcccgccaagttggcgacttttgttgaggactggttgctcgcaaccgaggaggtcgtggaccacgagggagagccacacactgaggagtcgtaccaggcctacctacgctggtaccagccacgcacctgtactagggtcaccttcgctcccttggagcagcagccccacgttgcgagcactagagacctctatgccaggcaccgcgaccaggacttcgctcatgctgtgagtaccctgcatcgcaccattcctttatgttttcatgtctttctcttcgtcaaattttacgaatatttacgaacaaattaaccatgcaggtcgacgacatcaaccgggatcgtcgttgacggttcaacgacgatccaacgtttaggcgcggggatttcggtacccgtagaggagcacctgacgacgtatacgcggatggtggagtcgatgcgctcgattctccgagttctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgtcgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtctcaggcagctgtgtcaacctcgcactcagcgcagttctggcagtacaccgggacttcgtcacaggcagccggcacgtcgagtcagggtccaccactggaccatgctgggacctcgtcggaccacttgttgccttccaccttcctcttcgacatcactgacttcgacttcgcttcaggttcgacagaggacgtcatcggcccctcacagctgggaggcgcaccgccggtgcagacgcaggaccatgcgcaggccactcctccgcgggacactcgtgctacccgtgctgtgccaccggatcgtttcacctactcccaggaccacgtgcgagcacaggcccggaggaccaggcgtggtcgtggtgcggggcagggccagtagagcagtcttctctttgtttacttgcttcactttccagtactgtatgcttgtgtaatgactacgttgttgttatatgtgcacgatacctttcggggcatgcacgatacctttcggggcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcatacccaccataccccaccacgttcacatgtcaggggtatcactcgattttttgcgcctatataagtcgccttaacgtgtgaggcctcacaatctttcaaaactcagtcacattcagtactctcttccccacttgcttcattacaaatccgaccggctttcgtcaatggctagacgccgaggtgttgaggatccaaactagcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttataagaaggtcgctggtatttcgcatccgaaagtactgagcaatacttacagagaaaagcgacttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgttaatacagagaatggatagacaccagaaggattctaactccacctagccgtgttgtgcagcttaaactaccagagcaatacagggttactaaagcgcggtttgagagaggagagggatcctcacgtaggggttagctattatcggacaacttggcatattgaaatttctactgtcatgcttccttgtcccattactacatcgttgttgtgttcaactattgcactacctccctcctagttcgaatctaatatcatctatgtaaccgcaatgcaaatagttgtatcatattcaaattgtactactatttcttcatgttacataattctccttgtttaagtccatataatgtttctatgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttcatttgggtcccttgccgccgcggcatagagggcggcaagggacccagatgaaaaaagtacggccgcaagctctttatgggcggccaaaatggcaattagcccgcaattttggccgacggcggcagacggcgcggtcgacccaccgtctgccacgtcagcttgccgcccatcattagggcggcagaggctatttctgcaatttttttggtcgatagattatttctgtaaatattaaaaaaaaaatctaaaaacgaaaaaaattcgtaagaaagaaaaagagaaaaaccatagatccgttccttctccaccacaggtcgacgacggcgagacatccccttgcgcttctcttccaaatcccctgcgccgccgccacacccgctagctcatctttctcctccagatccatccacaacatgtatcgcctaggtgccagtagctgccgtcgcgccgccgcgctcgccgaccgcatctactcaaccccaacctcctcgttagcaaatgttaaccccattagcagattggggacaaatcccaataatcgctccggcatcttggaagagaagaaagtgaagaagacgaaaaaccggcgattcctctacatggttgatttccgggctgtagactcttccttccagaggctacgccgaatcgacccatcaagtctcttctatgcagaccgggcggcggcggcggcgtcgccggcggccgtggaggacgtgcgcctgcctccaaccgacatcaacttctttccccccggcagcagcaattcggggacggacaacatcacgtggatggagattatgcgcaggaatgacgacaagataatcgccgtcgaccaggctggccgcacaatcatctacgaccccgccaagcacagcgtcggcgcgttgcccaccatggtcacgcccaagctctggacactgtcgctcgccgtcggcaaggatctgtacgtcatggcggtgtcacctcaccccgacggcgtcaccgagcgttctttcgaggcgctcgtccgttgtaagaagcccgagttggacgattgcctctggcgccccatgccgccgccaccgtacgtgcacgccgcggactacaaacacgtcgtcggcgacacctgcgcgtacgcggcggtcggcaactcgcacatcttgctgtcgtcgatgaggcatggcacctactccttcgacacggcgagagccacctggagcaaggccggcgactggacgctgcccttcagcgaccacgccgagttcgtccccgagcacggtctctggttcggcctctccgccgcggacgacggcgtcctcggcgcgtgggacctgtcctcctccaccgtccagcagccggagccgccgccgccggcgcaccccgggtgcagggaattcgccgtgccagggccgtcgcgtcgcagggcgcgcccgtcgcacgccatcgacctcggcgaattcaccgaggtgtattcgtcgcacgtcatccacctaggcgacagcaagctgtgcgtcgccaagctgtacacggtctctcgccgggggacctgcaccgaatactgctgcgatttcgagtcggatgaaaggaatttcgccgtgctcaccggcgtcgaggtggtgcgcggccacgacgacgagcttcgcatcatcaggcataagtcgcaacgttatagttttggtgaacgctacatacccacatctgtactctgactagcagagtactccctccatccaaaataataataaaaaaagacaaactctagttttccgtgtccaacgtttgaccgtccgtcttatttgaaaaaatctctatctcttctctatctctactacttaaaaatttcgtgtctaacgtggaccgtccgtcttatttgaaaaaatccctatctcttctctatctatactacaataagaggtgcttccatcgtccgttaaaaaaaccaggtgaaaaaaacctgtccgatccaaaacaaaacgagcgaaaaaaaccaggcgaaaaaaaaagaaaaaccaaatctgtccgataaaaaaagggaaaaaagggaaaagaaaaacgaatccgattccgcggtaaaaaaaagggcgaaaagaaataaaaaaggaatatgtccgattcctaaaaaaacaggcataaaaaaaaccaggtgaaaaaaagaccggcaaaaaaacttatccgcgtggacgcggtaaaaaaagagcgaaaaaaataaaaaacaaatctgtccgatcaaaaaaaaaagaattacatgtgacgcggtaaaaaaaagtcgaatcctattatatttgacacggtactatatatatctatcttctctatctctactacttaaaaaattaaaaacgtttccgttgttcgtaataacaaaaaaagggcgaaaaaaacattaaaacaaataaaagaaagttcgattcaatttacttccgtcgtccgtgaaaatcctatcttatcttaatcttaatctttccgaggggacgagcggcgccctccgtccctgcccgcacaatgaaacgccagccaaagcaaaaaaaaaaaatgaaattgagcaaagggataaactagattgaagtttccaaaattaaaagaggataaacgatattgaaacttccctaactcgaaaagagagaataaaatagattgaaatttcccgataaaattctctaaattcgaagaactctaattttgggtaagaaccataggagtcaaatccaaatcaattaagctaagggttcgggttacttaccggatttgaagcccctgagctcaccggagcttttcaggaagcggcaccaccgcaccttcacctcctcgcagtcgtgccgggttccctgcacgcgcactgtcctagagcacccgtccaccatcctttgccgaagacgggaagcgtcggcttggcgtcgctcctaccgccgacgaggtccaagccacttggcgctcgtcgccgtttgcacgcccacctagccggaccgccgacatcgtggcacggttttgcgccgccctcgggtgcgctcccccagccagcgaagcaggagccgctcggcggtcgtcactgcacgcgcgcaccaacttgccggacagccgtcgttccgctcgctcgtcgccggagggaaatgggatcaggagagagggatttgggagctagggttttgcccctctccccagtcggcgcttcatccggcgcggggacgattggagccgtccattagatcggacggctcagattcgcccagcgacgggccgtcgctgccgttgattacgctgcgcccaatgggccgcggaagtgcatcggaccgcccccgcatatgtgggccgcacttagctgctcagcttgcgggccgttgaattgactcaactcgctaaagatgggccagcccaagtttggaccggcttgggaagacctaggccaaaagcaaatttgatcaaacaatgtggcttacatttttcaaattaaagtccgtcagataaactcctaagtaggctcgaaaaataaatctaaaactaaatcctaaatcctatgctaattgatcaaattagactcggttctacctatttgttaatatatcaaattagacttgatttttacagatttgaggttttcaaagtgtcacattatcaaacggtgtttttcccgttgcaacgcacgggcactattgctagttatgaaaaaaattaaaaagacaagtcatgcataaagtattaatcatgttttatcatctaacaacaatgaaaatactaattataaaaaattttcatttaagacggacagtcaaacattggacatggaaacccagggtttgtctttttttttagacggagggagtactccactgcttaggatttgttcaataaacctcctactctgactagcagagtactccctctgtcccactgaaaaaattgaatctacgactgtatgtaacattctattataataaatttggacaaagatatgttcagattcgtagtactagtatatgtcacattcagtattaggttggttttttataggatggagggagtactccactgcttaggatttgttcaataaacctctcttctgttaatcatcctgtttttgcaggatgcagacttatcggttagctttcgattaaaagctctgcattcgaaagctctgtatactatttctttcatgatgatgcaattcttatctgaacgacagttagtcactactagctggacgtccgtgcgttgcaacggaaaaaattgtacatcaatttgaatcactggataatgtgatataaaataataattcaatataaatctgctataacgaaaaccttgaagcacaaacgataattgcatcacatctttataatcttcatatcattgtagttttcacgtggtagttacacgtacaacaaaaagttgttgaattcaacggcacagcaaggacctatatacaccttatatttttacgcactacctcaggaggttgtctatctattacttcatttgcttctaattcctgatgcgcaaaagaagttcccctattactattacttcatttgcttctttagagtcattctcactgcactatgtcagagttcgaaaaaattaattactagtacaacgcaatagaccaggtggaagcagtaaagtagtaaacaaatattaggacgatgcaaatctttctatgttcatcttctgtcgtaactaagaaaaaccaaattcaagcttagataactgctaacattttttcgtatatcaaactaaattcaagctccaaatgcccttgtatgttttctgaaggaaacttgcatatttgtgcagctaaggcatcgttatctgcaagtacacatcttgatgcatattttaagttcaattaagaacgagatggcaagtgctcacctcaagtacatctctaggatgatgatatcagagtttaactatctaaacataaatcaaaatggtggtggcaaaatagtagcttttttgctaacataagttcagaatacgcactggaaaccttttcaacatgtgacatgtacatcaagagtggttaattgttcagataaactgtgatccaagaaattgtatttacctcaaccgtgctttgctctggataccctgatataattaacgaagatttcaagaaacaacggtggtccatggcatgtactccctccgtattttaatgtatgacgttattgacttttttgacgaacgtttgactattcgttttattcaaaaattttgtgcaaatatgaaaatatttatgtcatgcttaaaaaaatgtttaatgataaatcaagttacaataaaataaatgataattacataaattttttgaataagacgaatagtcaaacgttggataaaaagtcaacagtatcatacattaaaatatggagatagcatctgatagcatcatcaccaccaagtgcagcgagatgattcaactcatcttggcagacagtagcaacagccgcataggatgcataggagtgagcagtgatgtaggagacctgaataatttggtaaaacctgaatctaattactaaaaatcagccccaaaaatccaaaattgtcaaatcaatacttaccaccaaaaatccctaccggcagccgctgtagtttttacaatcatatatcttatataactgctaatttttttcacatataatgctaagttgctaattaaactcaagctctaaatgcattttcacatataatgctaagttgctaactaaaatcaagctctaaatgcattgctatgttttctgacagaaacttgcagattagtgcagcaacttatatatcttgatgcctattttcggttcaattaagaacgagaaggaatgcgctcacctcaagaaacgagcactggcattgatgcgacttggcgttgagggaggccgtcgatgccatggcttggaacgaccggggaaggcagcggcggcagcagatgcggtgggggaagaggcggcgcgggagtagcacacagataaggttgcactccagttataataagaagatcaacatccaatttattttgtaagaattaatgttctacttctacttaaaatgttaactcatagtacatcctgtagaagaaattactttacattgaacaccacattcaacacgtgtgtgtctttgttggttagacgtaacttaattcacacttggaaacaacaactgagtccattgttaaatggattttttttagtgtacctctaaatgaatatagaccattgaagagatgagatataagggtgaaaattcgttgctactacacctaatataaatgtgtactccctctgtcaaaaaaaagataaactgaatcacatccctcaaaggttttttttttgacggatggagtagtagtgtagtaaaagagtaattgtggaaaaaaaatcatatggtattcttgtaagttcagtttttaggggggtgtattatgtaattgcgcatggattccagattgtgctgccaaatagcgcttcggctgatgggcctctcgatacaggcccactcgttcgtagatggcctccaaatttctttatgggctgtacttgctgagaatatacgtggatattttcagagattcactattaaattaggttcggacactaaaaaaatcgtgaggtttttaatattcgacattatatcctaaaatagtataaatagtatttgtcttttattccatccgcggtcgaccggaaaactatgtttttttaaaaaatcgacctggctcggacaatcccggtcttaatagttatttgtcgaaaataatatgttccgcttaattctacgcacggtggaccggaaatctatgttttttaaaaattgacctggtctgtacatatagttatttgtccaaaataatccgttccgctttattttttaaaatcgactcggtcggggcttgataataactagttcccgaaaataatctgttctgctttattttttaaaatcgacctgatcatggcttcataataactagttgtccaaaataatccgttccactttattctatgcgcagtcgaccgaaaaaccatgttttttaaaaagttccaacaaattacattcgaacactaaaaaaccgttctgctataatatatgcacgcttgacagaaaaaccacgaatttttatattcgacctggtccaggtagaccggacggattccgggcttaaccaattgcgtcctaaaataatatttgtcctttattctatgtgcgctcgacaaaaaaaccatgatgctttttatattcgatcaggtctggacacactcggacttaatcttttttgtcccaaaaaaaccgttttgctataatgtatgcgcgctcgacacaaaaaccatgatttttttatattcgacctggtccgagtagatcggacggattccgggcttaaccatttgtgtcctaaaataatatttgtcatttattctatgcacgctcgactgaaaaaccgcgaggttttttatattcgacatggtccggacacacctagacttaatcttttttaaaaaaaaaactgttctgctataatatatgcgcgctcgacagaaaaacaatgattatttatattcgacctagtccgggtagaccggacggattccgggcttaaccaattgtgtcctaaaataatatttgtcatttattcctatacacgcttgtccgaaaaaccacgaggttttttatattcgatctggtccggacacccggacttaattttttttaaaaaaaaacgttctgctataatatattctgtgatatagtacaccaaagtttgatttatttaaataatagtaacccgagtggtttttgttttcacgcgtaaaatagagaatataataggccagtgattttttttatgtcgctctgctctgcttatgccaaacatggaggttgcaaaattgcaatgatcaagagcagcttgtgcatggtaattctctgttgcaaaatgctttttcctcgaagctggttaataaaacaggaaaaaaaagtgcatgagttaagtaaagaaagtaatccgtaatcctgatgctatagcatgcttcaaaattatacccttgaatgccaaaaaaagtactagtaataggcatcacttatatttgtcgaagaacaatattttttttgagatcaggtaattcattacccagcttgaaaaccaagccaaaaggagaacacagtcttctgagtctaaagagctcagtcatcaagaaacaaaaggaaaaacgaggaaactagatggcaggggactccagctacatatcaagcgaacaaaataccactaacacatagatagcaaggcctcagaaaccggaacccctaagctntggggggngacccccccccccccccccccaaaaaaaaaaaaaaaaaaccgaaatcagatgtcttcaggaggatcacacagctgcctaagtcgcgccaaat

SEQ ID NO: 9687 - DNA, 2179 bp, Oryza sativa
caaattgaaacagcaaatctctacgcggcagccgccgccggcagcacggctgtgcacctcctgggagcgggcgccggcgcacgcctcggccgctcgcgcacggcgcgcccgcagccgccgccgcctcgcgcacggcacgctcgcgtccgccgacgccgcctcgcgcgtgcgcccatggccgccgcctccgcgccgcgcgcgcgcactcgtcgccgccaccgcgtcgcacgccctcgccgccgccgcctcgtgcgcgcccacggccgccacctccgcgccgcgccgccctcgccgcccttgccgcagccgccggcgcccccggcctgcaaagtgacgcacggggtgggagactcactcaactggtcaaccatatccattccctcaagggtacaaaggtaatatcacaattcctaaaaccttttttttatttcctttagtatttctttaacgcacaacatgggacccaccaaacggttgtcacaagtgagggtagacggctgcttcagatttcaaaacgtgagggtaaaactgcaaaccctaaaaaaatagggtgaaggaattctccctcttaaagctaagaagacaaagtgtttaatcttaagaggcactttactttgccacacatcctgcatttctgcatcaataacccctccaaaacttaacaatctactagtagtagcatgcctgtgacatttacatagaagcatacatgacagatgaatgatatcaagaaacatatatatgacttaccattgcctctaaattataaattatatattcaagaaaataaatgtaggcaaaatatataaatagtagatttattatttgattaataaaaaacatccttaaaatgtcttatcatttccgtggtacgaacacatctctatacgctacaacacgccacacactgagcctagcattgcttcggttctccttaaaggcactaagcaaacataatattagggcatccaagaagtgctcgcaaaaagtaggtcacaagatcgttaactcttatctcgcatggaggcttagaatatagagaaaatcccttgtatacccctggaaattaagctaatcccttctatacccctgaatttcacttacttccttgtatacacgtaaaatttgattttgatcccttctatacccctcccgtcagttgaccgttagttgaccgtctaatttctataaaaatgaccattttacccttcggatgaatatataaatttatgaattacattattaaaaatataaaagtttcccgcatgagactattaatagttatgagtttgttgtgcgatgtattatttatccccaaaattatttttatataatgaaataaaaaatatgtatttatttttaaaaaaaatcataaaaaatgaggagcattcatacaaatataggaccaatgttcacaataatggttttatgaatgctcccgataaaaaaaatccattgtcctattaaaatttcaaataaaaacttcaatttattacttttgttttattttcaaaatttatgtcaaaattttctgcactaattatttagtctcattagtttcataaaatgcacatactgcgcactcaaacaaaatttttaattgtttttgaaggttatattcaaacctaaagcatcaagggaaaaaaggtcatttgtaactaaacgtaatagtgaaatgatggaaaatgtaacagtaggggcatggaagggatcaagttgaaatttcaggggtatagaagggattagctaaagaaagtattgagtgagttttcacacagggaatttactctagaatatacaattcgtttgaaatattcagtgaaaccttagatatttttttctcttcaataacaatttgtttggtcagtgtacctctacgactgcaagttcatatatagattatctctaattcctgcacacggccagaattgaatttctgaaccaatgcatcaccctcaacaaaattgtatcaaagtatttcggtgtattgcatgtgcatagatgtaaaaacacaaacaggtatgtgcatgtgctacacagataattgcataaagtgtccaaacttaactttacacttcacaaataattgcctttttttacagcaaataaacataccataatgtctttcacggctaagaactaaagatatcataaataaatccaaattaaaggtcaccat

SEQ ID NO: 9688 - DNA, 7454 bp, Oryza sativa
  unsure (1)..(7454): unsure at all n locations
aaaatattcttgagcaaaagaattaataaaaacctccaggggtgaaatgcttttaatgagtaacatgacaagaaaaggcagaagtgtttacttatgttcaacttatcactttatatgtgtagtatgaaagcaacaaaagttccatacgacaccaaatacagataactgaagatatcaaagtctcacttttatctgaaagtttcaaggtacaactgaacaataatgtatcaacaatttatgttagtaactcaccttgccagaaatatacttcttgccaacagcagtgtcctggaggatatgtgcagccacctgaacgaataattattagcttatcttgtattataaatgcaatcaagaaagtctgtgaatcacatctggtttgaggaaaacatgatgcaagtatccagttgactcttcatgacttacggaagaattgattcaggatgaacttcaacctatggctagtatggtatttcagttttaaaaatcagccatcataaaaaaaaaataaaatttacaagatggttactagcttgagttcccaaacaaccctcacagacccatatctgagaactgtaaggacattacctcaccaccatttattggaccatcatagcatggatgaagtgtcatagcacgttgcagataaggtttccagtgtccagtaagtaaatccctccgtaccatctcaacgccacattgataatgctgtttattaggaagaaaagaggatatagaacaggacatcaaggttcatgactgatgctctataagtacgaattcttaaaatgaaactatacttcgagatgtttcaacctcaagcatattcctcaaaaacggctcttcattgaaataatctctacgaacaaatacaaatggcagcttgtaagccaaagcctcactcacagtgccatatccaattttccctatgcaacaaccaacagaattgttacatttctagaaaagaaataaggcggtaaatagccctaacacagataatatagcactgtatttaccaagcatgcagtcagatgctgccatcaaatcaggtgtataggcgtcctttgcaagtttaatgaaatttggtggaagctcttgagtttcagatgcaccacatacctttatgaaaatagaatttggtcacaaatgttgtccagacattattaagagagagagaaagaagagagaagaaaacacgtagtttcaaagaaaatataccaaacagagccaaccatcaggcagccattctttcttcagtttccatcctgcaggctgaagaggaaaccatcacaatggcattgcatcagcaatacttgcataagatggtagcaaattcaactatggattgtactgactaccaataacagcagaaagacagaaaccttagctggtctaaaaggacatattgatttaacataaatatagccctttcaaaaaaaaatgatttaacagaaatatgcaactaacatccattaattgaacaaaatcgagcatctataaacgagaaagaacattcaggctatttaatggtttacctgtcctccaaagttgaaaatgaccaccttaacatcatctttaattcctaattccttcctcacctgatatatggagattttttaagtcatcaagaactgagaacatgggttgagtgttcagagcaaacattgtccagcagagttgtacgcacctcagatctagatttatgcaatcttctcaccacaagaggaacatcaatgacatcacggaaagcaggcactgcagaagatagaattaatcacgagtacttcaaaccaacatgcaggatctttggatatattattcattcagacatatagacgtactagggcagtatccagggagtcgtagtaagaattcacaatgtgaataatcttctgctatctgcagttgatgccaacataaatgcatggttattgaacgggctgaattagtctcaacttgcaactaaagaacgatattacagagaacagttttctcaaaaaaaaatcaagaaatttgaatccggtgtctaggtggctttaggaatttagtagttagcattagcaaaccaattagacaattttgcaccatttttgggaaatgaaatgacaggcacctgccacacaattgagcgatgatgatgtccagctactacgacatactctgcataaatgaagtcccagctgcaaatagaaggtgaaaattaaagaccgtgctttgattcaaaaataactactcaaaaaagaagcaagaaaaactgcaaataaaactatccatgtaaatttcttcaatagcccgaattataaaaataaatggagagaaaaaattatgtttacaactagtcaatttcgggtaaagccataactaaaatttattgttagcatcactcagagctgcagatttcttgtgggttagtagataacttttgtgttcagcgttagtactgattacatcaggaaatgaatgttagcaggcaaaacatataaaagtcaggtaactgtagcaactatgcactgatgaaacatataaccccaagcaaaatgttaacataaacttggaataatatgggaacccacaaaggctgtaactaataattctaaagctcactctacatcctcattgctccttttgacccctagcatgaagcaaccacagaaacactaacctgaaattggtgacgcacaccgatcgaatgccagcatccgcagccgccctgcacgcgacggggacgacatctgaaacctgaccaaagaccaacaacaccacatttgcttcagatgctgtaaagattcatggagaccccggataaaaacagattaaaaaaatcgagcaagtagttggtgttagcatcctcaggagcattaccactaggtcggccttgatcgtgttgagccattccacctcagtcctcagaatcgattcgcgtggcatcacggccgtctgatgatactgcattccgcaccacacaatcactcaatcagccacaaatccacaggcaaagcacagcacagcaagagcaagagtggtggatgttgtagcagtagcaggtagtagagtggagatattggagtatgtttctggaaccttctcgagggaggcgaggcgatcgacggtgagggcgtcggcctggacggcgccgcagtcgaggagcaccttgcggatgtggaggttgggcgagctgatctcggtggtgaagacgaactccggcgcgccggtgaccacgtgcacgtcgtgccccgccgcgatcaggtgcctcaccacctgcactaaccacaaaccaaaattccatcaccccaaataaaaattaaaaaaaaactcaaacagcagcgaatccatccatccagccacgaaaccaaaattccgcgcagaaaccaaaatttcatcgcacggagacaaacacgaatcaatcctccccaaaacgagaaaaaagagaagacgagacctcgagcgcgcgggtggcgtggccgaagccatggccggtgatgtagtacgcgaagaccagatgctgcggcggcgccgacaccaccgccatcgccgcctcctcctcatcacctccgccgtctccccgaatcctcatcgccgccgccgccccaaatctcccggaatttctcccggaacaacaaaaatcgacacttattatcagagactccacactccacactcctcctctcctctccctcttatataagtcagacgatcagcaattgattgattgggagacgagacgacgtggactcgttggttggtgttatccgaattaacgaactgccacgcctgaatttcttttgttgttttttttttgggttttttttgttgttggcgcgatgatttgttggtggtggatggtggtggtggctgccattcccgcgaatctctctatctcttggtgtcattgccgcgattcgcatggtgcctgcagaatcagggcgcaacaaaagagcagatggaagaagcaacagcaagtagtagctgggggagttaggtttttatcctatccaattccagtagcagccaggacgattcgcgtatatcctatccaattgttggattatgaatttatatccgattcgttgtccaactagtccaacctcctctgcaattgatcaaacaaaattaacctgtaaaggttaattggataggataaccttttacttaattggttaatactactagattttaaagtagaggctagaataaattctacgattggaaaaattcttatgctttctaccttttgtaggctttctatcatttagggaaggtttttttataattaagtaaagtgttaatagtgttaataaattaaccctttagttaatttgataacattcttttgataataaattatattataacaaaaaaatgctaattttatagtgcttcttaacggtttcctggaggtaacacattttctatgcctccggttacactaataattttgtatctttagttacatctcaagaactgtaaaattttgccaaaaagtatcatgcttagttactccctcttttactaaatgtttgacgccgttaactattttaaatatgtttgaccgttcgtcttattcaaaaaatttaagtaattattattttttcctatcatttgatttattgttaaatatacttttatgtatacatatagttttacatatttcacaaaagtttttgaataagacaaatggttaaacatgtttaaaaaagtcaacggcgtcaaaaattttgggatggagggagtatttggttaataactaaacataatataaaatgtggataaggataattaacgttgtagaggtatttagcatggcatgagcatgcatgtagatgactgaagatcataaggctataacaaaattggcatttttcaaaccaaactcaaggaagccatgaacatgttatgacatccttcaatttgacaccaaaactcaaaaagaaaggatcttgagaccaagacggaacatataacatcagtccaagtcatcaactcaacccatcgaaggggttgcgtctacgccatgaccttgacgtccatgaccagaacatggcatcgtgtaccgcttgtccctctgcttaatttggcacttttgagttttgacttcgatcaagggatttttttttctctctatgaattctattaacctctaattttttaataaacgacgacgttaacttttggacgcatattttagcatctgtcgtcatactttaaactggagtgagcaataatcaattccgttatcaactatgcaattttagaaaactgcaattttaatgacaaaaccaacattagcgacatgttttagtttactacaacaatagcgtgagaaattatcacaaaactgtaatttttacgttatatgctgctacagttgttacctatatgtactgtaacagcatatataacataaaagttacagttttgtgataattttccatgttattgttgcagcaaattgaaacatgtcgttcatgttgcagcaaactgatagttatggcactaaagttacagttttttaaatttactcatggatatattatcagcaatggttcagttggtcacaaactcacaatcgcaagatcacaaatgcagccagcagcaagtccaaacgcacaacaacaacaacgtcggctgctgcaaacctgtctgcaacgtcgctcagctcagaacacccagtgcagcgtctcgtcgtcgtccttcctcggccggccgcgccgccagctgctgcgtcgtctggcctcgcgcgtgacgaccgtctcggtggagagcacgtaccgcctcacggcgcgcctcgccatgcgcagcggcgccttgccgctcgccgacgcctccacctccactccggtcaccaccgcgaacctctccctcacctccgtctcctcctcctcctcctcgccggcggtggcggcggcattgaatccccagcgccgcgtcgtcgtcttcaatgaagccttcttgttggtatcgagtggtcgtcctcccacctcgacgcgcgtcgtctcgaacagctcggcgacgcacagcctgccgccaccgagctggacgaggtaggacgccaccggggccggccaatccttgtgcggcgggcggtacctccatgtgtggcgcancgacgggggcgtggcggtgaggtcggaggcgcaaaggtggccgtcgtggtgaggggagaagccgaaccagaggctgtgctccgggacgtgctcggcgcgggcgcggaacgggagcgcccagtcgccggccttggaccacgcgccgctcgccgtgtcgaaggtgaacgtcccgtgccgctccgtggacacccagatttgggagtcgcggaccaccgcgtgggcggcgagcgggcggggcccgtcgtctccgtcggggtcgagaacgtagggcggcgccgtgagggagggccagtgccagtcctcgatgatggtggcgccaccccgcggcggcgccggcgggaggccgtggacgagcgcctcgaagcagtgctccgccccgcgcatccgcgccggctccggcgccgccgcctccatgacgtagacgccgtcgccgacggtgaaggcgatggggcaccgcttggtcgcgcgcatgtgggggaggaggcggacggcgtgggcgccgcacttgaacaggatcagcaggaagctgcggtactcgccgtccacaccgaccaccttgtccttgccgccacctaggatcatcgcaccgcacctgccccagccgtggccctggggtctatagatggcctcgccggcgcgaggtagctgcgcgtccaccatcgctgccgccaccggcgccaggcgcgggcgatctgcggcggctgatccgtcgcccccgccggttggctttctcggcgggaagaagcgcgacatgtcgatgcggcggagcccgaactcctcgctgccccacggtgtgggtttcttcaccagcagatgcagaaaccggcggctcatcctacaactaccgatgaatttctcgacggcggcagcggcagcggcggcggggggcggcggtttcttcctttggccgtaccggttaaacccctagcttttcgcgcgtccgattttgtactgataacctaaaagatatccccttgtttggacaaaggtatcctaacagattggctgtgtttagttcacgctaaaattgaaagtttggttaaaattgaaacgatgtgacggaaaagttggaagtttatgtgagtaagaaagttttgatgtgacgaaaaagtttgaagtttagaaaaaaactttgaaactaaacaaggccgtagtttgagtaaaatttctcaaatttctgtttgaaatctacaggatacaaatatgtgcaatacaacataagaaaaggaacatatcaagaagatcacaaatgcggaagaggcgaagagcattgaggtggtaaatccaaaatgctagataaattaattggatgccaacatacaggcttgtgttttttgtaacaacaacagt

SEQ ID NO: 9689 - DNA, 7673 bp, Oryza sativa
agccatttgaggtactagtcgtggatgctaactaactggaggatttcttcatccttcctgtaagtaaacagcagcagtcaattcacaacaatgacatctgaccgtcaccttgaccacataacaggtgctgaagggtttggtagcgacgatggggtcatgcagtgttgttgccactggtgaaggctttcgccatcgattgctgcgacatttgcttccggagattcctcaacgtccatagaatcgacttctgtctcatcagactccattggcacttcgaagaattctctcttttctgaatctgaagcagaccaattagataccgtggcaatttgtggtggtgtccaaggaactaaagccaagaagttgctgcacccaggagatttgtcctccagcccgtgaaagttcctttgcataaaagcctgatctgaaagatgagaaagaaaatggtgaggagcaatttcaaggtatggatgataatcctatcctgacatacaggacatgagtataacactagaaaatacatacacataaagtccggtgcgccatacaaacatgctaaagtagttcagcgggctttcttccttaaagttaatcatctaatgctcatcacttaaaacagaactcacacaaagaatgtcaccaagtataagtgtgctagaagtacagaggcattttaagacaaaagcaaatataaaatcaggagcaacacgtgcagctaacaaacttgcatgctagcaacatagccttgaatatttgttctactactagccagttgccacaaaactaaacagtgagatctttgcaagataagttctgtgtatacttatttcaatatcaaccttggatgcatcacagatgtagtatgtaaaacactaaaacgcctaacacctaaagtagcaatagcatcttctcctatatatctatcccatttgacacacgctcgacatactgtaaaagtacaaaataaagtattgcaaacattcaaatattcagaagaatacaagagtaagttataataatacaaaatgttaagtaacttactctttagactacgtatcaagtctggactgattatgattgaagggttcgaggtcccaggaccaatgcatgcagtgttatctactgacttgtataaaacaagtgccttgtcctcacttgatggatgagattccatggcacctcccagcatgtcttctataatgggcatgctaacaacactgtggatttcctctcctagcatctcatgtccaaatggcatggaaggacctggcgtctcttcttccataataggtggaagcccaatatcctacaaacaatagtcgacatttattcagcaaaatgtgacggtgcagcaaatttattgaatatgtacttacagggaaagtaaaatattgaaaaccaaacaaatgctagaaacgatataatgcgcatttatatcctgaagcaactagccaactacaaatgaaacctagttttcttcaagcataacactcctactggttagtggtaacattgaatgaggtatcagaaccaaggtgaaatatggcaatacattgctcagtactgagaatatctcccactagaacactgagtggggatggtgatgtcataacaaaatcatgcatgccacgcccacaccaatggtggacatcttattaacaatgaaagaaaacaatgtcaagatgataaaaaaaaaagaaaagaagagatgatccattgaagtacagtgaaccacaagaaaggtttgctagtggttccatacagattttgacgaacagaaagatagagtcatttcattattaattaggaaccctctgtgataactgttactgctgagcaaactcatattggataatgctacaatgataaatttggagaggatttatggtgctgataaagcctatataatgctccctccaatcaaaattatagaactaagtttagttctccgaacgtcaaatattttgactggagggagtatctaaattataatccattgaacaactacatgaaagatagtttagggaaacagctggtactcaaatacatagtagtattagctatgctttcactcagctattttatttcgttgggaatccgttgttttctaaactccatcatgcgacacacagatgtaaccaagcaactccaaggtactgacaagcaagaaaatgaaatccggtaaacaaacatactgcaataacacggtagattcttggatgggaacagttgtcatggtaagcccaagatgacactttctcagtgcatttaccatttttttctcagcctctcttaataatctcattgcaaacacggcacccgcgcaaaatcagggcatccataagcatcccgaaatacaacctaaaaatgcaccaaactacctggtagatatcgcataatagtactccaactaacattaaaccaagcaagctcataacatgcatcaaactgctactagtaaccagtgggacgcctaatcatagctataaaagtaaaaaaaaaaaaatatgattccaggctccaagcatgaactacaatagaaatatccgacttagagccaagcacaaagctatgaaatctaacactcgtatcgaaacagtactagagcatgggggaagacagctcggctgctcagctacacagaccaaacgaagccgtagggacgaggagagcaaatggcggtggcgggagctcaccaatctgcggctcttggcggcggggccggagagggagaagtcggagaggccgtccaccacctggtccagctccttcctcttccccatgaaccccaccatcatccggcttcccccaagggaaatcaatcgtgctcgaatcccgcgggctcctcgcgagtcccgagctcgaatcgaggcgcggggatgctgggaatctgggactgggctgtggtgggattgccggccggcgggcggcggcgcggggagcggcgggtttcgcgggatcttggcagatggaaggggtggggtttcgcgtgtccgcgtggggtaattttgcgtgggtgggtgggtggtgcctcgcaccggatggatggttccagaagcgggtggggtcgtcaatggaaatcatccaattggattggtcttagggcattaacaatacgtcacactagttgagttgaggagcctcggggtgtcacataggatagggctagaggtctaaaatttggattcttcacggtgcaagtgtctctaggagtttatatttcagcccctaacattttttttagttcttatagtttctttaatttatgtgaagttccaaaatttacactatacaccctacaatctctactattataaaaattaaagatgtttttgttggtactttggtacatcatccgtgtatgagttgatttttaatttcgttcgtttttgaaaatacatatccgtatttgtgtcggtttttaagttcgtttgcttttggaaatacagaaaagacttctaattgtagctcatgattttcttaaaaaaaatatatttatccaagcgaatttctacagtaaatttcatcttaactaaaccatatctctactattataaaaattgaagatgtttttaccagaattttagtacgtcatccgtgtttgaatcggctttaattttatgtttcggttttaatctatatctctactaaaaacaataaattctggtcttatgttaaaaaaagaaagaaataaagtccaacttaacgagcgataaaaaaaacttccgtcgttagtaaaaaaaaaagcatctcgtcgcttgaaaaaattgtccgactcctgtagaaaaggaaaaaaaatctcccagtaaaaaaaaagtccgtttggtttttttcactggtattttttttccctttttatgtttggctgggtcaaagaaaagcagaccgaatggaggaaggtagcggacacggaatagcggactagtctagggctgaaaaggaaggaaggctttcggccgaaaacacagaaaatatttttattaacctttttaattattatctatagcgatcccaatgttaagatttttattaacttttcaattatagtgtatagtaatcctgatattttttattggtatgaaatcttaggtaatcccgattttttgaaatcttaggtatgacaatctgaaaatttattggtgcttgttttgatataaaatctgaagttgcaatgttgtttgttcagaaatctcaaaaacgttatagtactagttctgaagctgataatatgacaagttttacagtgagttcttgaatgaactagctgataattgaccagagactatttggctacatgtttaataactttaaacttggttagtttcaagaaattgtagcagtgaatgtagcacgttctgaaaattttacctcggtgctgtattttgcttctgacggatataaaatttcactgtattagattcatggcaactagtcaagtactgaactatcgtgtacatgtaatggatgttagatttaattgggtaattaatccatttaaatcaattaaatcaaataaatttcaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccatgactcttactcttcatcttccattcctcttataaaatgagaatggatttgatctcccgcgagaagaagtagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaattctattgtaaatatcatgtttattatcttgttattttggattaaaatatgccgaattatgaccaaatttccaacaatggatacatatccaggtttctaaaactactagtaaaatgtaattggttctgttgtgctttcatacattttccgattccaagttactattggcatgtgtgaatgcataaaagaaataacttgctgttgtttgttgttcatgtgaaaatggatggaagtgtaaaaatatacaaaagctcttctgttcattgcaggtgatcatttgatatgctaccccggtgcatttaacatgactacagggccattgcactgggagttgctgcaaagagcaaggtattacattttctaaatcatttgcacctgaaaatattacgatcattcaacgaataaatatgagcttaagggacaaataagagacaatgaattggactggtaatgaatttctaaaataaactcaaatgtacagacaacttaagcttggttagtttcaagaaattgtagcagtgaatgtagtgtatgtagtatgcacattgtgtacagtagcatatacttctctatatgataaagttgatcctgtacttttccatgtgttatggtgaattggtggtgatgttgtgaggtgatccatgcatatattatggtgatggcagaagattctacaataaacaaatttgattttcctgcaacttgtaaattcgcagagagatagggcgaggagtttgaaagaaatattatggcggtcaaagaaacacctgatgaagcacagaagcttgaagagttcttatgcgtacgaagagaaatgctgaaacgtgtttaactggtgaatatgtcgtctgttgctttgccgtgtaaaaaccgttttatcctggcacttgtctgcagggtgcctgttctactaggacaatgaggcacctgttttgatagctctcttttcatattgttcatgctgtaaaaaatgggtgcaactgtttatggagaaaaaagtgggggatgcgaatcatactttgttgtgggaggatgtgtggtatgggcaaactcctgttagagtgcaatacccaggcctgtatggggtcagtttacagtgtgggaagactgttaggcaggtctgagacgggggggggggggggaatgggatctaaagtttttagaagacatttgtgtggggggagtttgttggagctgcaagatcttcagaataagttgagggctgttgacatcacttcagactgtgataggatcatttggcctgctaggaggaagcgggagtacaatactaggtccatgtatctctactacttaaaaagtccgtagtggtggtcttgattcctgacatagcagacgcatcttacagacatgcataatctcaaccatccgattgccatatccaatagcgtcaatctcctccacatcacgcgatcgctcctctcccatcacgcgctcgctcctccccatgcccactcctttccccacgccgcgtccttcgccctcctccctgcgtcgcctcctcgccccgccgtcgcgtcgcctcctcaccagccatgcccaccggcctcctctccagacccccgccgccctctccaatctccacgcctccacctcgcatcggatcaatcctccaccttcgccctcctccctcctttccctcccacacggaaaagtctatacgtactaaatttttcttacaaaatgtttacaaactctgatgtgtcaagctgtgagtaaatctagatttcttgtaacttccatctagttaaatcaaatggttgagaaatttgttagtaaaagttttgtaagaaaattttagtacgtgtagcagtactcctcccacacacacgactcgcgccaccaccggcccctcaaccccgccaccgcttcttcccttccgctcctttccctcccccacccaccggcgccgctaccgatcccgccgccgcactaatctctctcgccaccgtcgcccgccatctccttactccgcaggccttcggcacgccgcagacgatttccacgccgaccggtcaccaccgacgccgtcttctccctacttcaccgcaggtactgcttcattgcttccgctcccaccttccccttctctgatcttttatgtcgctcccaccttcctcttctctgatcttttatgttttatgtggtagcttgtggtagctaggtcttttatctatactttccctgcttcttcttcttcttgttgtgtttttgttgctggatgagtggattgatcaaaacgtatgtcctcatccgagagaatcaacaaaaaatcatataggcatcatttatgtttttccatttccactttttttcactaagtaaattaaagaaatagtaagtttgcagtagtgtccgagttgtgaatttactaatgaaaacatccaaactgaacgaagtttgttttgctgtgg

SEQ ID NO: 9690 - DNA, 1576 bp, Oryza sativa
ccgttccatttgtgggatattctattcgtagactgtaaagaacagttgcataagtaatcttaaaatgaactttgataaatattctacttatttcaaatgcagttattacattcagttgataattgtttataatggtcgatttgctcgcatacattatttaatacctgtatatttcagaatattccaactattgaggcggacgcaggttgacaactgatctaattaagcaatacaggatccttgcgtgtaagtatcatatgctcacagcccttttaatatagtacgaaattggggatgatcagacctttgtgttgaatttaaagattcctggacagttttaaagtatcttattctgtttgaggattcaaaatttggattgctcaggtgttgtatgtacatatttgtagtatgaaagaatgcgatttcctactttgatcactaaggaaatcgggcacactacaagactgagagtctaagtcacatgaatttgtagattaactgttgcggatttacatttttggtagaaaaaaatctcaaatttgccttttgcattccatctggcactaacttagcctgctactctagcaaaacttacgatcattctaccgttaaacttacaatctgaccaaaatacactgggtgcataatcctcagattttcttccaatttccaagttaagattgtttgttctgacagtttcatccatccagctaatgttatattcatcggtcaattgatatattattgcttgctaattttacaatcactcctctctcaggtccttttgctgatataactaatgtaattgatgctaatttgacgaacaaccatcccgctattaataaaaatggaactaatatgccaaaagatatgagaattgtcaacacaacaacttggactctataggttgggcgtagcaccatattatatatttcgtttctttttaagccttttgtattaagcacagtttttgtgtgcaggcactcttgaagatgttacaaaactaagtgcggctgaactaaaaaggaagcgtgctagggagtggtacgcatcattggccaaagatcaaaagaaagatagaaacaagaaggcacgtgatatcaggaagcggaggaactatgaatctcaaaggtttaagggggtgtttagatggggctaaaactttttagcccatgtcacatcggatgtttggacgctaatttggagtattaaacatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaacatccgatgtgacatggatttggaataagtccctggaaaccaaacgggccctaaatctctactgttgtgttgccttctgcttcaccgtgacaagctctgttagatgtgatgggtaccacctataggggctctgctacagcgat

SEQ ID NO: 9691 - DNA, 953 bp, Oryza sativa
gctacagattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccattcctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccagataactttggaagagatttctatagtccgggagtatcccgatgtgttcccatatgatttacctggtatgccgcccaaaagggatatagagttcagaatagatttggtacctggaacaactccgatccataagagaccttatagaatggcagccaatgagttggcagaagtcaagaggcaagtagatgatttgcttcagaaaggatacatcagaccgagttcatcaccatggggagctccggttatttttgtggaaaagaaagaccatacccagagaatgtgtgtggactatcgtgcactaaatgatgtgactatcaagaataagtatccactacccagaattgatgatttgtttgatcagcttaaaggtgctactgttttctccaagatagatcttcgatcagggtatcaccagttaagaatcaaagaggaagatatacctaagacagcttttaccactaggtatgggttgttcgaatgtactgttatgtcttttggacttaccaatgcccccgctttcttcatgaacttgatgaataaggtgtttatggaatacctagacaagttgtggcggtctttattgatgacattcttatctactctcgaaccaaagaa

SEQ ID NO: 9692 - DNA, 5890 bp, Oryza sativa
taagctaattaaagaaaaataaagattagctgatgatatcatggccatccaaatctataagagccagcagcaaatttgacaggataagatcctcttcacctgcaactcatcagcaagaacatgttctgcttagcttctacaggtatcagataagcaaccaatgtgtatgtcggcatggcctgcaaaattactaatctcacatataaagtcagagcagtcactgcagatgagaattttctttactctgaatttgagtggttgcaagagaattcagatgcagttgagtgcactgcagtgcagctgcgaggttcacccgtttgcagaggtcatttcagaacatgtagctcagcatatgcctgtaacaagctgttgggctgtgacctgacgactccagtccagtggtgaaggagagatactacaaaagttgcaattccttttcaatttttttctgccggctggatgatcgtgtcggcagctaagcttgaacaagctagcttaactgtaatcataaacttttgacaattccctctgaattttttacttctcctccctctattcttaaaatataaaaaagatattaggttcgtctgagtcaaactattctaagcgcaactaaatttttattagaaaaaataacatatatctcatcaaagaaatagactgtaaatatatatttcatagtggaccaaatgataacaattgatatcgtaaatattattgtttttttataaatttaatttaatttaaaataatttggcttacgacaaacatacgatctgtaggacggataataatgcagccaattgtttactgtatagatatttatagcctatctctcagctcactcatataatggttaactctttaatataatagtccacatgtctgtttcacatgtctgtttcacagattttcttggtttctatgtctaaaccggttctaaacttacagcctgcttctcatctctatcctctcctctctcatccatctcagcattttgccttctcatagattatacttgctctaaacagtaactttcttcaccctggctttttagcaaaaagatattattactagtagctgatactgcaactttttttttactactgttgtaacgttgagactgtgacaagtgtcccaaatctagcagtaaaggctgcatgcatattggattctcctgacttttgaagaccctcatgatactgtattttgaatactttgaaagctcaaagtgagaaaaagaaaaggtgaaattaaggagtgaagagtagggaaaaatcatgagtctttctttacattgatgtattgtgatggtggcacttattgacatttgcatgacactatgacagtaaaagttttgtactgaagtagtactagaagtagcttgaagctgaaaaaatgaagtggagtactcaaagatgtgactgaagctgaaaatgcagggactgtcggcatcatgcatgtcatgccggcgtgatagttccttcaaagcttatgcttatatttataaattaacttttgaattgtaaaatttaattttggaattggttttataggttttcattgtagtttatttaaaaacttttgaatcgctaaagatatatttcctgcattccaaattgatttacatatttcataagtacatcaagaccaagaaaaaataataactctctcctactatatttactctagcaacaaactcgatgtatgcaccatactcattatttcctagcaaatagcaaataaatatattgcatgtgggttataaatacttgtgtgcatagatacatgcatcaatgtctatttactccaatgcacagataacgaatagacttaatgtatgcaccatccccattatttcctagccaatagcaaataaagatattgcatatgggttataaatacttgtgtgcatggatgcatgcatcaatgtccatttactccaagcacagataacgaatagacttaatgaatgaacacaaatatgtatatcgtttaggaataaccttaaaaatatatatgtagatcaatttgaaatggagggagtagtatacagtataaaatttctactcataagttatttaaaaactgttgataagcgattcacataagtataaacaaaagcttaacaataaggtcgtagtcaaacaacctaagctgtcataattatatttctggtttagcaactctgtgtagattaactccctccgtatatgatgtgaccatggctactatggatacaaccattgctcacatcatggatcaacaagaagacatcaagatcaagtcctccaaaagctggaattcgattcggccacctgctacattgctgacttcaaacggccgccaaattttcatacgagctccgttttgggtccatgagtacttgatggaaagccctccaagtcctcttttcaacggatccagtcttgttctcagattccatcttagtcgacggcaatcgcagaaacaagatgttgcgtcacctgtaatgggcctatgggcttgtaacttcgtctgggaccccggcccaagtggggcccatgtggggtgcgccccaacctggtggagaacgaccctacggcaccattggtcatcctcccacatccttaaatagctaggtaccccttcagggtttctcgggttttgatgatagagatagctacttgctaccggctcgcagcgcgcgtgttggctaaaccgctcgtcttcctgtaatcagaacccccaccatattgtgttttgatagtgaaattttcatctttatctagcaatttcagtgcttgttctacttgttcttgcttgttcttcgattgcttgcaggacgagtgccctcgtggccgggttgacgcgcaccacaagttcgcggcgaccattggagacagtgtatcggttgctaaggcgcagcgtctttggacggttgtagtcgggccgtgaacgtcgtctttatccaatcgagttatcccctacctctcatcgaaagatcgggccacaaaccctagcgggttcgcatcaggtggtatcagagctttcgttgctcggtgagtttttatctacccataaccagaaaatagcccgacaaaaagaaattgtatcatttacctagccatattgtgccattgcatagttcttttcagtttttgctttgttgaattttgtgttgcatcgtcacgtcatcttgctggtcttaacgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttattgtgttgcatctagagtttgccgatccttgtgtgtgtttgtttttgccgtgcatgtgcgcgtgaggaagaaggaaggagaagatgcgcatgaggaagatggaaggagaagattagactagattagattgctttcgtttctatttgggggccacgcagaaaaggaataggtttccttctttcagaaattctcaccgagtcccaccaccttccatgcggcattccccccttgagtccgactcccctctcctttcggttcaatctacaccgtgccatcccttacaccttggtgaatttttgtttggtgtccgtttcaagatccgttcagaaaaacagaatcagtataaattcagcattccatttttgtataatttttaattttggtttgaacttttacatttgagtccctataaattttatatttacgtttgagtccctgtaaccttacattaaggtccttgagtcagtttttgttaaaaaaaatcaagaaaaaagtgagagaaaaaaaaggcagaaaggtgcataaaaaaaagaaaagaaaaaaaagatgcaccaaaaaaacagaaaagaaaaggaaagaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacctagagctccacagatttgattgcagccgtacagcaagtatttgccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttatttgctactaaccatggcaggattgcgcatggggaaacgagatggtcatgctcaacgtcaacatcttcaccatcaacgagatatagcgacttcttcacgcatcacatatgaggtacatgatagtgatcttgcaagggtagaatctaaattgcctggttttgatggtaagtatgattccgccgcttatgttaattgggagctagcagtagaaaaacaatttgatgagtatgatttttctaatgctcaaatgattaaggctgctagtaataagtgtaccggttctgcatctttttggtggcatactgtgggaaataagcttgaaacttgggatgaatgcaaaatactgatgagaaaaatatttgtgttttcatactatagacgtgctttccttgagaaatttgaacatctaaaacaaggtgacaaaactgttagggagtactttcatgattttaaaatttgtattacttatagtgatttacaagaatctaatgagaacacaatgactagatttttcagagggcttaattccaatattcaggctgggcttattaacgtgacatataatcatataggcaacttgttcatgcttgcttgcagtgttgagagcaatattttaataaacccaagggagaaacaatctatgcttgtgcctcctattactgacattttgcagggagctcagaacattcaccatgaggagaagagcaatatgctcgagatgtcatctccatcactcacgaaggaagaagagaagactgatgcacctacattatctgaagagggcataaaaggtaaattaaatggtgctgatattactcaaggtgagtgtgcttctaatgagtcacatttgtccactatccatgctaatctagaacaaattttggtggaaactacttctgatttgcctttgtcacaagttgatttacttactattccttgtgataaagaagagttgtgtgataatgcttcacttatatccctaacacaactagtgaatgaacatgctatttctagtgtttctttgtgtgccaattttaagcatgttgttcacattgctaatgaagtacaggaacgtgaattgctatcttctttaaatattttgggctatgttcagtttgatgatttttgtgagctcaataatttgaagaagaaattatttgctaagtttgatttgccttgtccaactagtgctatttttcatatatttggcgaatctgatgatagaggactatatttggtgcatagagtttacatatgttcagatttagaatctcctatacatgtggataaaacatgcaagctagagagaaatgttattgctaacaaaattatttcgagtttgccttgttttgatttgatgaaacaggttattttgaatggactgtgtgaagagcaccatatggaaaaaccgaggacggttttcagtgaagaaggggagaatgatgtgaacatggctactatggatacagggctgcaggaat

SEQ ID NO: 9693 - DNA, 4411 bp, Oryza sativa
cgggttcgcattagtataagagtatgctaacattcaaaatttatcctaaacaaacttgcccacttattttctcatctcaatcaaattacaaccatcactcacttaattccacatctctccttaatttcataaaaaaagaacttttaaaacacataggagtagtagaccttttataaacatctacgctaataaaactaagatgaagtaagatcacttcataagcaattccgtttactattttgtgaattactccctccatcccaaaataaacataaccatgagttttcgtaccaaactttgatcatccgtcttatttaaattttttaatgattagtatttttagtgttattagattataaaacataaatagtactttatgcgtgatttatgttttttagctttttcaaaaaaaaattaaataagacgaacgattaaagttgggtacgaaagcttatagctgtgtttattttgggacggagggtgtatatcctataataacctcatagttacagttaatacataattacagcatcgtgaatctttgctgatggtggtggttgctgatggtggtgcggcccgtgacgagagagagatggaatttagagctgaccaggtgatgttaggtcgtacaaagctgtcttgggcgtgatccatgtaagaggagaccagagaataagctttgcctcactgccaggagacaaggcaaatccatcgatgtgtgctccccattcaggacagctttcctttttcctttttctactcctataataaattatcttgtgtcaatatgtctgccgtatgaatgttttcagtacggacggtaactccacctggaggtgaattagcctttgtttacttccaaactttttcttcaaacttctaacttttctatcactgtccaaatttattttcaaattttgtatttttaagatgaaaggagtaaattacttgtccttttagttcattatacttcataagacaagggagaggtttaaaaggtgaatcgagtaccggtctcattgtttggtttattcgtggaataagccaaacgtatattcacaaacgagaagtaattggtaaataaaacttttatatacgtgttactagaaatctaaaagtaaaatgctaaaaaataaaaaaaaattaaaatcagctttaaattaagattgaaaatttaaattttaacggataagtataaagcgaaaagattgagtccctacgatttttgtcccgtgtctgaaaaatcgaacgatatgctggccaccatttgctactaccatgcacattaatccatggaaggcatctctcggttgctttccattggctggttgaccacatgacctgacctgacctgcctatacatgttgtaccactacaagtaccgggtatcttggcttcttgctgttgagtttttttttaaaaaaaagaaaaataatttgtagtagtactatctttttggtgatgagttgctacgtggccatttgaccttgccatgtcttttcttcggttctctagctagtgcttggcacttgtcgctgtcgaggtttcaagtagaagtatgggtgcttacatatacaagtacggagcaccatcatgtactcatgtgacgtgtatggtagtacaattactgctaatctaccactctaataattaatcatgtttactaaagtgaaaccgatttttctaaattagttggagccagtttaattcgggctttgagtctatggcctcttttcttagaaacatgtataaacgcaggcgctcacaacacacgtacactcatccctataaacgtacatacgcacactctacgagcacctccggaaaactggaccggcatatctagagattgacgaagtcaccactagcgtctcgctgttagccctacccctataagcacttccggaagactgaaccggcatatctagagattgacaaagtcaccactagcttcgctgttgaccctacccctatgagcacctccgaactggacgggtatatcttgagattgacgaagtcactactggcgccttgctattcacgggtacatcgtctaccactgaaataataattagccgtaaatgcgagcactcgtatcaaatttaggatttaaaaccgggtggttccaccacaaggaacctaaccagttgagttacgctcacttcacgagtctatggcctcctttgaaatgcgggaacaagaaaaatacatgaataaatgttgtaagctatagaaccttataggaacccaaaacataagaatttagaaaattatgcctttggataacttgtatagaaagaaacacatgaaactagggagaccacatagaatgaaataaagagtatgaggtatgaggtcgtattaatcttactatggaacaagacatagttatagctagttaaaaacaaattaggtaggtgattaaaatatcactgtacccctcattgatatggagagaataaaatgaaggaagtaccattgttttgagaaaattcaagaaatatcattgaggtcttacctcacattttcttctttccgtgtcttgaattcctacgtttttcctgtatggctatcaaacggtagttttgaaactttcttgtgttttcaaatctcttagaaatccaacggacataacatcatatttctatgttttttctattctcgtgtttttgacaatcttacattttaaagggggcccttcattatgtttttcatatgctccatctaatgcatactccttcagtccaaaattaaacaacctacgatatgataaaacggtgtgttctttgagtttgtttcgtattccacacgcacgctttccgaagtattaaacggtgtgtttttttaaaaaaaaattctataggaaagttgctttaaaaaatcatattaatccatttttgaagtttaaaaatagttaatacttaattaatcatacgttaatggctcatctcgttttacgtatctctcaatcaacacaaaagttgatttattttgaaacaacgaccatttttcgatactctattctacacatgactttctacttatattcattcatgtattttttattctacttttacgtttttataatcctgtgtctcaaataaccaaaatggaatttttttctatggttttctctggagctagccaagccgaaactacattcggtggaggggtctcgcatgagagaaggcagggcagggctgtgtgtgtgtgtgtgtgtgtgtgtgttgagctcgggcaccgatgaaagagcggcgcacgcggcggcgcgggcaccgaggccacactgatgaagaagcgtgccaactacacaaccgatgtagtacggtttagttgtctgaccaaaatattttcaagtatatggacaatatataaaaatatagtattaaatatagactaataataaaataaattacaaattccgtctgtaaattgtgagacaaatttattaagtctaattattccatcattaacaaatgtttactgtagcatcatattgttaaatcatagcgtaatttagcttaaaagatttgtctcataattagttattttgggtgtgtttagttccaaagtttttttttctagacttccaactttccattccatcaaacctttcatacacacaacttttcagtcacatcgtctccaatttcaaccaaattttaaactttggatcaatctaaatacaacatttatctatatttaatgttccataaaatttttagaagtttgaaaggacaataacagaacaggagagctcctcggaatccgaccacctctctgcactagtactgcatgcgtcaccgcgccggccaccgttaagaacaggtacaattgcgtaagctataagcctggcttataaacatattttaagtagataataaggagagagaagagtagcgggctacagatttgtagccagctatagcatggactccaagatgcagtgtgtataacagatgggaccatatattaatagtgtagtatataactattatatgaataaactattagattggctatagataaattggaattaataattagctatactattagggcacccacaatggttatctataggctctctacaagagatccatgtcagcatatttttctacttggaaggtattaaatgaagagagagagcaaagctatctactaacttagagatagtctatagagaaaaacgaggcaatgcatgagagaattatagataccaatgtagacatactattaaggtggtttactattaattgagtctattgctgagatgtacatgttttatagatagcaacttactttaccattgcgggtgctcttaaacttgctctaaccgctgtgcagcgacagtacgtgcgtcagtgtcatccaactcctcgccgccggctggcgaaagcctagctacgaa

SEQ ID NO: 9694 - DNA, 2329 bp, Oryza sativa
ttcatctccatcttcagaagattcaaataccatcttaggtggtgtttgagccagtttggataatggattaagagaaaaaaaatcacctatcaacatgattctcttttggatattagaggttagtcgatttcttctgccttccattatcatctccctctcactcattttaatattttatcgtaaccctgcactcattttgctaatcacaatcccaaccctcttaacatactataaaaaaaatcatagaacaagtttaataatataataactactagcttaaaaaattaaggcattatatatgaccaacctaatagtttactcatggaatactaagtaatatatagatatagacatattgtatcattaatatctaacacacttatctctctcacacagtatattgaagtttgtgctgtacggttgactataaatttagagctcgtttttcttctctctcctccacataaatacaagtatgatgtgataacttgtacgcctcatttatacttatagtatcagcttattgtacccgctctttttttaaaggttaagcaactgatttctcctttgaaacaacagaattttagaatgtttcttataggactaaatggctaaaactctcgcaaaaatcgtttaaattctgtgcattggtatgatcatgccatgaggctattgagggtgcatgcaaacagggtgactcattagcacacgatcaactaagtattagctataaaaaccttgaaaaatggccggtttaatatgtttttctaaaaataatttctatataaccttttttaatatacaatgcttagatgttcggaaaacgtacgtgcgaaagacgagggagtagaaattaaggagcgtgtactacaaaacacaccatgagcagaccatataaatatgttagtgccaagacggtaagtttggcatgtttgtatggatatactctaagagcaagtttaatagtatagccaactactagctttaatttatctataaccaatctaatagcttatccaagccaactactagctttaatttatctataaccaatctaatagcttatccatacaatagttacatactacactattaatacctggtcccacctgtcatacacacactgcgtcttgaaatctgtgctacagctggctataaatatatagcccgctgctcttttctcttcttatttatcttcttaaattatatttacagctggtttatagcctactattgtacctgctctgaaacgtttatttttatgaaaatactaggatgaacggacgagcacgctacatgctagtatactactagtagtgagcattgtgtttccacgatgcagagctgacaaaatgattagcaaattatcaccaatgtgtcaagtggacgcaacacacacgtactagtagtacaaaacacacaaatggcgtttgatgatgaggacgtcgatcgaacaagctagcttacagaagacatgctccaggatcgatttataattagctggacaaatcgcgggatttccttgaacatcccaactaatcgtaccatatatcctagctactcgatcgtgactaacatcgtccactcgtcttgttgagtctttgcctagggtctttcggaaaaaaaaagtctttgccgagtggtacatcctcattcaaagaatcaactttaggtatgattctagatccaaatttatccttagaaattgattctttttcaaatggagatagtaacatagtaattcctccgttctaaaatataaacatttttagaaaagtaacaagtcaaacattttttattttaaccattaatagggaaaaaaaatcaatcatgtaaaattgatgttactagatttattattgaacaaactattctaatatgcaacttttttatttaaaatatcttacttttatagatattgttgatcaaagtagcatctcggagaccatatgtcaggataaaaaatacttatattttggaacggagggagtagttgtagtatgatggacttccctagatacttaatactattatcagtttcggatatctgtttagtatacagtcgcccgaattaaataatactagattcttaatttttaagagcaatttagaaggatccactattggaaaaacataagaagggtgagattgctttttgtcagctccacaactaagctatttcagacattaaaactctgccaaacacagagatttgaaactctaccaaatatatatgctaactcaagactgtcatactatttccacctatatattcatggttttatgataagagggagagcacggaggaccaacgtatatcttcccgaca

SEQ ID NO: 9695 - DNA, 2376 bp, Oryza sativa
  unsure (1)..(2376): unsure at all n locations
gtagactaataacaaaacaagttacagattccacctgtaaactgcgagacaaatttattaagcctaattaatttgtcattagcaaatgtttactgtagcatcacattatcaaatcatggcgtaattaggctcaaaagattcgtctcccaatttacatgtaaactgtgcaattgattttttttcgtccatatttaatgctccatatatgtgtcaaacatttaatgtgacggaattttttgaagtttgaagggaactaaaccctgccactgttaaaaaaaacaatattctactagtatttttttttctccaatagaagaactgatatttttttttgacgcacttgaaaaacaccagctgctttgctagctgagcaaccagaggccagagcagcagcagcagcagcagcagaacgagagccgccgcgccgcgtgcgtttcgtttttttgctttcccactcccgagacgccgcagagcgcacctcgctcttcgtgctgctgctgctcgcctcgccgccgccgccgccgccgccggagtagccgagcttgtgtgcgtggttcatctggcaagagctagcgccgaaccccgcggcgccggcgcggcggtcgtgccatgcgtggaggaggaggaggaggaggactctgaagtgaactgccatggcgagcatgaagcagcagcagacgccggcgagctccgcggtgaccgcggcggcggcggcctcctcctccgccaccgccgccgtggccgcatgcgaaggtatactgcttttttttttctcttctcctcgctcgtctggtggcggtggctgacgcggcggctgcggcggtgcaggggagcggaaggcggcggcgatcaactcggagctgtggcacgcgtgcgccggcccgctcgtgtcgctgccgccggtgggcagcctcgtcgtctacttcccgcaaggccacagcgagcaggtcatcatcatctctctctctctctctctcctcttcttccatcatcgacctagtttgatcgaagacttcttcagttcttgctgtttaatctctgctgtattttggatgctctctcctctcctctagtataatgttaatctgatgctgctgctcatggcaaggttgaaaatttgtggtcttttttgtgcgttttgaggtgaaactctcagatttctgtgggttgttcaatgggaattttttttcttttggttaattacagaaaagaacttttctttatttctttctgtatgtactgttgcagtgattgatacagtgcaacgatccttctcagagcaaatgttttacttacaccccaaataaacttttggctttggatatttgatctcctatggaagataatttttttataacaaaagagttgaagagtatttctcacatgatgcattgttcactgctaatgtatgtgaggattttacttgctagcagagacatctctgcttgtatgtagctactaataactgtacttgttcattaccaaagtggttgggagcattgggcctacgaggcttcccttttctgttgccctactagtatggtgagtactgtttcgatgttaatgtggtttggtctccatgaagcatcttatgggatttggatttcttgcatccatgaccctgagatggatcatttctagtccaaccgattgtaataaataaatactcctacttgttttgagaaattttgtcaaatggtaaggtatggtgctctgattgaaaaaataaataattaattattaggtcaatagacagtcttgggaggactaatcctgcaattattcgtgcatttctttttagaaagatgagaaaaaaggtcctttttcatgaatgatatttggttgcgctgcacatgatggtaattgtacttatgcgagtttatctaaaaaaagttcactcatgaaccgcactttctggactggacactacgaaacttcatttttttattgaaattttgttgacaggtgtacaaaagtaacatagtatgtttgaaaggttgtactttcttaaatttttatgagatggttatcgagtgctagtttacagagtagtgcagtagtacttttctttttccacttccatgttcttgagcacaaaaccttttttttcagtttgaaaaaagtggatgttgatccacatatactggctacttggttcagctgactgcatttttcattgtttcagatattaagaaatgctttctccatgctattggaaacagcagaatatctacttaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9696 - DNA, 1740 bp, Oryza sativa
atagctgtctgtttctttgacttccaagcaagaagagaagatcccaggaagatacaatagccagtaatagagcatcgatcaatagggtcacttgcccaagtggaatctgaataagcttgaagctctaatgagctatcacgggagaaaaatataccacgagatggcgtcccacgtagatagcggagcactcgtaataggtgagcataatggacagatgtaggggcactagtaaattgactcagaacatgaacagcatgtgagatatccggtcgagtaacagcaagatatacaagacttccaacaatatgtcggtatcgagaaggatctgaaagtggattcccatcagtaggacgaatcttgagatgaagctccataggagtggcagcagttttatcatcacttagaccagagcgagatagtaagtcgagagtatatcgatgctgagacaaatgaaaaccattcggtgttgaagcaacctcaatgcccagaaaatactttagtggtccaagatcagtcatcatgaattgctcacttagacgttgcttcacgaaggcaacatgagaagcgtcatcacccgttatgatcatatcatcaacatagagcaagagaatcgtacgacctcgagaagaagtgtggataaatagggcagaatcatgctcactagcaacaaatccagcttttagaacaactgagctaaagcgctcaaaccaagctcgtggagcttgcttaagaccatataaagcacggcgtaggcgcaacacatgaccagatggacatgtcaaacctggtggaggctgcatgtagacttcctcttgcaaatcaccatgaagaaatgcattcttcacatccatctgtgagatctcccattgacgagttgcagctacagctataagggtacggacagtagtcatgtgagcaactggggcaaaagtctcatcataatctcgaccatattcctgctgaaaaccacgagcaaccaagcgggccttataccgttcaatagatccattagagcgagttttcaccttaaacacccacttgcaagtaattggaacagcatgatggggaagaggaacaacatcccatgtacccgtgcgctctaaggcagaaagttcctcattcatagccaatttccattcattaattgtaacagcctcttgatatgtgcgaggctcctgaacaccatcagctattgcacaactgtaacgaggatgtggcataattttactgcgatctcgaagaccatatcgtgctgcaggagatggtgatgatggtataggcatatcatcaacaggtagctcattagaatcatcaagtgggtgagagacaagggaaacctattgcttcctagcagattcggtaggcagcagcaaagaagattgaggacaggggaaacttgccggcggaggagaagagattattagcagcagagcagatcgctgatgcgacgtccaggacgcagctccggcgaatcccaggcaagctctgataccatgttcaacatttgggggagatcacgaaaatgtattcagcagtgaacctagatggtagtgaaggttatatacatatacatgggccaaatgggctaagtgggccaactgaaccaaaacagaaatatatatatggtgtatacattaacaataccaaagatgctctctaccgaagaattcactaaacaacctttcatattttcatctttatttcctaaacctaaactcaactttttagtaatggacacaa

SEQ ID NO: 9697 - DNA, 13442 bp, Oryza sativa
  unsure (1)..(13442): unsure at all n locations
tgagaaatgactgaacaaaacaaatatagtattaggtctatccaagcactaaacatgtaaatgagttaaaatctggaaaacaacgaccattaatccagacctacctaacaattagaatctccgaatcgcggtgatcagtgaaggcactcatgaactgatgcacaatatgcccaagagggtatatttcccaaacctgaggtcagggtgaaacatttcgtcggagaaattagcacatgttggcatacaaactgccaaaaaacagagaaaggggagaaagaaacaggacacaaataaagaaaatgcttactcgaaccatctccaatattaagaaaacggcaaatgtgtggcatgatgtgtggcatggcgcatgccctttgaaaatttgcttcccaagaatttttgagatttgcaatcaacaaaacatcttagttgctgaggtctctgcaaatgctaatgctctcactttcagaaggtcttttggggagagagagtctgaggaatggctagctattggggatatcattaactctattgagttgtctgatgacccagatgtgttcctttgggggcttgataagaataaaacttacacctctaaatccatgtatagagcaattctctttaggggagtgactgacactagaatgcagggtgtgtggaattgtccctgtcctgaaaaaattaaacactttctatggcttgctttgaaaaacaggatacaatctgctgaacagctgaagaaaaaaggatggaagggctctgagttttgtgtactttgtgggatgcttgaaaccactgatcacattcttttccagtgtccaatggcctctttagtctggtgcttatgcagagatgcttttggcttggagtattatacctaggtcttttgaggatttcttcctgatcaatggctctttgggtggggctgatctgagagttttcttgaccctacttgctgcagtttgctgggtgttgtggtccactagaaacaacatgatttttagagaaaaattagtctactcacccctatcattaatgttccaaatcaattcatttttgcagctctggagaatccttagcagcaaggacactgagaaaattgacaagatttttttttttttttgccgggtcggccgaaggaactggcgaccaaatttcattaagattgggaggaataaaatcaaagtacaagtagttttcgcttgcaacgacaggaggctgtcgaattagactgtggcaggaaccacagcccggcaaactaaaaaactggaacgccaacacaacagaaagaaaactaagaactgcaattctcgaaatagcctgcttctttccacactaagatctcttctttgatagcctctgctaactggttagggcttctcgatctttggtcgaaaattgacaagattactgggaagctcatggatgctacttcaactttgagacaaccaagatctggagttggctgatcgtctgaagtttttagttcttagtcgtttgcttagcttgagagtttgttaagcctgtcttagagttgttttgtttccttttagtgctggtcagcttttatcccccctaatggtgttaattctggacctttcctgtgtgtgatgtaaaatgggtatcccccataacgatgccgtgtttggctttctataaaaagccgggcctaatggcctcagtttcaaaagaaaacggcaaatgctgcaccaaatgctaagcccaagaaatcaggcgcaaagagaaacaatttattgagagtgtgtttcaaacaatctgatggggatcgaataaggaaaacatacaatacctgaaatattattgcaggagagaaaattaggacagcaacgggatggtaatacttgcgcaaaagaatcctctccgttttgctttgttttgatatactgtagaaccttctaattgatacatatatcacaaatatccagtatgcgcataaagcaagccgttcacgtgaatcggtgaaaatatagttaaaaaccctgtcaaacaataaaccattaagtgaaccaaaattcaatatgtacaaaaatgcacaaggtttagaagcaacaacagaaagaaatttttcaatatttgactaacagatttcgtgcttttatgcccttccaatgaaatgcaaacttatatgctcaccaaacaaatggatgcacttcaaaatcttgaataagacgcgtccatgatggcactaacaacaatagtgctaccaacaatgaaacataaaatacatcacagtcaattctcttctgtgtgcattcctcaactgtttgtgttctttgcctccccagttttctacagtaagccaaaacttgaacggaacttttgtataacaaggggagaagaaaaggaccaagcaaaaccccctgcagaaaagaaaaaaaagggaagggtattatgcactaagaaactgaagccatacaacgcaataacttctacctgaataactgtgcctatctagcttcgagttccaggtgcgcgaataaatgcttctgatgatacggagaacttcatctgccagcagcacggttgcaaacgtgaaggcaacaaaataagtatcagatttgctaccattttgctggtaaaacatatatagttcaaggaataaatcacacctttgaaagagtatgagccagcatatcaccacagtaaagaaaaagaccacttgagaccaaaatggcctcccctaagttcacacaaaatgtaaagataagttaaaaaaaaaaagcaattgcttcaagtcatgatgaaaaggagacatatacattgcatcggccaataggaacctcacaaattagctgaatttaaattttaaaaaatgaacagtgtagatataatgcactatgcctgcatggaaactggtaggataactagaaatcgtatggatagctctaaagtataaacatatgccgtcagatatacacaaaaaaactttatctaattacatcttagacttcaggtacaaaccaaaagatgaacatgaagggaacttctctagaatatgctggattaagatcacagcagccactccacgacagagcaaatacaccaaattactcatcaccagcagatctattaagacaaaacctagattagtttgtaattccttgcttctgatgaacttccaccagattttgaaaagaaagggtgagattatatctttgcatgcagataaaatatgcgtgtacctccatcagtcttcagtaaaaagtggaacaagtatgccaggggatataaaatgatgagcaacgagccgtatttcgaagctatagaatttccattgctgggagactgccgtacatgccaaacaaaaaatgctaacacgctgaggcagctaacagatactgcccagtactgcatttcaaggtatgcatattctgacaatgaacacatatagttagtaaacctgatgtgttaccgaaaatcttagtgtcaaacaagatttgaaatgttgatgaagacttaggaaaatatccatttagtagtggatctgataaatttgataaaatagaaaaaatggataccttctcgtccattaggatctgctagtaagaccctataaagttgaattaaccgtgaaagcatgacactaggcagagtagtggcgccaagaagtatgcctgatgaagcacctggcctggatcaagagcatcaagagcatcaagccaccacaagaaggtgaagttttatgctattcctcacaacacaagacatgacgaatcttacggtaagcaactaggattgcacatcacagaacccatataaatgacagtgggagcaacgtttttgctgaaaatgcaatggaacagtatttgtgaaatgggttaactaagaaatgctgaagcccaattattcaagagtgatatttgtcccttggattcttggaaccaccaaaacctgaccattttgcacactactgaaccaaaagaaaatccactaagcctcaagtaaaaataaaatcgcattcctgctgtatgctgaatccgactgatgttgtttccccaattgcatgatcctcacagggaggcaaccagcattgaagcaacaaatggatcaattcacctggtcctgaaccggcgggcggagcggggatgaggacgtggcgggggagccatccacggcgagctcgacggcgagggcggccgcggcgaggaccgcgggcgacgaagaggaacaacgacgagcctatctggatttttcacattttggtccttttaaaaaatttatttcgcaaatagacctaaaaaaatatcctataaatggtcatttttggatgccagagtggctggggccgtcgtccaacaggacagcgccaacctctctatcgccgtccccccgccgatgtggaatgaactcaaatggacggaatatgtaacttgtagaatttttcctttcttctcctctcttcgaagtgcagaggagagagttgtgtaacttttttattttaattttaattttttgatattttttgcacgcttaggaacacaaaagaaccaaccatataaaaaataaacttaaacggatgaaatatgtgacatatgtgaaattttacaaagctctactaaaaacatgtctcctcgaaaatccagacgagcctctcgcccgagaccaccgccggcgcacgaacgcgactacgctagcctcgggttcggttgggtcggccgccttggtggttctgactgacagctgggtcaaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccaggcatagtaataacattactaatacagactctaataataagacaagttcacaatctcgatagtagctttataacatttttttgctaataatacagttattgggacagcagtaatactatgttgatcattttctcttcagagcggagaggatcatgcaacggcaacaaagtgtgacatgcaggacagatatcatctccttgggatcttttaatctaagggaactcctcagcaaaccgggtcaaaataccctgaacacaaaaccagtaacaaaaacgtcagtgcatcagaacaggtagcaatttatcattacattacacaagtaaacaagggggaaatatatcctaaacattgcacccccttcagaagcaacaagcctgcaaatacagaaaaaagaaatgcaacttcaatgaaaatgcatccatcacaagtaaacaccataaattgaatatctgctaactcaaatatcactgagttcaagcttcacacgcatatattgggtgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatggttcatatgataacaataaccaaagcgttggcaccactgaaaaggagcaaacagaacaaaacagctgttggtgcaacctagtccattcaatataggcagctcgtgatagatgttcactgaaatcaagtaaccaagaagaccatacaattctagcatatcaatgtaaagtgaattataaaaagctgagctctatttccaacaggtcaaactgcctaaggcctaataacatacagcagcccaggctaaggatgcccatttgttgaggaacagtacaaactgataaaacacttgcaaggacagcagtaaacgaaaaggaatcatacatgcgagtaatgcaatggttgctctttagaaaaagagagcacctgaatgaacaaatgtgaacccatgatacaatatcacaacttacttcgtaactaacagcagaagtttcaataatatttgccacaaaatttaagtaaaataataggaaagaaacaacacttacattgaacagacaaacatcgccagctctggacggctgtagatattatccccatcgtcatccagtgcaggataagcagcaacaagcgcatcttgtgcagcaatatatagttgagttgtagattttccaatatacttcacatactttccttgctggatggaaaaggccttgaaggcagtaattcaagatcacagctggaccaagagcaactctcatcccctcaatcgcctccatgacagcattgatgacatggggagatgtctcaaatatgtttggcaccaagagccatgtgcttcacagcagaggcagcagtttgccagtgaacaagatctctgtccattagagcatcgtcaaccaagggagtaacagcatatatgtaatccttgcccatctcaccaatatactcaaagaggaaagagagagacttcaggacaccattctgaacattgagttctgggactcggtactcattcatcagggcaggcagaactgtaaaaggtgagcaggtttcagcaacaatggcaatcgcgacagtcgtgcagacacggttttgccgttcctgcaccttcaagtaattcaacagagtagccaacacatcctgcagcccaatagccttcgcaatataaccaaatgtgttcacggtggctcttctaatacccttcttgtgagccttcaacatttcaagaagctcaaaacaaatcctcatccactccctagcaggcacaaattctgctccacgatcagcaatcctaccaactagatcaatgcagttctcctggaccttttcatgcctgttcttcaaaataggagtcagtcgaggaagaagattcttgatcagcggtgtcatcttagtcatgccaatgacattcacaatagctttcagtgctccaagaattgaacccaacacctcagggtactcctctcccaaatactcatacagcacaacacccaagtgacccataagctgctcctcctggcaatgtttcattacaatggctatccttgagatcagatcagcagcttgctgcctaacttttgcactcttgttgttcaaccgccacttaatggtaccacaaatctgaggaaggtaaggcttgaccccctgtcccagtgcattgacaacagccccaaaaccattaagcatgacatttgcatcgtcacttgcctgctcttggaaagcatacaagatgccatcaataagcagctcctccaaacgagcatcaatatctgaagcacccaaattagccactaccttctcaactgtttccattaccattctcctgtaaggttcgctttcatctttcagatcctcaacaatcctcccaacaatatcagcaactccaaccttatttgccatctctaccgttgtttccacaagctgcttatagttcctgcggtccagagccattctcctaacccagaagtgatggaaaaattcaggaaggatgtcattccagatataatcagcctctacaccctctgtactgacacactgtttaacaaccttcaggacaatctttttcatctcttcatctggtgactggaactccctaatcaggatttgcatgacctcctttgtgtagtaactggcatacagcgcatccataagagggatgataaaaccaattgctttcaagaaggcagcaagaacctttccacggttagatctgatacccttccacagaggcttcaaaacagtatcaaaactttctataccatatggtgcagcagcctcagcaagtgcagcaagagaaagggcagtgattgtcctcactttctggttctcgtcactaagaccatgctcaatgatctcgactacggactcgagatgtggcagaacagcgcagcccataagaatagcaatctgctgaacaatcttgataccagtgtgccgagcttgccaagacttcttactctgacagacagcctttaagaatggcaggagagcagggatacccaaagcagaagccaccacactaaatgctctagcagtggtatttctcacatactcatcaatgttatcaatatctggtctcatggcggcaatcatagtagcaagaccagcagctttgctaagatttgagatgatctcccggccctcaacacgagcgtagtagtcctcatcaatcagaagtggttcgatgaccacaagaatcttgtgcacaaatggacggactagctcatccagcttatacagtaccctgtcaatgaccttcactagaagatgacgctcctggtcctcaagtgttggctgcatgagcaagggtagaatcttgttgaacaatgggccagcaccaaattcccttgctttgtctgtcagctgtcgaagtgctgtcttccgctgtgggggtgtgccattcttcaccttgagcaggagcttcatgatcttcctctccttctgctcttctggagatagctgctccccctcctcctcattcagcaatgttccaaagtactggtaatcctctggcttcatgaagggcaacccaccaggcaactcctagggcacatcaaactgctgcccacgattctcctcaggaatagcatacaatggtgtgcccaatggtgtcggtgtaacgagcagctttcttgctggtgtgcgtatgggctggtatgaagcaggaggttcaagaatcttgtacccttcctgagggaacatagtatcaagctcctcatccgtaagaggcctgttccgctcctcaatgtcccgctcccaccgcaagagctggtactgctctggagtcattggaccacgagaagcaatctggccggggtgttggcgtcgcaaggttgtcaccaccaaatggcgtcggaccaggagtgtaacctgcaggcgtcgcagcaccagtgcctccaggtgtagcactacccatactagcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaccgattccttctcaccgacggcgtcgcatccccgacacgaccaggggtggcatcccagcgcccaatcccaggagttgcatcaggagcatcccaatcggaggaggtcttcgccttcttggatccagaagcagcagaagcatcaccatcttgcgactgatcccatctattgctgcgccgactggctgctgctcaggcaaggccttcttctccttggccttctcctcttccttcttcttctgagctatatcacgcagcagctgctccttctgcttctgcaggtcattctcgcgcatggcatcagcataggtccgcacggaagggtccggggtggcctcaccggcggcgaagggatgtggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcggaggcggggatggaggtgtcgtagccggcgaagcggttggggtcggagccgccgccgccgtagagatcggtgtcgaaggtgacggaggagacggccatgggcgcgccggcggccagggcctcctccatcttcttgcgctcctcctgcgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatagaaaaatcgttttggatatgcatcattctttaaaaaccggtttcactgtaatatcatttttaaacgcgagcattcgctataatattgttttctttttttattgcatttgcaaacatttttgtccaaagcatatgcaatctctctctgaccacgtactcatgatcgagaccgagccgagcgagaggagagaaaggcgagggaagggacgaccacattagtatcgtcactcactagacacgttgccaccttcccccactatccacgaaagatgtggtgaaaggaggcaggagatattgctcgagtaggttgctgcttcttgctgctcctacctctcttgtctcatggcgtggcatgccactgggcttctccctctcgccaaagaaacagacgttgtggtcgtctcccaacaaaaccttctccatctctttcacgatgactctaatggcaccacagatgacgagggagggggcgcagtcaagtaagacggcggagcaggttgtgggcgacgccgacgaggttggggagggagaagtggcagggatggtaagggaaggtggctagggctataagtgggtcagccgcgaacccacttataggtcaaaataagcggtttcgcgacttattttagcctataagtgggtttcgcgggttagccacttatacccctaaaggtggcagcgcagaagacaaatgaggtagcgcgactcagttggggaaggaagtgacgcgctcggttgggtaatgcggcggagttggtgtaatcaccccttcattcagccttctatcctagtattgctcagctcggtctcgatcgtgggtgcatggtagggctgtcaacgagccgagctcgagcgagctcgtctgcccaagctcgagctcgacacaagctcgagccgagccattgcaccttcgagcttttaggcaagctcggttcgagctcgagcttggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatataaactatacacagccaagcttggtcaggctcggacgctcggtagaagctcgagctcggctcggttaagctcgcgagcttttgctcagactcgagttcagctcgtttggagctcgagccgagctcgaatcaagcctaggacgagtcaagctcgagctgctcgtgagtctcgagcttttttgacagccctagtgcgtggtccaaagagagagattgcatatgtggtttggttcaacaacagtaaggggcaaaaacgtccgatgaaaaaatatttgaatgaaaaatattttgtaagtaaaaaaaacaacgaaaatagcattgtgtcgaatgcttacaattaagactgacatctaagcgaatcacacgcaaaattcttaggcactaatgtgggaacgcgaagtaactaactggttaatttagtacataggagtatttaggatggattactattaaatccccaaaaccccgcaccaccgcgtctcaaaaaaaaaaaaaaacgcaccaccggcgcggtcggcctcgccgatagagaggccgcgcgcggagggcgaaatgtggaagaagatcgcggccggcgcggcggaggggtggcgcggtctgctgccgaagacggcgtccgccaccaccaagctcgtgcccgattcttctccaaagtcggcgacgccgaccgcggcgctcaacctcgtcgccgacgcggtggcggcgtggcgccgctggcttcgctctccatcagcgagtcccaccgcgaggtgtgtataccctcctcatcagctgccgtggagggcaccgccggagaaacaagcccccccgtctccgacgcagcgttggaggtgtggcgtcgttggctacgcgcgtcgacgcggcgctcgctctcctcgttcatggatcaagcttcgtcggagactcacgcgcccccaccaactccacggccgtctccaccacgtgttctcccgcctcctccattgtctgctgcacggagggcgaaggggtgtcgcactgctgcttcgtcggcatctctgtcacgcaactactcgacgtcgtcgacgaactcgtagtcccctccggagccccgcgacaggttaactcttcagaacttatataaatgatgcttcctctagcgatattttctctcatgtccttttaatttgtactctccaaattgccccacatggttcatggcccatgtccaaatctgtggtgcaaagtcagacgggatagactaggcacccattatatgatctgatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9698 - DNA, 1006 bp, Oryza sativa
tgttaatgtatacaccatatatatatttctgtttgggttcaggtggcccacttagcccattgggcccatgtatatgtatataaccttcactaccatctagggttcactgctgaatacattttcgtgatctcccccaaatgttgaacaggtatgatagacttctgagcctatctggaggcaacaaggcatcaatgtatcatggaaggtatgttgtctttcagaactagaacttcttctgcaggtggtgatacctgtttcaccccacaactccacaagcagttgggcaagaatagcaagctgagagtaaagccatatgctgcaaggagcctgaaatacggagacttgttttagagaatcagagttagtatatgcaaaccttatttccatggacatgcgaagtgtaattagttgtagtagctcatctcctgtaagttttgcgtcatcactgtacggagtaaaagatcactactcagattgcaaccgcgcattgatgtaaattttgttcttgacctgagaaaaaatgaaatcgaagtaagtaaagctgcaaattaatgttctcttattatgagattggcaggtttgcgatgtttgagttgtttatgtgatctgtttatctatcaggatacctccacctgccgacttgctgtgtcaagttcagtcagatgatccttgcctaattgtctaattgaacaaaagttcagtcagaagttcaattagacaatggttgtgcagattctcacatcagtagtctttaatatggtattctaagtagttttttttttttttcaaatcaggctgatgaaaataattcatgtacttaggctgtgttcgtaggggatgttcccaaccagccattagtgcacggaaaacggaatagtccattagcgcgcgactaattaagtattggttaattttttttcaaaaatagatcaatatgattaatatgatttttttaagcaacttttgtatagaaacttttgcattgggaacagtgaactacatacac

SEQ ID NO: 9699 - DNA, 7787 bp, Oryza sativa
caccaatttctttaaacaattttacaagtgccacatattctcatacaaatattgctagacctatttttaatggacatattgcatttgctagtgattattcaaataattattcgagatctttgaattacgaaaataatatgtcactgcctatgcaaagtaattcacatactttaaaattcagtaatgctagtaatatacaatatatacacacaccttttaattcatcggcgattatttcacaacctactgttacacaacaaattttgccgatgaaagatatgtatggccatgacaatattaattatccagttgattcttttaattcattgcatggcatgccaagtatcggtcagtcacatctcagtcttatgggtcaccttatatagtatctagtggaaataattcggcttcatatgctagtagcgattatagccgaattaatagtagttccactagtgattttgtacccccacatagtttgccatcttcaaaatgtcaatcaaatagtactatgtatatggtcaaacacgcagagttcaaattgtgtaaattcggttgggggcaaactgaaatacctatgtcaaaaattgccaacattgatcaagagcacaatttcgatctcgacaataacactgtcacactagacgatttatctgagggccaacggtgtgagttagagcaggaagtcgaggtagaaattgcagagctaagggaacataaactcatacgcttgcagaaaacaaagaatagtgttattgcgaaacagcaaaagccgataaatttagaattatcggctaatgaaaaggaggtagctatgcttgatttatctggaaacataggaccttttgttttgccagctgaatttcgtgccaaggaagtggatgaacatctagacgatggatcacgaaatcgcgacgacaaggcggaaatattggagagccatcaatgaacgaacttagacatcattcaagtgaaaaaatcagaatgcttctccaacacattagataaggtaacgtttacaggtaatttgcttatttctcaatttgatcatgcttctgaaaataatccatacattaataatgtcaccatgaataattctaacagatcgattggggagattaatattcttgttggcaataataaagtgtttaaattttctatttcatcattgacaaagtttatgtctacatggtttgcttatgatcaatctagagctagaagcacaaaattaaaattggtgctgatatagcagatagttctaaatcattggacaagggaaatataagcgacaatgtagccgaatgggtagatagtaaatctgaaccatttgtttgcttagctttaaaaccgtctccacaaaagtgtcggttaaaggaaaagaagtatacttttgattggagtatgtgtgatcatatttttgatgatttgctaaagaatgattatattaaattgccggatcatcatgtcatgccatcgcttcaagatttagaagaacaaatttattgtaagtggcataattcatttgatcattgcactagtgattgtaatatttttcgtcagaaaatacaatcagctattaatgaaggtcgattgcatgttgcaactccagaaaagtcacatgccatggataaccgatttgataagagaaatcggtctaggtggtctagtagaaagaagtcttcggtacaggtgggaggtagttcaacaaggaagcaaatctaggtgccgaagtctagagttcaagaaaagagcttagctgctggtgcatgtgtgagtgtacaaaaggctttagtttagaaaaaaggttattgaacctggggggcatgcacgtgtacaacagctagaaaatgtacatcatgtgagtatgaagtgagagacatcttcggcagagttagtaacaaatcaggatccgccgaagagctcggggggcaatggcagccaattgagacattcacacagcttgtcgaattggcagaagaagcagctccacaagctaagtgtagaaaagctgagggagaaaggtatgtcatggcttcctaaaggaagtgttcaggtgcagaataaaacagatgttaaagttaaagtggaggcaaagaatgagaaggtagataggaggtgtgtgccaaatcaacggtttgcatcagatcatcaggttcttttgccaccatattatatatattcttcacctatgcaaccgatgcatatgtcttggaatcaattctcaggtatgtaaggttatccttcatggtcttattatgattcttggatatcatatgagtctatattatggagggatgttaccatatagttttgtatatttactaataattgtagatgttgttatcaatttttagagaccgaaatatttgggagctagaaataactgtgatttttttattttttttataatttatttcggtcatattttgtgcaagtcggcaagatgttggtactgttttagttttgccaaatagtatttgcttatgagacatcggtttatttggaatacccttacactttagaccgaatacaaggctttgttattcggtttggaaatttagttaatattggtgtgaggatgtagatgctttgggtgatttgctgctagtagtccaccaatttagttggggagtttaggattcactggtgaagaaaccatctttggtcggtcagccaaaaaccacaatagtcccggttgcaataaaaaccgggttatagctacttttttatcttttgttccggttggtgttctcaaccgggactaaagatcaatttttagtcccggttgataataccaaccgagactagagatacctattatctttagtcccggttggtggatctatttgtagtcccgattggtagcctaaactggaacaaaatatcaccatgcgcgcatgcgtggcggagaggacgaggcatgcgcgagatggaggagttaataaattctattccttatctcttccctaaccttatctcttgctcctcccatctcttcctcttcctcctcctcctctccccattctattcctcccctctcttctctttcgtcagcggccaagcggcggcggcggccggatagaggcgcaggcggtctcgcgccatggcggccagccgggcggcagcggcggggccctcgcgcggcagggcggaggtggcctcgcgccgcgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatacttcctctcaatcaataaagatctaagcagcggaaagaaagataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcatagtagggtttcatttgcaaaagcagcatttaacaaacttttgagaatttaataaaacagttaagtaataattaaacaatattaaatcaacgctatacaacataccctgttgcataggcccaaccattctgaacaaccaccccggctgcacagttctatctccaaaccaggaatataccattccaaaccaggagctaatcaaattattaccagttatagcatcattaactatggtgagaagtgtgaaactaatcacgaaagacattgttagacccgcccataaccgcgggcacggctattcgaatagttttactatgatcagaggtgtaccactgtacccacaagacacaaccccacatcatgtcaccatgtgcctcaataccaccacggtacctcggaaaggagttgtgacaatacccctcgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgtccatcgtgaactatcattaagccatcattaaataatagtgagtcataagttatcccaatagtgagctaatgtttctaagcatggctaagcaattatatctaatgtctaattgaacccatataaataaagctcaactagtcaaattataataacccaagggatcaaggaataaagtaatcaagaacaaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcataaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacggcggcggttcacgcgaacggacggccgagatcgactcgatccaaaacggacggccgagatcgatcggtccacgaccggctcacggcggacagccacgatgacgtcagcgatgatgtcaccaccggcggcggcggctcggcggctcgggcttgcatgctcgccggcgaacgacggcacggcggcgcgaacggaaggcaccaacgggtagcggacggcacggcgaactcaccggcgaccaaagcgacggcggaagaggaacggacggcgacggcgacgaagaagaagcggcgacgctcttcggcttgacgacggcgacggtgctccggcggtctacagcgacagcgaaggggcggacgaggacggcgacgacttggcgaccacgacggcggtcttcccgagcgacgacgacgtctggaacggcggcggcgcacggctggagcgacggcgacgacggcggcgctagggcacacggcgctagggcgtttccgacgacgagaggcgaaggcgaaggtggcagcgggtagaggagacaccggggaaccttttaaaggggctaggagacgacgacgaaggcccacggcggccggcgacgagaaggaaagttcgggaaaatcgaatccgaaacaaactcgaatccacgaatttccaaacgattttagccctctattgattcggccggagaaggaaaggatcggccgaattggaaagcggcggcggcggcgcggtgctagggtttcggccggaggaagacgacgacctgacaggcgggccccacctgtcagcgggcggacgcgcgggcgcgggcggctgcggactgggccggctgggccgaggagagagagaagggttttgggccgactttcggcccaaagccaaaagagactttttaaaacctttttcaatttaaattatttcttaaatgcaattccatttattaaaaatacttccttgctcaaataaatcccagaaaaatctaggaattatagaattaagcaaagtatttaatgaaattttatctggccccattttatattggaatttattaattaaaattagatcttctcttctaggcttttacaataaattctaaaaattccatttaaacaacaatttatatattttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaagcggataactcgattcctggttcttctctcatctgtttccaaaatacggattggtttctcaacataggacagatcctcttggacttctatctgttcgagattagcttcttcggtaggtacccttaaacactttttcaattgcgacacatggaacacattatggactcctgccaaagattgaggtaactccaactgataagcaacctctcctcttttactgacaatcttataaggtcccacaaaacgcggtgccaattttcctttggtgtggaaacgatgaactcctctaagaggcgtgacacgaagatacacataatctccttcaaaacttagatctctgcggcgattgtcggcataactcttatgacgagattgagccactcgcaatctttcttgaatgatctttaccttttcttctgcttcccttaggatatccgtcccgaaaacctgacgttctcccgtttgatcccacaaaagcggagtgcgacacttccgaccatacagtgcttcgtaaggagccatctgaagactagcttgataactgttgttgtacgaaaattctgcataaggtagattcttatcccaacttccatcgaaatctaaagcacaagctctcaacatgtcttctaaaatctgattcaccctttcggtttgtccgtctgtctacggatgataagcagtactaaagttcagcttagaacccatctcttcctgaagtttcttccaaaaatttgaggtaaactgactgcctcgatcagacactattttcttagggacgccatgcaaacacacaatccttgccatgtacaattccgctaagcgacttccggaataggttgtctttaccggaatgaaatgagctactttggtaagtctgtcgactatcacccaaatagagtcatgacctgatgacgttctgggtaaaccagtgataaaatccataccgatttcttcccacttccattcaggaatcttcaaagcctgcaacaaaccggcgggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcggggacacagattctctcacccaaccatacagttccgtgctcatcctccaagaaaccgatagcttttcctcttctcatattcttcttgatctcttgaatatcaggatcattaatttgggcttctctaacttgatcaattagagtgggcttcgcttctaaggctgcaacgaaacctctactgacaattcccaaatttaatctttcaaattccttgcataattccaatggcagctgtcgtccttccgtagcattgcaatagccttttctactaagagcgtctgctacaacattagcctttcccgggtgataatgaattcctatgtcataatccttaattagttccaaccatctccgttgtctcatgttca

SEQ ID NO: 9700 - DNA, 1319 bp, Oryza sativa
tggtccttcatagtgtatgccaggttttatgactttggcaaaatttcagatatgaagctgtttacgcgagagatattccagagatcataaccggggatgcatttttggagaagtatggagatcataatgatgcagtaacaactgttgacccaaaacgatcttactgtgtgaaggctcctactagacatcctatatacgagaacttccgagttgaggtttgatatcataaaaccagaatatctacacctctcgattcataatggctgttgatgagatccctgcatgttgttgtctgatgttctactgcttttgctgctttatcctcgttgtttgtatttttaaactttaaaataattctttgagatgtttgcaaatcagaaaactatcttgagagcgcatggttttcagaaccagctttattttttctccataaagaatagcttattcctttcactgatatttttgacacttgttatgcttctcacgtgtaggccttcaaagcattgctaacagcagccaaaacagttgagcaactttcggcccttggagaattgatgtatcaggtatctgtattacaaatgaaagccagcactgtacatgttgattcacaaaattagcagtcagtggcactgcattgacccttttgttttctggcagtgccactacagctacaatgcttgtgggcttggttctgatggaaccgacaggctttgtaatatggtacaagaagtcagcacaggaagacctcacaggatggtggtcctagttatttgggtgcaaagataactggtggaggatctgggggctcggtttgtgtcattgggaaaaattgcttgaaaagcagtgaagagatttttgaggtattttcgacatcgttttttattgtcagttgtacacaatggatgaccataactacaaagatccaagataaaccctccaagagagttgtgattcaccataatgtttgcattttcatggtattgcatgctaacaaaatatcatttgttttcagattcagaagagatacaaagctgctaccgggtacctaccaattgttttcgagggctcatctccaggtgcaggcaagtttggatacctgaagattcgacggcgatccacatagccatcaatcagcctaactgaagatttggctgtattttaggtccacacaaacatttgtcaggaacctgaatattacctgttcatatggaacacatatcacatcatcccattatgtagtagtaataagctctctagttcatgcaataattctagtgattagtgcacctctggtgcagacttccattgtgtaagtgcag

SEQ ID NO: 9701 - DNA, 2791 bp, Oryza sativa
tcctgcaccccagagacaccactcccgatggtatatgcgtcttccggaaagcagcggtgaattcaagccaagtgataggttcagcagtagtcctgttcagacggaagtgatcccaccattcagaggcagggccatgcaactgatgtgatgcaaatgagaccttctcctgatcagtgcactgaagcaaatccaacttcttctctatggcatgcagccaatcaccagcttcaacaggattagtggtgctagagaaaacaggcggcctcacacgaagaaattctgctaacttgttctggggaggtgcatggttatttccttggttttgctggttctggagttgctgcatcatcatgttcattagctgtgtctgttgagcaagaacttgagcaagagtgggattctctccgttgttattgttactggggccattcccgttgctgcgagtgttcaccatctggcatggacagggcacaagaagagaaaccgggggaaactacttaggacagagaattactttaacttttattgatcttaactgagtttcattattacaaactgaagactctcacaccactaaactcaccaacttcctaacactcaaaagcaaacaaacgcatgcacttacatcccactactgatgtaaatcacatgcgagacacacaagcaaacttaaaacaagcaagctaacacaacgatctaagacaacggcttaacaagtcactctagttcttccgagcatcggaggtcgattaaaggctcgttcggctcgtcttcatcatcttgagttgctacccactcaatcttggaatggttgcgcttggattcttcttcttcatcatcacttatgatgatgaccggaggatctgctagggttggggcaacttctttctccaccacacgaacctttggcgccaattgatagcgagggacaaatagagctctcttccttgcggtgagacgaatcctggccttctgcggtggtgcttctcccttcaatacagctagttccttctccaaacgatccactttgtcttctagcttgcaaatcttaccacgattccggtcttcacgatcttgagctgctaacacaatctccgcacgactttcatccatagcccacagcatctccaccaaatgccttgtggtagcatcattctcaattccttcagtctcaaggtaactgccacggtcacttccctgtggttgacgaggatggtagcgatactcagtgtcggccaattgatcactgtagcgatcgcgaagctctcctatggcgatccttgccacttcctgacatgcatggatgtagtttcttcctccagctttgaacatcactgaggggatatcttcactattactgttcaaggtgactttgactcggcacttctcttcatgacgatcatgaggaatctgggcataaaaaggggcagtcccaaatccaatgacaaaggacattgtacgcaactcctggacaaaaccctcaacaccaaacaagtactcaggcttgtagcgcggcatctaaagacaagtgaaaggagggagttaagacatttatccaattaatagcaaaagtttttggattaatttgaataaagttagaaaatcaaagtaaaaaggtaagtaaacaaagtaaaccaagcttgcaagataagttgaaacagttggaaacgaggtcacaagttttgtacttttgaataacaggtttcaaaagaaatgaaagaaagttataaaatcaacatgctaaatttattttattgcagcaagattaaataaagcaatattgtaaaacttttgctggtaaatgagccattagtacagtaatagatgtacagtactaataacactggaataaatttttaatgagaaccattaaaagagattatgaagtgcatgtgccattagtttggtttaaaagagaaagggaggagaacagttctacttttccaatatttttagagggcttctatgggtaaccgtttggcataacctagggtcaaggggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatacttcctctcaatcaataaagatctaagcagcggaaagaaagataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcatagtagggtttcatttgcaaaagcagcatttaacaaacttttgagaatttaataaaacagttaagtaataattaaacaatattaaatcaacgctatacaacataccctgttgcataggcccaaccattctgaacaaccaccccggctgcacagttctatctccaaaccaggaatataccattccaaaccaggagctaatcaaattattaccagttatagcatcattaactatggtgagaagtgtgaaactaatcacgaaagacattgttagacccgcccataaccgcgggcacggctattcgaatagttttactatgatcagaggtgtaccactgtacccacaagacacaaccccacatcatgtcaccatgtgcctcaataccaccacggtacctcggaa

SEQ ID NO: 9702 - DNA, 3635 bp, Oryza sativa
actccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactgtcacaccctgaaaattttttaaaatttataaattgttgtttaaatggaatttctagaaataattttaaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacctctcttctctctcctcggcccaagccggcccagtccgccgcccgcgcgcgcgccctcgctcgctgacaggtggggcccacctgttagtcgtcgtctaccttcggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccacccttgccttcgcttctagtcgtcggaatcgctctagcgccgtgtgccctagcttcgccgtcgccgccgccgctccagccgtgcgccgccgtcgtttcagccgtcgccgtcgctcgggaaaaccaccgtcgtgctcgccaagtcgtcgccgtcctcgtccgccccttcgccgtcgccggagatcaccggagcagcttcgccgtcgtcgacccgaaggttcccgccgcttcctcctcgtcgccgtcgccgtctgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgccgccgctgtcggtgacgtcaccgctgacgtcatcggggtcgtccgccgtgagccgccgtggacccgatcgatctcggccgtccgttttggatggatcgatctcggccgtccgttcgcgtgaaccgtcgcccgtgcgcccggtccaccaaaccctagcccgctgacgcaataattctcttttccttttcaaaaataattcattattgcgtcataattcaattttaaccgatataagtgttttaatccgatttaatctttaaaaattcataactaattcatcttagctccgatttagttggttcaagtctctaaattcttctaaaattgagatttacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtatttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacgactttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacattaactaatcacgattgtccatcgtgaactatcattaagccatcattaaataatagtgagtcataagttatcccaatagtgagctaatgtttctaagcatggctaagcaattatatctaatgtctaattgaacccatataaataaagctcaactagtcaaattataataacccaagggatcaaggaataaagtaatcaagaacaaaaagggctataacaatgaataggttaattccacccaatgacattcgaaaataaatgcaatagttgaaaagaaacaatagctttaaacatgatcaacatgctcaaagggttgtttgggatctgtgtgacttgccttgctggccttggaactcttcaaactcttctccggcaaaaacggactctccggaaacgacggaatctaagcagaaa

SEQ ID NO: 9703 - DNA, 3660 bp, Oryza sativa
agcgacagcgaaggggcggacgaggacggcgacgacttggcgaccacgacggcggtcttcccgagcgaccgcgacgtctggaacggcggcggcgcacggctggagcgacggcgacgacggcggcgctagggcacacggcgctagggcgtttccgacgacgagaggcgaaggcgaaggtggcggcgggtagaggagacaccggggaaccttttaaaggggctaggagacgacgacgaaggcccacggcggctggcgacgagaaggaaagttcgggaaaatcgaatccgaaacaaactcgaatccacgaatttccaaacgattttagccggtgtttccaaaggagaaaaggtagaggagatctcgaggatcatttctcctctattgattcggccggagaaggaaaggatcggccgaattggaaagcggcggcggcggcgcggcgcttgggtttcggccggaggaagacgacgacctgacaggcgggccccacctgtcagcgggcggacgcgcgggcgccggcggctgcggactgggtcggctgggccgaggagagagagaagggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttacaataaattctaaaaattccatttaaacaacaatttatatattttgaattttcagggtgtgacaccgcggcagccgggcggcggcggatccggaggggaggcggctgggcggcggtcacgcgcagagggccgcgcctggcggcggctggtgcagcggcaggcggtggaagctggagcttggattttttttctttttttccttaatgtgcgattcgatctgtgtgttgattgagttgaatgtgtgatttgatctgtgttgttgttgtgaatgatttggggataaactattgtgtggatgatttgggatgaactattgctgtgaatgatttggatgaactatattgctgtgtgctgtgaatgtttgatctgagataatgctgtgaatgtttgatctgagatgatttggtcaaatagcaaaagaacagtgaaaaaggaagagagaaaagaaaaaaaaaagaaaaaaccctccaaccgggaccacatctttagtcccgatcgatctttagtcccgggtatttgaaccgggactaaagatatacccgggactaaagatatctttagtcccggattgttactcccggttgaaaaactgggactatagaggagttcctaaccggaactaaaaatcgtttctccaccagtgattgctaaattgttatatggatcgatgtttagttttaatcaaaccgcttgatacctttactgttcgtcatatattgaggaaggaagatagcaaagcaaattacttgacgcaagtcttcttgttaactgctactgaatgaatcggctcaaattgtagtgttagtttgcatggcaatttagtgcaagccgatttatctagtagtaacactttggtgaatacatgcagtagtgctggtgccgggtagttctgaattctgataggggtacacagtacatgcatgtggtttcggtgctaatgaggtgtatgcgtacgtgtacgttctggtagtagtgtacatgcctcattggagtatgatggttcggctagctgaatacaatggagacaggggcttgtacgtcttgtcgttgtggctgagctagtacctggtggttaatagctacagatagtgtagtatcatagccagaattggaggataggttaattcggttaggtggacattagtgatgaccgaattagtagtaaaatttgtactaaatggaaaatatttgagaaggtatttgtaggaggtttgattgtctcaatacgaatgcttatttgagtattgttttgagagaacgactgtggataggcttaaaacggatacctatttgagtatcattttgagaggacgactatggatgggctcagaactgataccgtgttcaaagtatcgttctaagaagatgactgtggattggtttaggacaaatatcatattagtggttaatttttatagtgttttcggtaaaaaaaagttatgattcttatactgaaaacaggggtatgtgtttgtaccataatccggcttacaattagtttatttgggcacgccaaattattgagagtagtcggtacatttatctacacgtttgctcgagagttttgaaacatatatgtgtgcaggaatctgtgatgccctgcttggatgatctgtgtataatgctgggtgcagcagcaatttatttggtttggacttgtcacatgcatgcagcctaggagagatttgcgacggggatcagtgcttgattgatgattaatttgccgagctgtgctgctgttgccgcacgggacccgtgccacatagaccgaagggtgacagtgatcaggctggaagactggcattagattgcatgcgaactatttattttttgtttgttaatatttagatggagtcggattctgttagctaatttattggagtttccatgtacgctcaagtggtgcggctagggttcaggtgctcctataaatattagtgtattaggttagttttgaggaacccccccaaaaaaaaatatcaatctactattttcttgttatttactttcctattattttctattttgttttcatagctgagttctggtaaccctagaatttagttaatatttgccgttttgcgctgaaaaacggtcgtgcttcaccacgaaagcgaggagattatcctttgctagtttgctgatatttaccctctttgctaatttccttataaattagtcgtgtgattccgcgaaagtgaattaatcttgaaatcggttccactagccgattttgatctattgattttggcgactctattgtttacactgcaaattgttaggtaatgttgtgttggccacaaaaaagcgtcaacacagggatacacttatatataatactagaaaaaaatacccgtacgttgcaatcggtaaaggctattgaaattcattgtgataactcgcttggatatatattttttctagaaaatcatgtcaagttaacatgcgagtttattttaaagagatttcttatacgactacttctgtattccaaaagcgaacgaatttaaaacctgacttaaatacggatctatatttctaaaagcgaacgaacttaaaaaccgactcatgcacggatgacgtaccaaagtaccggcaaaaacatctccaatttttataatagtagagattaaaaatatataaatagtgaagtgttgtaaggaaatactccctccgtactcgtaaaggaagtcgtttaggacaatgtttaagtcaaaccttgggtatataaatcatgaataactctcaagttgttgagtttgaaaatataaaaattatatgaatagatttgtcttgaaaaatactttcataaaaatatacatatatcacttttcaataaatatttttatagaaacaagaagttaaag

SEQ ID NO: 9704 - DNA, 667 bp, Oryza sativa
atcactccatacaagaaggcattctgaacatccagttgttgtagactccaacccctggacacagctatagacatgacagttttgatagtagcagctttaacaacaggactaaaagtatcttcataatctatgccataccgttgtttaaaaccttttgctactagtctagttttatacctgtctaggcttccatcagcctttcttttaaccttatatacccatttacaatcaatgatatttaccttcttgataaggaacaaggtgccaggttctattcttcattaatgctgagtactctgcatccattgcatctttccactgtttgtttcctagtgcttcctccaaattgctcggctcacctgcagaagtaaagcaggagtatcgcacagtaccatctatatataccttgggtttcctgatgcctccttgtaatcttgttctaggcctgcagcactggattggacaacggaactcagctcagtgtcctgcatgggtgcatcattaggctgtgtttggtttggggatgggataggatgggttggttccatccctgtttttttaccctttttggaatgggatggttacggttttttgtttggttcaagggatggaacggatcctgttttttatttggtttgagggatatgatgggttggaatgatcctat

SEQ ID NO: 9705 - DNA, 514 bp, Oryza sativa
ccgagaacgaatatggttgattgcaaaccggtaaatacacctctgtcaactacagaaaaattgtctttgcatgaaggtgatcaattaggacctaatgatgctactcagtatagaagtatagcaggagctttgcagtatttgactttgactagaccagatatatcctttgctgttaataaggtttgtcaatttcttcagacacctaaaattgttcactgggcagcagtcaaaagaattttgagatatttgaaatacacagcaagtctgggtataaattttgatagatcagtatctcacttgttagtgcctttacagatgcaaattgggctaggtgtcttgatgaccggcggtccactggagggtttgctgtttatcttggctccaatcttgtgtcatggagtgcaaggaaacaagctacagtctccaggtccagtacagaagcagaatataaggctttagcaaatgctacaactgaggtaatgtggattcagacattgttggatgaactcgatgt

SEQ ID NO: 9706 - DNA, 705 bp, Oryza sativa
tgcgttcttaaaacttaattcatttgacaaccaaagatgtagcatatatttagttggatgcttcacagctcatttggacgactgggatcttcttactaaatatgtctgtacaggtatcatttggttctgaattgagtaatcgtgcaccaacctttgatatggacctgtctgattttatggatggtgacaaaccaatatcctatgataaggccaaagaatatttctctcaggacccatcccaaaagtaagaaagatcgtttgttttactctataaaaatcataacttgtcatgcatattcattcttggttctggttcagatgggctgcatatgttgctggaacaatccttgtgttgatgaccgagctaggtgtggtcttcacagacagcatgagcattctggtaagctttgatcctttctgttttcaatcagaatgcagtaatatatgtaaaattccacctctttgtccagtttgtcacctttctcatattggggagataaagagatattcagaactcaaaaggaatattgtttattagtcacaaaaagaaaacagcatctttcacactttctccttccacattctaatcaatcaagtgtttccttccacattctaatcaatcaagtgttctaactcgaatgtttgtattggtcattcatgataattttatttgaatcctcaggtttcttcatcagttcctgaagg

SEQ ID NO: 9707 - DNA, 723 bp, Oryza sativa
attgggtgcgttcgtggaaaaaactcacttcgtgattcgcgcggcgaacttttgtcaattagtgccaatattagcatatattggcacacacgggtgtgatgtttttgaccggaatgaataagttcgaaaagcctccaaacatgagtttttgcacatattctagtgtattgggttctttcgtggcaaaaactcacttcgtgattcgggtgacgaacttttgtcaattagtgccaatattagcatatataggcccacacgggtacgatgtttttgaccggattgaaaaagttcaaaaagcaccaaaacatgatttttggacatattggagtgtactgggttcgttcgtggcaaaaacacacttcgtgattcgtgcggcgaacttttgtcaattagtgccaatattggcgtatattgagccccccacgggtgcgatgttttttgaccggaataaaaaatttcaaaaagcaccaaaacatgatttttggacttattggagtgtattgggtgcgttcgtggcaaaaactcacttcgtgattcgcgcgacgaacttttgtcaataagtgccaatatttagcatatataggcccccacgggtgcgatgtttttgaccggattgaaaaagttcaaaaataaccaaaacatgatttttggacatattgcagtgtattttgtgtgttcgcggtaaaaacttacttcgtgattcgcacgaagaacttttgtcaa

SEQ ID NO: 9708 - DNA, 1622 bp, Oryza sativa
ttgtattaaattcctatttgcaatatcagattgcttttatcttgttcttgcttgtttcttcgatttgcttgtaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacatccaaacttgatttttggatatattggagtgtattgggtgcgttcgtgttaaaaactcacttcgtgattcgcacggcgaatttttgtcaattactgtcaattttagcacaaattggcccccacgggtgcgatgtttttgaccggattgaataagttcaaaaagcatccaaacatgatttttggacatattggagtgtactgggtgcgttcgtggcaaaaactcactttgtgattcgcgcgacgaacttttgtcaataagtgccaatatttagcatatataggcccccacgggtgcgatgtttttgaccggattgaaaaagttcaaaaatcaccaaaacatgatttttggacatattgcagtgtattgggtgtgttcgcggtaaaaactcacttcgtgattcgcacgaagaacttttgtcaatttatgccaatattggcatatattgagcccccactgatgcgatgttgttgaccggaataaaaaagttcaaaaagcacccaaacatgatttttggacatattagagtgtattgggtgcattcgtggcaaaaactcacttcgtgattcgcacgaagaacttttatcaatttatgcaaatattggcatatattgagcccccacgggtgcgatgttttttgaccggaatgaaaaagttcaaaaagcacccgaacatgatttttggacatattggagtgtattgggtgcgttcgtggtaaaaactcacttcgtgattcgcgcggcgaacttttgtcaattaatgccaatattggcatatgttgagcctccagggttgcgatgttttctgacaggaataaaaaagtttaacagcaccaaaacatgatttttggacacattggagcgtattgggtgcgttcgaggcaaaaactcacttcttgaatcgcgcggcaaacttatgtcaattagtgccaatattgggtacgttcgtggcaaaaactcacttcgtgattcgtgcggcgaactttcgtcaattagtgccaatattggcacacgagggtgcgatgtttttgaccggaacgaaaaagttcaaaaaatgccaaaacatgagctttgcacatattctagtgtattgggtgcgttcgtggaaaaaactctcttcgttattcgcgcggcgaacttttgtcaattaatgccaatattggcacacgagggtgagatgtttttgaccggaatgaaaaaagttcaaaaaatgtcaaaacatgatttttgcacatattctagtgtattgggtgcgttcgtggaaaaaactctcttcgtgattcgcgcgacgaacttttgtcaattagtgccaatattaccatatataggcccacaccggtgcgatggttttggccgga

SEQ ID NO: 9709 - DNA, 1089 bp, Oryza sativa
ctcacttcgtgattcgcgcgggaaacttttgtcaatcaatgccaatattggcatatattgagcccccacgggtgcgatgtttttgaccggattcaaaaagttcaaaaagcatccaaacatgatttttggacatattggagtgtattgggtgcgttcgtggcgaaaactcacttcgtgattcgcgcggcgatcttttgtcaattaatgccaatgttggcatatattgagctcgcacgggtgcgatgtttttgactggattgaaaaagttcagaaagcatccaaacatgatttttggacatattggagtgtattgggtgcgttcgtggcaaaaacacacttcgtgattcgcgcgacgaacttttgtcaattaatgccaatattggcatatgatgagaccccacgggtgcgatgtttttgaccggaacgaaaaagttcaaaaagccccaaaacatgatttctggacatattggactgtgttgggtgcgttcgtggcaaaaactcacttcgtgattcgcgcggcgaacttttgtcaattaatgccaatattggcatatattgagcccccacgggtgcgatgtttttgatagattcataaagttcagaaagcatcgaaacatgatttttggacatattggagtgtattgggtgcgttcgtggcaaaaacttacttcgtgattcgcgcgacgaacttttgtcaattaatgccaataatggcatatgatgagaccccacgggtgcgatgtttttgaccggaatgaaaaagttcaaaaagcactaaaacatgatttctggacatattggagtgtattgggagcgttcgtggcaaaaaatcacttcgtgattcgcgcggcgaacttttgtcaattaatgccaatattagcataaattggcccacacgggtaaaatgtttttgaccggattgaaaatgttcaaaaagcatccaaacatgatttttgtacttattggagtgtattgggtgcgttcgtggcaaaaactcactccgtgattcgcacgacaaacttttgttaattaatgccaatattggcatatcttgagctcccaccggtgccatgttttttgaccggaata

SEQ ID NO: 9710 - DNA, 9869 bp, Oryza sativa
tgaccggattgaaaaagttcaaaaagcatccaaacattatttttggacaaattggagtctattgggtgcgttcgtggcaaaaactcacttcgtgattcgcgcggcgaacttttctgaattaatgccaatactgcacacgagggtgcgatgtttttgaccggaatgaaaaagttcaaaaagcaccaaaacatgatttttggacttattggagtgtattgggtgcgttcgtggcaaaaactcacttcgtgattcgcacggcgaacttttgtcaattaatgcctattttagaatatcctgagcccccacatgtgcgatgttttttgagcggaatgaaaaagttcaaaaagcaccaaaacatgatttttggacatgtttgagtgtattgggtgcgttcgtggcaaaaactcacttcgtgattcgcgcggcgaacttttgtcaattaatgtcaatattggcatatattgagcccccacgggtgcgatgtttttgaccggattgaaaaacttcaaaaagcatccaaacgtgatttttagacatattggagtgtattgggtgtgttcgtagcaaaaactcacttcgtgattcgtgcggcgaacttttaccaattagtgttggcaaaaaactcacttcgtgattcgcgcgacgaacttttgtcaattaatgccaatattggcacacgagggtgcaatgtttttgaccggaatgaaaaagttcaaaaagcaccaaaataagatttttggacatattggagtgtattgggtgcgttcgtggcaaaaactcacttcgttattcgcgcagcgaacttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcactttgtgatacgcatggcgaacttttgtcaattaatgccattattggcatatattggtacacgtgggtgcgatgtttttgaccggaatgaataagtttaaaaaccacaaaaccatttgttttagacatattggagtgtattaggtacgtccgtgtcgaaaaatcactccgtgactcgtgcggctgatgaaccctgagttccacatgacactcaaagctgttgttggcccgatctttcgatgagttgagataactacgatttggaagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcaagaacaagataaaagcaatttgaattgcaaataggaatgaatgcacacaataagttggggtttcggatacaagcagacggacggtctagccgacacgcgcgctgcaaggaagtagcaatggctaaactttcatctaaacaaaagccaaactaaccctgaaggggttactagctatttaagggatgtaggaggtcagaagggcgtcctccctctgtttggagcgcagccccccttgggccccacttgggccggggtcccagacgaaattacaggcccataggcccattacagacaatgcagccccttgtttcttcaattgccaatgactcagatagaatttgacaatgaggttggatccgttggaaggaggattccgagagctttctatcaagtactcgtgggcccaaaatgaaggccatatggagattttgcgaccgtttgaattcaacactatctcaagtggtcgaattggattctagaatgcggcggacttcatctctatctctgcatgcaccatggccgtcgtctttatcttccatatgcagccccaaataagtggattggtcctgaacatataaacgcatacatttatgaggtagtgtcatattcttgattagattaaattggcacttgttatgaaacgagaccacctgtgggtatatgacatgatcaatggttgtatccgtcgtaggcgtggtcacatcatcggcagactttgtcaattaataccaatatttgcacacatgggtgcgatgttttcaactggaacgaaaaagttcaaaaagcagcaaaacatgagttttggacatcatggagcggattgggtgcgtccgtgttgaaaaattactccgttactcgcgtgaccaacttttgtcaattaatgctgatattggcacacgtgggtgcgatgtttttaaccggaatgaaatgttcaaagagctagcaaatattggcctatgttggcacacgtgggtccgttgtttttgccaattaatgtaggtattggcctacgatggcacgcgtgggtgcattggttttaacctgaacaagaaaaaacagttaaaaaaccagaaaaacatgagattttgacttattggaatggattgggtgcgtccttgttaaaaattcactccgtgactcgcgtggcgaactttgtcaattaatgccaatattggcacacgtgcgtgcaatgtttttaatcggaacgaaaaagtttagaaagcaccaaaacatgtgttttggacataatggagtggattgggtgcgtccatattgaaaaatcactccgaaactcgcgcggcgaaagtttgtcaattaatgccaatattggcctacattggcacacgtgggtgcgatgtttttagccggaaaataaaagttcaaaaccacaaaaacatgagttttggacatattgcagtagattgggtgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtggatttggtgcgtccgaatcgaaaaatcactctgtgattcgcgcgatgaactttttcaattaatgctaattttggcacacgtgggtagcggatccaaaattttcaaaatacacgaaagcatgagttttggacatattggaattgattgggtgcgtccgtgtagaaaaatcactccgtgactcgcgcggtgaacttctgtcaattaatgccgatattggtacacgtgggtgagatgtttttaaccggaaaaaaaaagttcaaaaaacagtaaaacatgaattttggacttattggacttgatttggtacgtccgtgtcgaaaaatcactccgtgactcgcgcggcgaacttttatcaattaatgccaatactgcactatattggtacacgtgggtgagatttttttaaccagaagcaaaaagatcaaaaagcaacaaaatatgagttttggacatctcgtagtggattgtgtgcgtccgtgtcaaaaaatctctccataactcgcgcaacgaacttttgtcaattaataccgatattggcacaatggtgatgaaccctgagttcctgacgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcgcattataggtgatgcaacaccttgttcctgtgattctggccacacgagatagaattcagagaagaggctggatccgttagaaagagggctccgagagcttttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaaatggcacacgtgggtgctatatttttaaccggaacaaaaaagttcaaaaagcaccaaaacataagttttggtcaaattggagtggattgggtgcgtccgtgtccaaaaatcactccgtgactcacacggcaaacttttgtcaattaatgttaatactggactacattggcacatatgggtgagatgttttttaccggaacgaaaaagatcaaaaagcagctaatcatgagttttggacatcttgtagtggattgggtgcgtccgtgtcgaaaaatcactacgtgactcgcgcggtgaactttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacgatgaacttttgtcaattaatgccaatattagcacacgtggtgcgatgttttctcatcggaacaaaaagttcaaaaatcaccaaaaacatgagttttggacatatttaagtgtattgggtgcgtccgtgtcgaaaaatcactctgcggctcgcacggcaaactttcatcgattaatgccaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatcccgcatgctcttggcatttacccaccagacgatcacatcacccgctccatttgcaacggagctccttactctacctcgacttgcaaccgaccaatggtcgccgtttgttgggacatccatacccatgcattctggatacgctcttctctcctccgtcttgctcgtcctcctggcgctctccatcatcacactagtgccacgcatgccatcaccgcagtcattcttccgatctccaccgcctcgcctgatcaacagtagggttcctcatccatccgatgccagcgattgtattttctccgacggtaaatgggtgagggacgccgcggcagtgactgcttaccgggaggactgcccgtttcttgaccctggtttccagtgcatcagcaacggccggagcaactcatctttccgctactggcgatggcagcctcatggctgccagctcccgaagtaggtagccatcgccaatgacatctttgataaattagtaatttcttttctgtggtttttcatgatgtggacatttttcagttacttgcattgccactcaatcttcaattccaaatgatttgaggtgtttaggttcaatgcaactgatatgctggagaggagccggaacggcagaatcgtgttcgccggcgactcgatcggccgtaaccagtgggagtccatggtgtgcatgctcgccgcctccgtgccagcggggaagtcaagaatatatgagcagtccgggaaacccattagcaggcacaaagggtacctcgccatggtcttcgcagactacaacctctccgtcgagtactaccacgccccaatgcttgtcatgatcgaccgcttcccggcaagcagcggtgccgtcaggggagcggtccggctggacatgctgcctcggcacgccaaccgttgggccggcgccgacgtgctcgtgttcaatacagggcattggtggaatgagcacaagactatcaaatcgtaatgccaggggctgcttcaagaaacgggtgatgtgggttccaatcattcttggtttggttcctcggcaccaagccaatcccattcctttccgctggtgaccgccttcttgttgcctacctttttaacccctgttgtaaccccaagtccaagtacaaggcatacgtgctcctttaatatgcttgctcctcttttcttgaattcaggattggctaaggctctagccattaaatgtgactggggttgatccaagggctggtctcatggttttgactaggtgtttctcaaatttctgatcatatttcctgtcgttataacccccaaaatacgctaactcgcagctcgaagttcccagttacatgggcaaccctactcactatacatagggtgtgaagagacggacaacaatagtctttctctgctttcactcgagccaaactaagtgttttctaggattggccccaaagccatactatggtcacaacggtaaccccctcgatttgatttatccaatcaatcgagaggcagcatctctatcaattactcggatcggcaacctcggttctggaatgtggacttcactgaccagccgcctcttagtccacacccaacttggaagtgttattgattcgttagtaaccttcgccatcctaatacccgagactgtagtgttctaagttggttaaagccgtcgtctcctgggatgcccggctggtcgggcaagtattagtgaaacggctccgcgcaatcaataactaccctgcttaggtatgagcttccaagtcccgaatccttttgtctcaagtctgccttggtaatgtgaccacacatcctttgatgatggaagtgttgtttcccaacaatccaccccggaatcctagttggagtaatgtatccctacatactatcgcactaatgtaatcgggttctcagatcatactcaatgaggggtggctagtatcccgaaactttgaagaacatgagttaagtagttcattcacttggtttcgccaccagtcagaacgccctaaaacccagtaggttttctcgatcaccattctacgattttatttccacctgttttagaacacataaattgtgctacccttaagagtttatcactaaaatcaagaactttatttatgacctgtaagttgcctcataaaaagtagatgttagtacccgactaaaaggagggaatcaaataaaaggtaaagctctcaattaaaagaaaaagctatcgtttactttgttaagggtatattgcccgtagcgaggttaaggtaaacccttgaccgagtgaaggcgagcccggtaaagcactaagtgtattggctagcttgtactttattagctatcaagtgtttgatgtaccaattactttattgtgtcaactagtttattgaatgcaaaggtaattccctcgataattgatttaattatcaagaaagagaattagttaccctccttcctcgagctgagctatttcttgtgtattcaatcgtatgcacgagggctgtcctctcctctgctctatctcccggacaagtatgaaagtcgtaattctttgggtttttgtagtcaatggaatgagcggagggagacacatccttccatccaaaggtgtgtgtgtcccgtagcgagtggaatggctggttcggtctagtcgtatagaacgggttgagttctttttactgagtcctttcgaggctggaagtgtttcttacagtttccttttccgaagggaaagtcaagtagtataaactagtactaagtccaagaagaaggggtgaaaagtgaggagggcgattagcccgatccacttgaggggaggaaggccttccttcccggtaaaaaccaaaaaaaataaaagacaatacatatttttttaataaaatgaatggttagaacgtatttaaaaagtcaacattgtcatgcattaaaaaaatggagatagtacgttccaacgtagatatataatgcttttaaaatggattaaaatggagtagtggtggtgatgagtggtgaatctaccaccatccccatcactaactccctactttagtaattttatagtacattctacttgaagtatatatttgctgcagtatatggaagggtaggttcggtatttgttaaaaatatgaaaagtgttgtttagtattttgaaattgaagtttattttcatccggattgattttccagttgtagtattttttctgtatctcgtcatccattcgtgatatagcgcttcttcagaatttatcgcgtgtccccggcgtccttgactcccgacgcacttgcctccagccccggcgcctccatcccgattccttcatgacaaaaaaaaagttatgtccagatttcacccgatatgtctggaccaggaaacaactaaataacacgtggttttcagatggagctaatataaattaaataactattattttaggaaaaaaagttacctccggatttcatccatggctctaagtccttttccaagtgtctccttgacccctccattgttcctattcacaatataatcattaggtagcaatctattctcgaattcatacaaagaagaacataggaacgagctcacctctaaatttaattgtcgcgcacgagctcttgttatcggtccttgaatgaacgttggaggattgttgtgtgtatccgagttagtgatgttcgcatcatcctccccctcttgaattgaagtcgtcctcgactcaagctcatcctcttctcccaagtatggcttcaaattttaaatgttaaacgtgggactaaccccaaacttgggaggcaactcaagtttatatgcattatcattaatcttctcaacaattttaaaaggaccatgagcacgaggcatcaacttagactttctcaattccggaaatctatcctttcgcaagtgcaaccaaactaaatcacccggttcaagcttaacctcttgcctacctttactaccaacaattctatacttttcagtcatcttttcaatgttgagcttggttgactcatgcattttcaaaataaattcagcgcgtgccttagcatcatgatgaaccctctcactagtaggtaaagtcggcacatctattggagcaagagcattttatccatcccgcggcggaaaagggcttaccttggtagtagaatgcataggctgagaccccacgggtgcgatgtttttgaccggaatgaaaaagttcaaaaagcactaaaacatgatttctggacatattggagtgtattgggagcgttcgtggcaaaaaatcacttcgtgattcgcgcggcgaacttttgtcaattaatgccaatattagcataaattggcccacacgggtaaaatgtttttgaccggattgaaaatgttcaaaaagcatccaaacatgatttttgtacttattggagtgtattgggtgcgttcgtggcaaaaactcactccgtgattcgcacgacaaacttttgttaattaatgccaatattggcatatcttgagctcccacgggtgcgatgttttttgaccggaataaaaaagttcaaaaagcaccaaaacatgattttggacatattggagtgtattgggtgcgttcgttgctaaaactcccttcgtgattcgcgcgacgaacttttgtcaattaatgccaatattggcacatattgagcccccacgggtacgatgtttttgatcggattaaataagtttaaaaagcacccaaacatgatttttgtacttattggagtgtattgggtgcgttcgtggcaaaaactcactccgtgattcgcacgacgaaattttgtcaattaatgccaaaattggcaaatgttgagccccacggctgcga

SEQ ID NO: 9711 - DNA, 5010 bp, Oryza sativa
  unsure (1)..(5010): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagttgtcatatctcgtcgaaggtgtagatgttgacgttgagcatgaccatcttgtttccccttgcgcaatcctgccatggttagcagcaaacaagaaacatacacaagaatatacacgctcctatcaactattaggtactggcagctcaaatgtcacacacactcaagcttttaaccaagctcttacaagatcttaccaatgcaagtggaatggtgatgtacaccgactcaaccaagcagcccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttctttccttttcttttctgttttttttttggtgcggctttttttttttttttttgcacctttctgcctttttttttcacttttttcttgattttttttaacaaaaattgactcaaggaccttaatgtaagattacagggactcaaacataaatataaaatttacagggactcaaatctaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactaatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccttggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaagactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgatgaaaactacgatttggaagaaacgttgacgacccgactacaaccgtacaagacgttgcgttgcgccttagcgatcgatacacctctccgtgggttgttgatcttgccgttgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaacattaatctaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcaccttgtttcttcagttgctgccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaactcgaaatagtgtgattagcaataacatgtttctctaaatccaaacaaatgaaaactctatgcaccaaatatattcctctatcattatatttgccaaagatatgaaaaatagcattagttagacatggcaaatcagacttagcaaataatttctccttcaaattatcgagctcacaaaaatcatcaaactgaacatagcccaaagtatttaaagaagatagcaatttacgttcctcaacttcattaacaatatgaacagcatgcttaaaatcagcacacaaagaaacactaggaatagcatgttcatccactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtaccatttactttaccttggatgtcctctttagatgatggaggtgtctcgaacttgagtgtgaacaatggaattggtggctctttcatgtctctctcctccttttcgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgtagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctaatatatgaagttcagctcaaacataacagtattttctcttttctttctttcttctttcttcttttctttttttttctttccttttcttttctgtttttttttggtgcggcttttttttttttgcacctttctgcctttttttttcacttttttcttgattttttttaacaaaaattgactcaaggaccttaatgtaagattacagggactcaaacataaatataaaatttacagggactcaaatctaaaagtctaaacccaaaattaaaattatacaaaaaatggaatgctgaatttatgcccggtccgttttccaaacagatctcgaaaccgacaccaaac

SEQ ID NO: 9712 - DNA, 9147 bp, Oryza sativa
atatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatattgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtgtttcaaagattcatgatcagagtgtataacaaattctttgggccataaataatgctgccatgtttccaatgttcgcactagagcaaacaattccttatcataagtagaataattcaaactaggcccactcaatttctcgctgaaatatgctacaggtttgccttcttgtaacaacacaccacccaatccaatcccactagcatcacattcaagctcaaaagttttgttgaaatcaggaagttggagtaaaggagcgtgtgttaacttatctttcaaagtgtcgaatgcattcctttgtgctgcagcccaagtgaatgtgacatttttcttggtaagctcatgtaatggggctgcaatggtgctaaaatccttcacaaagcggcggtagaacccagcaagtcctagaaagcttctcacttgtgtgatcgttgttggaaccggccagctatgtatggcttcaaccttggcttgatctacttcaattccctgcggagtcacaacatagccaagaaaagagactcgatctgtgcaaaatgtgcacttctcaaggttaccaaataaacgtgcatctcgtagagcatcaaaaacagcacgcaaatgaccatgatgatcctctattgatctgctatatatgagaatgtcatcaaaatataccaccacaaatctgccaatgaaagcacgtaaaacttcattcattaatctcatgaaagtactgggtgcattagtgagaccaaagggatgactaaccactcatataggccgaatttagttttaaaagctgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatctttcttaggaactaaaagcacggggacagaacaaggactaagagactcacgtacataccccttgtcgagtaactcttgcacttgacgctgaatctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggaatatcctcaattggaaataaggtttctttgcaaaccaaatcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtacgctcctgatttttttgtttgctagctctagcaagttcatcctttaaaataacttcaggagacatatgatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtaaggctgtggatgtggctgtgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccccaatgtgttcctcatcttggtgggacgcgtcaccttcccctgcattgttagttgcaagcaaagcataggtttcttcatctaaatcactagcggaggagtacccaccatcagctctcacaatcattacacgagtgcttgggcagtccttgcgcacgtgaccatagcccctgcagcgtaggcactgaatatctcttgtccttcctgatgaagctactgatgatgagctcttggaaggtgtagcagcaacccctcttgttggttcactcgggcatggtgtagagtttgttgtagagggacgcagcttgttgcttgaggatgatggtgctgctgctcgagttgacggtgcagcagcgttagaagatgtccaagagctagcacgacctgcagaaatgttagtcctgaagctagctcttcgtccctgtacttccctttcagctttacaagcaagatgaaacaaacgattaattgaattatattctttgtaggctagaatgtcctgaatttctcggttcagcccacccatgaatctagccataccagcatcatcattttctaccaatccacaacgaagcattcctgtttgcaaagcttgataatactcctctacagatttgtttccctgtctaagttgttgcaatttgtgcagcaaatcacgtgcatgatatgaaggaacaaatctagctcgcatgactcttttcattgcatcccaggtttggggagtgttatttggattggaacgaacaaattcactccaccaaatggatgcaaaatcagtgaactcactagtagcagccctaacacgtttattctcaggaaaatcatggcaagcaaatttctgatcaatggctaactcccatgtaagatatgcatcagggtcatattttccatcaaagcaaggaatggtaaacttgatcttgcctaaagaatcatcattatcacgtacctcccgccgtggtggagcgcccatgccatggcgctgccggcgttgttgtctttgtggacgaccaagtacctcctcatcatgctcagtgtcagcagcgtactccagttcttcccttgctgcgatgctgctattagcatcatggccattgtggttgcgcctagccgatccatcatgaccttcttggcccattctctccaacgtattcaagatacctgcaagagaagtgttcacagccacaagggacctctccaatgaggaaagcttggagttggtgtcaatttgagcggcctccaattgaccaaggcgatcattggcgaccctaacatcctcatcaaggccttcagcatgctccctcacttggcgctcaaaatgttgtatgatgcccctcatacgtggtgaatgttgagggtgctcccccgatcctcctgtcatggttaatggaaagaaacaattcacaagaaatatgtcctatcaactattgaagctaggtgttgtccatctccacttctaccaaacttgtgcaaacgagttcttacatgttcttactttgttatgtaaaaggcgttggcaaacagcaagaacagcaacaacggttagtagtaccggagccgacaacaagcacgatcctgtgatatagtagataaaaatttgtggagctataggtggctgcaagtaatatcaaggtacagctagaaccacatgaatcaaagcaagttgaataatcattcaacgatggtattgtgctggtcctaggcaaaaccctttagagacgcgagcctagtcacaagcgtagccactcaaaatagcacgaaaataacacaaacaaaacagcaacaacaacaacttcctctcttcccttccttttttttttccttctcttcatttctgatttttttttctttcttttttttttgttttctttctttttttttgtacagcaagctcaaagcttcagccaacaagtcaaaacaagaagtaatgatgggttggttggctagttacatgattcagccaacaagtcaaaagtgagagcacttaaatgctttcttgggaagggctgattcacttcaaaaagttgcaaaagggttggctgttggtggaggcagcaataaatgcatttgggggtggctgatgtggtgatgagggtgctgctggttgtggtggacgaaatttggtggggttggaggtggatttcgtggtgaatatggtggtgatggtggcagcgggatgaagataaatgaagtgatggtggaagtgtttgcggtgacgaattcgtgagcagaactcgaaactctaaaggactaaactactagaaccagcaactcaaccaatcgatgcaatcgaaaactcagcaagcaaagactaagtagaacagcaaaggctcaacatgttttggtgatttcgggtctgtcctattttagtggtttttcttttgggctgtaggtaaaaacaaagaagtgataaaatctctcaccgagcaacttgagctctgataccacttgatgcagcaacgggggttcccgatctttcgatgagaggagggtaaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccacacatagctgaaagtagacgacgagatctttccaacaagtactcatttgccccgtttgccctccggagtgaagagcattgacttcatcaactcagcgctgctagtgctgcttgcgatttggttcctcttccatattcctaacaacaagtagatcacaacaaccatttagtagcacacaattctgagaagaacttgtatgattagctaggaatgactttacctgataattaagttcacgagctcgagctctagtcattggtccttgctgtgcaataggtgtggttgtatcgttggaagggatgtcctcatcatggcatatattggcccacatgggtgcgatgtttttgaccggaatgaaaatattcaaaaagcacaaaagcatgatttttggacatattggagtgtattgggtgcgttcgtggcaaaaactcacttcgtgattcgcgcggcgaacttttgtcaattaatgccaatatcatatattgagcccccacgggtgctatgttttatgaccggaatgaaaaagttcaaaaggcaccaaaacatgatttttggacatgttggagtgtattgggtgcgttcgtggcaaaaactcacttcgtgattccgacggagaacttttgtcaattaatgtaaatattggcatatattgagcccccacgggtgcaatgttttatgaccggaatgaaaaagtttcaaaaggcaccaaaacatgatttttggacatattggagtgtattgggtgcgttcgtggcaaaaactcacttcgtgattcgggcggagaacttttgtcaattaatgccaatattggcatatattgagcccccacgggtgctatgttttatgaccggaatgaaaaagttcaaaaggcaccaaaacatgatttttggacatgttggagtgtattgggtgcgttcgtggcaaaaactcacttcgtcattccgatggagaacttttgtcaattaatgtaaatattggcatatattgagcccccacgggtgcaatgttttatgaccggaatgaaaaagttcaaaaggcaccaaaacatgatttttggacatattggagtgtattgggtgcgttcgtggcaaaaactcacttcgtgattcgcgcggcgaacttttgtcaattaatgccaatattggcacacgagggtgcgttgtttttgaccggaatgaaaaagttcaaaaaacgccaaaacatgatttttgcacatattctagtgtattggcaccattcgtggaaaaaactcacttcgtgattcgcgcggcgaacttttgtcaattaatgtcaatatttgcatatattggcccacacgggtgcgatgtttttgttcggaatgaaaaagttcaaaaagcaccaaaacatgatttttggacatattggagtgtattgggtgcgttcgtggcaaaaactcacttcgtaattcgcgcggcgaacttttgtcaattaatgccaatattggcatatgttgagcccccacgggtgcgatgtttttgaccggaatgaaaaagttcaaaaagcaccaaaacattatttttggacatattggagtgtattgggtgcgttcgtggcaaaaactgacttcgtgattcgggcggagaacttttgtcaattaatgccaatattggcacacgagggtgcgttgtttttgaccgaaatgaaaaagatcgaaaaacgccaaaacatgatttttgcacattttctagtgtattggcaccattcgtggaaaaagctcacttcgggattcgcgcggcgaagttttgtcaattaatgccaatattggcatatattgagcccccacgggtgcaatgttttatgaccggaatgaaaaagtttcaaaaggcaccaaaacatgatttttggacatattggagtgtattcggtgcgttcgtggcaaaaactcacttcgtgattcgggcggagaacttttgtcaattaatgccaatattggcacatattgagcccccacgggtgctatgttttatgaccggaatgaaaaagttcaaaaggcaccaaaacatgatttttggacatgttggagtgtattgggtgcgttcgtggcaaaaactcacttcgtcattccgatggagaacttttgtcaattaatgtaaatattggcatatattgagcccccacgggtgcaatgttttatgaccggaatgaaaaagttcaaaaggcaccaaaacatgatttttggacatattggagtgtattgggtgcgttcgtggcaaaaactcacttcgtgattcgcgcggcgaacttttgtcaattaatgccaatattggcacacgagggtgcgttgtttttgaccgaaatgaaaaagatcgaaaaacgccaaaacatgatttttgcacattttctagtgtattggcaccattcatggaaaaagctcacttcgggattcgcgcggcgaacttttgtcaattaatgccaatattggcatatattgagccccaggggtgcgatgttttatgaccggaatgaaaaagttcaaaaggcaccaaaacatgattttttgacatgttggagtgtattgggtgcgttcgtggcaaaaacttacttcgtgattcgcgcggcgaacttttgtcaattagtgccaatattggcacacgagggttcgttgtttttgaccggaatgaaaaagttcaaaaaacgccaaaacatgatttttgcacatattctagtgttttggcaccgttagtggaaaaaactcacttcgtggttcgcgcggcgaacttttgtgaattaatgtcaatattggcatatgttgagcccccacgggtgcgatgtttttgaccggaatgaaaaagttcaaaaagcacaaaaacatgattttctgacatattgcagtgtattgggtgcgttcgtggcaaaaactcacttcgtgattcgcgcgacgaacttttgtcaattaatgccaatattggcacacgagggtgcgttgtttttgaccggaatgaaaaagttcaaaaaacgccaaaacatgatttttgcacatattctagtgtattggcaccattcgtggaaaaaactcacttcgggattcgcgcggcgaacttttgtcaattaatgtcaatatttgcatatattggcccacacgggtgcgatgtttttgttcggaatgaaaaagttcaaaaagcaccaaaacatgatttttggacatattggagtgtattgggtgcgttcgtggcaaaaactcacttcgtgattcgcgcggcgaagttttgtcagttaatgccaatattggcatatgttgagcccccacgggtgcgatgttttttgaccggaataaaaaagttcaaaagcaccaaaacatgatttttgggcatattggagcgtattgggtgcgttcgaggcaaaaactcacttcgtgaatcgcgcggcgaacttatgtcacttagttccaatattggcatatattgagccctcacgggtgcgatgtttttgaccggaatgaaaaagttcaaaaagaaccaaaacatgattttttgaacatattggagtgtattgggtgcgttcgtagcaaaaacattgacgaacatttgtcaattaatgccaatattggcatatattgagcaccgacgggtgcgatgtttttttgaccggaatgaaaaagttcaaaaagcaccaaaacaagatttttggacatattggagtgtatttggtgcgttcgtggcaaaaactcactttgtgattcgcgcggagaacttttgtcaattaatgccaatattggcatatattgagccccaacgggtccgatgttttttgaccggaatgaaaaagttcaaaaggcacc

SEQ ID NO: 9713 - DNA, 5305 bp, Oryza sativa
gaaaaggacttttagagcttttctttttataaaatcattttaactttgtttatttcttaataattattatttgtgctatgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacaaacctaccccccttaaacggaatctcgaccccgagattcggaagaactggcgaagagatcgggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgtcgggcaacgatacggaaaggacccacataccgaggtgcgagcttccctttcgtctgaaacctgtgtacacctcgcaatggcgtgacccgaaggtacacaaaatcgtccactgcgaattccaggttacggcgacggttatctgcataacttttctgccaggactgtgccacctttagattatcccgaatggttctgactttagcttcagcttctctcaggatatcagtcccgaacacttggctttccccaacttggtcccacaatagcgatgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgattcagacgctcggtctgtccatctgtctgcgggtgatacgcggtgctgaaatttaatcgggtacccagctcttcttggagcttcttccaaaagtgagaggtgaattggcttcccctatcagatacaattttcttaggaacgccatggagactcacgatcctagcgaagtagagctcggctagtttgttccctccataggtggtcttcacaggaataaaccgagctactttggttagtcggtccacaactacccatatagaatcatatccaccttgggtttttggaagtccggtgatgaaatccatcccaatttcatcccatttccattctggtacttggagaggttggaggagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtattcatcctctgtgaaaccagcggctttaccctgtttcatattcttgaggagtccacgcatgtccggatcattcttctgagcctcgcggatttgatcgagcaaggtaggcttggcctccaacgcagccaagaatccgcgaccaactatgcttaggttcagggcttccatctgttgattaagttcgggtggaatgccacggacgttaagagtgttgcaatggcttttttgacttagagcgtcgacgaccacgttggccttaccgggatgatagtggattcccacatcataatccttgatgagctctaaccatcttctctgccgaagattcagatccgactgggtgaagatgtatttcaaactcttatgatcagtatatatttcacagcgattcccaatgagataatgccgccagatttttagagcatgaaccaccgcggctaactccaaatcatgggtagggtagttgccttcatgaggccgtagctggcgtgaggcataggccaccacatgaccttcctgcatgagcacgcaccccaatccttggcgcgaagcgtcacaatacaccatgaagtccttgcgagtatccggcaagattaacactggcgaggaaaccagcttttctttgagagttttgaacgccttctcgcattgcgggctccacacaaatttatattttttcttcaacaactgtggtcatgggtcgagcgattttggagaagttctcgatgaacctccggtagtatcctgccaaacctaagaaactgcggatttgagtgactgtcttgggttgcttccaatcgggacggggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgatgtgaccatggctaccacggatgcaaccattgctcacatcatggatgaacaagaagatatcgagatcaagtactccaagtgctggaatccgattcggccacctactacactgctgacttcaaacggccaccgaatctgcatacgacctccgttttcggcctgtgagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccccaagctggtggagcacgaccctatgcacccctaggtcgtcctcccacccctatatatagctagttaccccttcagggtttcttggggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacagaatgtcatcaatgaaaaccacaacaaacttatccaagtattccatgaacactttgttcattaagttcatgaagaaggcaggagcattggttaaaccgaacgacatcaccgtgaattcatacagtccgtatcgtgtggtgaatgcggtcttcggaatatcttcttcacggatgcgcaactggtgatatccggaacgaagatcaatcttggagaataccgtggcacctttaagctgatcgaacagatcatcgatccggggaagagggtacttgtttttgatggtgactttattgagagctctgtagtcaacgcacatcctcttcgtcttgtctttcttctccacaaaaatcataggagcaccccaggggaaagtactcggccgtatataccccttttctttcaactcttccaactgtttcttaacttcggccagttcatttgctgccatacggtagggtcgtttgtacagaggagtggttcctggagcaagatctatccggaactcaatctctcgcttgggcggcatatcgggtagttcttccggaaacacgtctccgaactctctgacgatggggatttctgacagtcctatctgatgaagttctgaactactgacagaggttggaggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaagggatcccctgaatttctatagggacggcaggactataatactttgctgtcataacccctccaggggtggtgatgaggagagggttcctaaacctttctacccccaactgatttctccccacgaatggcacagatataaacgagtgggaagctccagagtcgaacaaaatggtagcagggatggaatgaatgaggaacgtaccaacgatgacgtctggagtcgtcagcacgtcctcggccgtcacgtggttcacacgaccccgaatgacatccttaccaccgttgtttgagcggggaggcgcttggccttgctggcgcctcggctttgggcatttatccgcaaagtgcccaggctcgaagcagttgaagcacagacgctgcggaccttgaacgtccctgcggccttgaccagactgcgcggctggcgtaggaggacggggcgcacgggtcccttgctggctctgctgttgctgcggctgtgggacgcgcaccacgaattgaggtcggggcgcggagcgaggttgctgctgctgttgctgttgcgaggacgatccccctggatagggattggtgtagcggatcctttggttagctccctgttgattgcggaaattcgccaagcggcgcttgtgcgactccagttccttgtgcttggcttccaagcggatgctcttgtccaccagacgttggaaatccagatagtcaccggagactagacgcacggacagctcagggtccattcctgccaagaacttctcctgcttttcctcatcttcccgtacatcctccggggcgtaccgggccaggttgttgaactcatgcaaatactccatcacggagcggttgccttgcttcaactctcggaattcccttttcttaagggccatgactccggcgggcacatgggtcctccggaaagcggcggtgaagcgggcccaagtaataggctgcccctctggctgcgtagcctggaaatggtcccaccatagagatgcgggcccctgcagttggtgggcggcgaagatgactttctcctcatcgctgcactgcacggtgtctagctttttccccacggcatgcaaccaatccaacgcatccacggggttgttggagc

SEQ ID NO: 9714 - DNA, 7385 bp, Oryza sativa
gtgggctgccctggttgttgtggttgctgccttcggggtgactgccttcaccggtagcagcacttctcctggtcatcaccatctgaaaaccccacacagaaccagcaaacagagagagctgacaattaaaactagccacccacgactaccataattcttgaatttattactgctattaaattggttcattaaagttcaagttgcttaagcaaataaaataaagacaggctccgacacagttataccacacaccggcataaccatgccccacacgactccaacaagaagacaaacgagaaagaacacacgcgcaagcctactaactgctcgtctaccgctgcgacggtccaggacggaaggtgagcaacagcgcatcctccgtgctaccaacgccggaggcttccccctcctgaggaaccacgggcgcgggctcggcacgaggggtctccacgaagcaggtccacgccagggactgacgaacaagctcaggcctggaggtgctcttgcgggcggtgatcttctggctgcggcagacgggcgacgcttggggcgacagacctctccctgggcaatcttgagctgatgcagctgcgcctccactgcgtctaggtccttcttcagctgcagattctcctgacgcagctccaggatcttcatgttgttctcgaccatcccacggcgcaccatatgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgggagctgcctgccctggtagtccactccatgcggataccccaggacaacgcacatgccccgctactccaaaacaaagccagtcaggtccagaccacgacggttgatgctgccggccatctacaaacaaaaacaaaaagaaaagcaacattttaaaggtcagattttgacgataaatgaagcagtaggacagagagagactagaggattttcacaaataagaaaggatttttattttgaaaatattgctaaggcttgggatctacggctcgtcctagggtcaagggggctctgataccaacttgtcacgaccggaaataacccaacgggcgttccttacgtgcgtgcattattccttgtcccaggaggcaaggtacactaaaagttgatacagttcagagtttaacaagcggaagcgtaaatagataatttattacatgggcagcgaaggcccagcacacaaaaagacaaacaggaaacagcggaagactagggcgacgaccacaggcgcttgacggcaggcacgagctagacaccaaggccttcatcttccagaggctcctcttctgggtttgggaaaaattgagcaagactgagtacaaccactgtactcaacaagacacacccacaagtgcaggataaatgcaagggagtacaagggagttataatataaagggttagggtttgcagtaaacagcattaaaagacacttagttgctcaaagctattttgtaaacacgattccagagttataatcaaggccgtgaacccacacgaacctgccttaacccaaggcctacgatgattcaaaccgaactggcaacccgaccctgggtcccagctcgtcccaagccaacccaggccaaccattccacattttagttgtttagcaggttttaagaattaaaacactaacttgggtacattgctcggcttgcccataaccgagggcgcggctattcgaatagattatactctgatcagaggtgtacatctttacccacaagacacattttcctcacgtgtaaccacgtgccacataccaccacggtatacggacggaagacatgacatagtttccaacccatcctagccataaacaagagtaccgacccaaccccacctacggccggaacccccaggacaggtaggcaggactgagcccctagcagcaggacaccggccctgtgccatgacatctcgactaccgggccgcagctcgtgtagccttcatttgccctagagatgtccatcgacccctgacttcgtccatctccatccgtgtacttttgtttataaccagactaagccacaaactaagccttacctactagacatgtggaagtacggtagtgctttgcaacagaggcccgaagaccggtccatatatggccgaggtgctactgtcaaaaccatgcaccccgagcccagcctaaaaccattttgagggttttgaatagagggggaggtgtgaatccaattccacaataatccaaccattccatagtgtccaggtgataagagtattcccaaagtctagagttgtaaaaccacctaatgttgcctaattaaccagcgaagcatctacctaaaatcatactagtggtaccatgagtgtccactagttggggttttgtttcttctagggtgaacaaggaaataataacaataacaataataaggtcataacaaaggtaaataggcatggctagataaaacagtgataacgcgggaatttaataaacagtgataacaaagcgataatgcaataatttaaatcaaaataattttataaactgggattcaatatgttcaaggatgatgtgacttgccttgctcactttcccaaacgtcggcttcaacctccacgaagagtggatcttccgaatctgcaacgtctacacgaccaacggaaaataaaagggcttttactctaataaactccatataacaagcaggaacgaagcacaaaaatgggttcttgacttcttaaggaaaaaaaagagacttgaacggtccaattccgagttcaaatggccaagttatggccatttgaagtttatatgctctttaaatgaatatttgcggatttgttcatttaaattttaatttaaaaagggtttattgcgtcagccgaggggagggggcgcgcggaccgggtccacgggagtggggcccacgcggcagcctcacggtccacggtggaccgggcgcacccgggctcgcaccggccggcgccgtgggccccacgcttcagccgcacccgagggcgcgggcggctgacggccgggccccacgcggcggccactcggcgtgcccgaaggcggccactcggcgcggccggcaggaggcggcgcccgcgcccctatggtcgccggcggcggccataggcacggcggagcggcggccgagagagggaaagggaagggggaaaagaagcggcggtccacggctcaccctaggtcgacggcgatgacggaaaggcagccggagcggaggaaggcggcggcgtggctcgggtcgacggggacgacggtgttccggcggtcggcgagtgaaacggaggggtggacgaggtcgccgaggatgcggcgaagccgaaggaggcggcgccgagggggaaggtggtccggggcgacgacggcggcggaccggagctcggcggcgacggccgagagagagagcgacggcgcgagctcgatttcggcggggagagagagcggcgagtggcggaaacggtggagggaggcacggggagggtttatatagggttgggtgtgagagagggcggccggaggagggggaaacgggcgcgggagacccggccgccattagtggcgccggcgaggttaggggaggagtttcctaacgaatccgagggagagagagagggaaaaatggggggaaagggggaggggatcccggggaataattcccccctattgattgcacgcggggcggacgggggcggcgggattcgcggcggcggcgctagggcgcgggcggggcggcgggagcggcgggaggaaggggatgacgggtgggccccacccgtcatcgagggaggcgggcgggcccgcccgtcggcggcacgcgcgcggggaggatgccgaatgggccgcgggggagaggagagagagggagagagatgggccgagccggcccaagagggggaggggggggggaaaaggacttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacattgaaaaagttcaaaaagcatccaaacataatttttggatatattggagttttttgggtgcgttcgtagcaaaaacattgacgaacttttgtcaattaatgccaatataggcatatattgagccccgacgggtgcgatgttttttgaccggaatgaaaaagttcaaaaagcacccaaacaaaatttttggacatattggagtgtattgggtgcgttcgtggcaaaaactcacttcgtgattcgcgcggcgaacttttgtcaattaatgtcaatattggcatatattgagcccccacgggtgcgatgttttttgaccggaatgaaaaagttcaaaaagcaccaaacatgatttttggacatattggagtgtattgggtgcgttcgtggcaaaaactcacttcgtgattcgcacgaagaacttttgtcaattagtgccaatattggcatatattgagccctcacgggtgcgatgttttttgaccggaatgaaaaagttcgaaaatcaccaaaagatgaattaaataagtttaaaaagcaccaaaacatgaattttgtacttattggagtgtattgggtgcgttcgtggcaaaaactcactccgtgattcgcacgacgaacttttttcaattaatgccaatattggcatatcttgagcccccacgggtgcgatgttttttgaccggaatgaaaaagttcaaaaagcaccaaaacatgattttttcgacatattggagttttttgggtgcgttcgtaccaataacattgacgaacttatgtcaattagtgccaatattggcatatattgagccctcacaggtgcgatgtttttgaccggaatgaaaaagttcaaaaagcaccaaaacatgatttcttgaacatattggagtgtattgggtgcgttcgtggcaaaaacattgacgaacttttgtcaattaatgccaatattggcatatattgagcccccacgggtgcgatgtttttgactggattcaaaaagttcaaaaagcatccaaacaggatttttggacatattggaatgtattgggtgcgttcgtggtaaaaaatcagttcatgattcacgcggcgaacttttgtcaattaatgccaatattagcataaattggctcacacgggtacgatgtttttgaccggaatgaaaaagttcaaaaagcaccaaaacattatttttggacaaaaactcacttcgcgattcgcgcggcgaacttttctgaattaatgccaatactggcacacgaggccgcgatgtttttgacaggaatgaaaaagttcaaaaagcaccaaaacatgatttctggacatattggagtgtattgggtgcgttcgtggcaaaaactcacttcgtgatttgcgcggggaacttttgtcaattaatatcaatattggcatatattgagcccccacgggtgcgttgttttcgaccggattgaaaaagttcaaaaagcatccaaacatgatttttggacatattggagtgtattgggtgcgttcgtggcaaaaactcacttcgtgattcgtgcggcgaacctttgtcaattagtgccaatattatcatatattggcccacacgggtatgatgtttttgaccggaatgaaaaagtttaaaaagcaccaaaacatgatttttggacttattggagtgtattgggtgcgttcgttgctaaaactcccttcgtgattcgcgcgacgaacttttgtcaattaatgccaatattggcatatgttgagcccccacgggtacgatgtttttgaccggattaaataagtttaaaaagcaccaaaacatgatttttgtacttattggagtgtgctggttgcgttcgtggcaaaaactcactccgtgattcgcacgacgaacttttgtcaattaatgccaatattggcatatcttgggcccccacaggtgcgatgttttttgaccggaatgaaaaagttcaaaaagcaccaaaacatgatttttggacatattggagtgtattgggtgcgttcgtggcaaaaactcacttcgtgattcgcgcggcgaacttttgtcaattaatgtcaatattggcatatattgagcccccacgggtgcgatgtttttgaccggattgaaaaagttcaaaaaacatccaaacatgatttttggacatattggagtgtattgggtgcgttcgtggcaaacactcacttcgtgattcgtgcagcgaacttttctcaattagtgccaatattagcatatattggcccacacgggtacgatgtttttgaccggaatgaaaaagttcaaaaagcaccaaaataagacttttggacatattggagtgtatttggtgcgttcgtggcaaaaactcacttcgtgattcgcacggcgaacttttgtcaattaatgccaattttagcatatcctgagcccccacaggtgcgatattttttgaccggaatgaaaaagttcaaaaatcaccaaaataagatttttggacatattggagtgtattgggtgcgttcgtggcaaaaactcacttcgttattcgcgcagcgaacttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcacttcgtgattcgcgcgatgaacttttgtcaattaatgccaatattggcatatgatgagaccccacgggtgcgatgtttttgaccggaatgaaaaagttcacaaagcatcaaaacacgatttctggacatattggagtgtattgggtgcgttcgtggaaaaaactcacttcgtgattcgcgcggcgaacttttgtcaattaatgccaatattggcatatattgagcccccacgggtgc

SEQ ID NO: 9715 - DNA, 5323 bp, Oryza sativa
tgttttttgaccggaataaaaaagttcaaaagcaccaaaacatgatttttgggcatattggagcgtattgggtgcgttcgaggcaaaaactcacttcgtgaatcgcgcggcgaacttatgtcacttagttccaatattggcatatattgagccctcacgggtgcgatgtttttgaccggaatgaaaaagttcaaaaagaaccaaaacatgattttttgaacatattggagtgtattgggtgcgttcgtagcaaaaacattgacgaacatttgtcaattaatgccaatattggcatatattgagcaccgacgggtgcgatgtttttttgaccggaatgaaaaagttcaaaaagcaccaaaacaagatttttggacatattggagtgtatttggtgcgttcgtggcaaaaactcactttgtgattcgcgcggcgaacttttgtcaattaatgccaatattggcatatattgagccccaacgggtccgatgttttttgaccggaatgaaaaatttcaaaaagcacccaaacatgatttttggacatattggagtgtattgggtgcgttcgtggcaaaaactcacttcgtgattcgcgcggcgaacttttgtcaattaatgccaatattggcatatgttgagcccccacgggtgcgatgtttttgactggaatgaaaaagttcaaaaagaccaaaacatgatttttggacatattggagtgtattgggtgcgttagtagcaaaaactcacttcgtgattcgcacgaagaacttttgtcaattaatgcgaatattggcatatattgaggccccaccggtgcgatgtttttgaccggaatgaaaaagttcaaaaagcaccaaaacatgatttttggacatattggagtgtattgggtgcgttcgtggcaaaaactcacttcgtgattcgcgcggcgaacttttgtcaattaatgccaatattggcatatgttgggcccccacgggtgcgatgttttttgactgaggggaggagtttaggggaggagtttcctaacgaatccaagggagagagagagggaaaaatggggggaaagggagaggggatcatggggaataattccccccactttattgcacgcggggacggcgggaggcggcgggattcgcggcggcggcggcgatagggcgcgggggaggcggcgggagcggcgggaggaaggggatgacgggtgggccccacccgtcagcgagggtggcgggcgggcccgcccatcagcggcgcgcgcgccgggagaggccgagtgggccgcggggagaggagagagagagggggggggagaggagagatgggctgggccggcccaagggagggaagggggacttttagggtttttctttttataaaatcattttaactttgtttatttcttaataattattatttgtgctctgaaaattccactaaaatttatttacgcattttaggcttttaggaaatttacaaaaatcctccaagccttatttgacttttaactttgcacattttaattgttggaggctttcacatggattttaattattctaggcatcatttaagggatatattttagagtcgttttgggacgtgacaattcttctcaaaaacagtcagagatgtcaacgatctgattgagaagaggctcacaaatacaggttggagcaaggaacgactccaaaccagtcaaacgcggtatgcacaccgtcaacgagacggaaatgctcgccgcccaattggatctccttatgaagagaatggacaacaatgagaaggacgccaagaagggtaccgttaaggccttcgacttttcaaatggcatgtgaggtctgtggcaatgacgatcactctgggacggatcgtccgaaaacctgtaaggacgtcatgctcatgaacaacaacaacggatatcgtccacaaggagaccaagtatggagcattgctccatggtctagttcaagaacggaccgaacccacaaggaggttagagtgaaaccccgaaggacggatagtctcaacactttcatgatgaacttcctgtagcgggaagaaacgaggaaccgtcaataccttaagccggcatccaagaagccaggaatataggccggtcaacctgcgttcccagttatgaagaggccgttgcccgcacctaaggcaaagaaggtgtggcagattaaggaaaaaacacctgctcctttacctccggaattgggtgccttatcgaggtaaatgcatcggaggtactgtcgtgcttgtcagacttgaaatgatgtcgcctttgccaacaggtaaatgggtagttatttcatatttattttccattgcatcaaagcatgtttgaatttttcaaacgcagcaaaataaaataaaatttttggcaaaattttgcatggccaccaccacactagtcgttggaacccaatggctaaatgtggggccggttgggtccaccaggggttcggccgaacccctgcatggcactggctggctgcaaatttctttagggtagcggctagtggggcccacatgccattactagccattatccatgcactatataagcagctcggctgggagagggaagtcacaccactctaactcattctcactccctctcaaaaccttcctctcaaaattcattcaaagttttgcaagcttgcctcaaattcacacaatttgctgcatttagtttagacactttacatatacgagtttgctttagttcggtgcaatgttaatcggtgggtatttgtttaacccccgtccgagtagtcttgtattcttgctctttgttgtagctatgaagaaacgacttccgggcatattcaagagacaatcaagctcacggacaagccgacacgaaaagccgagtacaccttcttctgcggatgcatccatggaggaggcgtacgttccaccgaggctgtacgacaactccgatctcgacctcgtgggcgaccgggaaatgcaagcctatcatatgctgaaggaccgaacgtgtgctcagacctaagcatacaactcgaccttttgaaaaggataggtatggatgctgagtttcatactgtttgacgtgctgttggatgggataaatttgcatgtgtagatgagctgggttcctgtttgcttaccatgcagtttctatgtaccttgctagaggtaggcgatggtgtactttctggttattccgcaaggaatatcacctttctcggaaagaccttagcttgcatctaggctttgacaaaacatgcaaagttaatttcaggaacgcatttcttggtttttaacaagcgtatgttttggcaaagtatttcaggtttctcatcctctaaaaagcctagaactagtgacatccatcatcctaccttggggctgttgcataagttgcttggtttcatgttgtttcttagagctgatatccagatagtttgtgaagacgaactagtcctcttgtatgccatggttaaaaaaaaaatcaaagtttcacctgttcaacccatgatcaagcaatggttagaaaatatgaagttgtctggtccttttgagtgtatttctttggtgactcgttcagcatgaagagttgggactatgctttataagcaagtattcctatcacccgctcttatgttgatgaggcctatttagttcaatgccacatactcaaacatggtccaaatgattatcttatatttttgtttcccggctatacaaataagattcctttacctaacccggagtttcatttgtgtaattgccgagaactaaccattccactccaattggagttgcatcgtgatgtcccacgcagggtaacatgacgaatgtacagagaagcacctcaggaggcgtcttcctcttcaccaccagtgtaaatgtatggggactattgggacgctggtggttcgtcctggcagagtgccagcgacggccgatggcatgagccgtaggagctgcactggggatactcgcgctcctccaattcaagtggtccaccttcatcctcttggatgtgtcgctgtctcctctcgaggggatctgggagaactcacccggaggatggatacacttgaactgtaggcagggaacgaacaacacaccttggaggataatgtggtacagtcacgggaatggcaacagtctgttgatgcacaggttgcaaacttcaacactatgatgcaacaatagcaagctgactggcaagcgtttcaccgctaccagggatttgatccccgccatgagccatagcaagaagcaagcttgggggggagatgtctctccccccactaaggtaacttgtatcatattgcatatttccctttcaaattacatgtttaaatttttgcattgcatttataaacctgaaaacaacataaaaatttgcaaaactaaaaataccaaaaagataggttagatttaatatgctaggtaagacatgcttagttcttcatgttgaaatgatgaatagttgctctgttttatatctctcatatatgggttcatggttaagtactctctcaaaatttgaataagggtagcctacaattatccaggaacctgaggtaagtgagctgcactttgctgatctgagtctaggttgttgcgagatatgagatagtaaataagagttgctataaataatcatgttctaagtttgacttgaattccggatgttttatttttcaaaatgataattttgaaagttcctcatttgatatgaattcctaccagagccaaaatattcatattgattaagccatatacattttggttacttgtaattccattaaattttgtcaaatccttgtgacttgtgtagatacttttcatgctctatgtgatcattgatggaggtagctgcaacaacttggtgagttttgatttggtcaagaagcttggcttgactacacgtacacatccacacccttaccatattcagtggttaaacgattccggaggagcaaaggtaacacaggtttgtagggtttcgttttccattggctcatatgcagattctgttgattgcgatgtggttcctatgcaagcttgttcacttttgctggcccgtccttgggaacatgataatgatgctacacaccatggtaggagtaataaatacagttttgtgcataatgggaagaaaattactttgctacctttgacccctgctgaaattgtagaagctgataaagagcgagctgctagtttgaaacttgatgaatctgaaaatcagcaagtggctaaatctgtttttccaactaaaaaggataagctttcacctagttctaaggttgagggaattaagttgaagggtggtg

SEQ ID NO: 9716 - DNA, 622 bp, Oryza sativa
tgcaggagtatgatgatgtctttctagctgagatacccccaggattgccacccatgagagagatagagcatcaaattgatttgattccaggagcatcattgccaaaccgtgttgcttatcgaaccaacccagaggggactaaggaaattcagcggcatgttcaagaccttttggaccgcgggtatgtacgtcaaagccttagtccctgtgcagttcctgtaattttggttcctaagaaagatggttcttggcgaatgtgtgttgattgtagagccattaataatattactatccgatatcgtcatcctattcctaggttagatgacatgcttgatgagttgtgtggctctataattttcacaaagattgacttgcgtagtggctatcaccaaattagaatgaaacttggagatgaatggaaaacaacttttaaaactaaatttggtttgtatgagtggttagtaatgccttttggtttgactaatgcacctagtactttcatgcgcttaatgaatgaggttttaaggccttttattggacgatttgtggtagtgtactttgatgacatattgatttacagcaagtctttggatgaacacatggatcatttacgtgctgtttt

SEQ ID NO: 9717 - DNA, 865 bp, Oryza sativa
caaatgaagttgcaagcccataggcccattataggtgatgcaacaccttgttcctgtgattctgaccactcgtgatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttgttgttcatccatgatgtgagcaatggttgcatccgtggtagccatggtcgcacccgtgggggctcaatatatgccaatattggcataaattgataaaagttcttcgtgcgaatcacgaagtgagtttttgccacgaacacacccaatacactgcaatatgtccaaaaatcatgttttggtgatttttgaactttttcaatccggtcaaaaacatcgcacccgtgggggcctatatatgctaaatattggcacttattgacaaaagttcgtcgcgcgaatcacgaagtgagtttttgccacgaacgcacccaatacactccaatatgtccaaaaatcatgtttggatgctttttgaacttaatcaatccggtcaaaaacatcgcacccgtgggggccaatttgtgctaaaattgacactaattgacaaaagttcgctgtacgaatcacgaagtgagtttttaacacgaacgcacccaatacactccaatatatcaaaaatcaagtttgatgccttttgaacttttttattctggtcaacaacatcgcatcagtgggggctcaatatatgccaatattggcataaattgacaaaagttcttcgtgcgaatcacgaa

SEQ ID NO: 9718 - DNA, 705 bp, Oryza sativa
gggctcaacatatgccaatattggcattaactgacaaaagttcgccgcgcgaattacgaagtgagtttttgccacgaacgcacccaatacactccaatatgtccaaaaatcatgttttggtgctttttgaactttttcattccgaacaaaaacatcgcacccgtgtgggccaatatatgcaaatattgacattaattgacaaaagttcgccgcgcgaatggtgccaatacactagaaaatgtgcaaaaatcatgttttggcgtttttcgatctttttcattccggtcaaaaacaacgcaccctcgtgtgccaatattggcattaattgacaaaagttcgtcgcgcgaatcacgaagtgagtttttgccacgaacgcacccaatacactgcaatatgtcagaaaatcatgtttttgtgctttttgaactttttcattccggtcaaaaacatcgcacccgtgggggctcaacatatgccaatattgacattaattcacaaaagttcgccgcgcgaaccacgaagtgagttttttccactaacggtgccaaaacactagaatatgtgcaaaaatcatgttttggcgttttttgaactttttcattccggtcaaaaacaacgaaccctcgtgtgccaatattggcactaattgacaaaagttcgccgcgcgaatcacgaagtaagtttttgccacgaacgcacccaata

SEQ ID NO: 9719 - DNA, 923 bp, Oryza sativa
ggtaaatgatacgaatttttttgtatggctattttctggttataggaagataaaaactcaccgagcaacgaaagctctgataccacctgatgaaccctgagttcctctcaacactcaaggctgttgttggcccgatctttcggtgagttgtgataactacgatttgggagaaacgttgacgatccgactacaaacgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctatcaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacagcagatgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatgatcacatcaaaacatcgcacccgtcggtgctcaatatgtgccaatattggcat

SEQ ID NO: 9720 - DNA, 2165 bp, Oryza sativa
taaggctcgtcctagggtcaagggggctctgataccaacttgtcacgaccggaaataacccaacgggcgttccttacgtgcgtgcattattccttgtcccaggagacaagcggaagcgtaattaattaatttattacatgggcggcgaagacccagcacacaagaagacaaacgaaaaatagcggaagactagggcgatgaccacaggcgcttgacggcaggcacgagctagacaccaaagccttcatcatccaggggctcctcttctgggtttgggaaaaattgagcaagactgagaacaaccaccgtactcaacaagacacacccacaagtgcagaataaatgcaagggagtacaagggagtacaagggagccataatatagggggttagggtttgcagtaaacagcattaaaagacacttagttgctcaaagctattttgtaaacaccgtcctagagctatacaatattattaaccaaggctgtgaacccacacgaacctgccttaacccaaggcctacgatgattcagaccgaactggcaacccgaccctgggtgccagctcgtcccaagccaacctaggccaaccattccacattttagttgttaagcaggttttaagaattaaaacactaaattgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaaccatttttggagattttgaatagagggggcggtgtgaatccaattccacaataattcatccattccatagtgtccaggtgatgagaatatcccaaagtctagaattgaaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaagttaaataggcatggctagataaaacagtgattacgcgggaatttaaataaagcgatagtgcaataatttaaatcaacataattttataaactgggattcaatatgttcaaggatgatgtgacttgccttgctcgctttcccaaacgtcggcttcaacttccacgaagagtggatcttccgaagctgcagcgtctacacgaccaacggaaaagaaaaggcttttactctaataaactccacataacaagcaggaacaaagcacaaaaatgggttcttgacttcttaaggaaaaattagagacttgaacggtccaattccgagttcaaatggccaagttatggccatttgaaggttatatgctctttaaatgaatatttacgaatttctttatttaaattttaatttaaaaatggatttattgcgtcagccgaggggaggggcgcgcggaccgggtccatgggggtggggcccacgcggcagccccacggcccacggtggaccgggcgcacccgggctcacaccggccggcaccgtgggtcccacgcgtcagccgcacccgagggcgcgggcggctgacagccgggccccacgcggcagccgcacggtgcgcccgaaggcggccacgccggcgcagcggcgggaggcggcgcgcccgcgcccctatggtcgccggcagcggccataggcacggcggaacggcggcccaaaaagggggagggaagggggaaaagaaccggcggtcca

SEQ ID NO: 9721 - DNA, 5789 bp, Oryza sativa
gtcattcggacggcgaacttttgtcaattaatgccaatattggcacacgagggtgcgatgttttgtactgtaatcaaaaagttaaaaaagcgccaaaacatgatttttggacatattggagtgtattgggtggatacaaggaaaaaactcacttcgtgattcgcgcggcgaacttttgtcaattaatgccaatgttggcacacgagggtgcgatgtttttgaccggaatcaaaaagttcaaaaaacgccaaaacatggtttttggacatattggagtgtatcgggattgttcgtggcaaaaacacatttcgtgattcgcgctgatggacccggagttcctctcaacactcaaggcttttgttggcccgatctttcggtgagttgtgataactacaatttgggagaaacgttgacgatccgactacaaccgtacgagacgttgtgttgcgccttagcgatcgatacacctctctgtgggttgttgatcttgccggtgcagatcaaccttattcctgcaagcaaatcgaagaaacaagcaagaacaagataaaaagcaatctgatattgcaaataggaatttaatacaaatgataagttggggttccgaagaacaagcagacggacggtctagccgacacgcgcgctgtaagcaagtagcaatggctaaactttaatctatcaaaaccccgagaaactctaaaggggaacctaactatttaagaaggtgggaggacgacctaagggaaccctagggtcgtgctccacctggttggggcgcaccccacttgggccccacttgggccggggtcccagacgaagttacaagcccattataggtgacgcagcaccttctttttgtgatttcggccgactgggatggaatttggtgatgaagctggatccatttgaaagatgactccgagagctttccatcaagtactcatggacccaaaagggagctcgcatgcatatttggcggccgtctgaagtcgattctgttgcaggtggctgaactggattgcagaacttggacggcctgatcttgatgtgaacgacggttgtatctatagtagtcatggtcacatcacgcgcggcgaacttttgccatataatgtcattattggcatattttggcctacacgggtgcgatgtttttgaccggaatgaaaatgttcaaaaagcaccaagacatgatttttgcacatattggagtgtattgggtgcgttcgtggcaaaaactcacttcgtgattcgcgtggcgaacttttgtcaattaatgccaatattagcatattttggaccacaccggtgcgatgtttttgaccggtatgaaaaagttcaaaaagaaccaaaacatgatttttggacatatttggagtgtattggttgcgttcgtggcaaaaactcacttcgtgattcgcgcggtgaacttttgtcaattaatacaaatattggcacacgagggtgcgatgtttttgaccggaatcaaaaagttcaaaaaacgccaaaacatgatttttggacatattggagtgtattgggtgcatacatggcaaaaactcacttggtgattcgtgcggcgaacttttgtcaattaatgccaatattggcacccgagggagcgatgttttgtactggaatcaaaaagttcaaaaagagccaaaacatgatttttggacatattggtgtgtatcaggtgtgttcgtggcaaaaacacatttcgtgattcgcgtggctaacttttgtcaaataatgtcaatattggcatatattagcccacacgggtgcgatgtttttgaccagaatgaaaatgttcaaaaagcaccaaagcatgatttttggacatattggagtgtattgggtgcgttcgtggcaaatactcacttcgtgattcgcgcggcgatcttttgtcaattaatgccaatattggcacacgagggtgcgatgttttctactggcatcaaaaagttcaaaaaacaccaaaacatgatttttggacatattggagtgtatcgggtgtgttcgtggcaaaaacacatttcgtgattcgcgtggctaacttttgtcaaataatgtcaatattggcatatattggcccacacgggtgcgatgtttttgaccggaatgaaaaagttcaaaaagcaccaaaacatgatttttgcacatattggagtgtgttgggtgcgttcgtagcaaaaactcatttcgtgattcgcgcggtgaacttttgtcaattaatgccaatattagcatatatcggaccacacgggtgcgatgtttttgaccggaatcacaaacttcaaaaaagcgaaaacatgatttttggacatattggagtttattgggtgcgttcgtggcaaaaactaacttcgtgattcacggggagaacttttgtcaattaatgccaatatcggtatatattggcccaaacaggtgcgatgtttttgaccgtaatgaaaaatttcaaaaagcaacaaatcatgatttttggacatattggtgtgtattgggtgcattcgtggcaaaaactcactacgtgattcgcgcggcgaacttttgtcaattaatgccaatattggcacacgagggtgcgatgttttgtactgtaatcaaaaagttcaaaaagcgccaaaacatgatttttggacatattagagtgtattgggtgcattcatggcaaaaactcacttcgtgattcgcgcggtgaacttttgtcaattaatgccaatattggcacacgagggtacgatgttttctactggaatcaaaaagttcagaaagagccaaaacatgacttttggacataatggagtgtatcgggtgtcttcgtggcaaaaacacatttcgtgattcgcgtggctaacttttctcaaataatgtcaatattggcatatattagcccacacgggtgcgatgtttttgaccagaatgaaaaagttcaaaaacgccaaaacatgagttttggaaatattggattgtactgggtgcattcatggcaaaaagtcacttcgtgatttgcgcggcgaacttttgttaattaatgccaatattggcacacgagggtgcgatgctttctactggaatcaaaaagttcaaaaagagcccaaacatgatttttgacatattggagtgtatcgggtgggttcgtggcaaaaactcacttcgtgattcgcgcgacgaacttttgtcaattaatgccaatatttgtatatattggcccatataggtgcgatgtttttgaccggaatgaaaaagttcaaagtcaaacataatagttttttctcttttctttctttcttcttttctttcctttccttttcttttcttttttttttgggtgcggcttttcttttcttttttttatgcacctttctgcctttttttttctttcttttttttttattttattttacaaaaacagattcaaggacctcaatgtaaggctatagggactcaaacataaatataaaatttacagtgactcaaatgtaaaagtctaaaaccaaaattaaaattatacaaaaatggaatgctgaatttatactggttccgtttttctgaacggatatcgaaacggacaccaaacaaaaattcaccaaggtgtaaggatggcacggtgtagattgaaccgaaaggagagggagtcggactcaaggggggaatgccgcatggaaggtggttggactcggtgagaatttctgaaggaaggaaaccgattccttttctgcgtggccccaaatagaaacgaaagtaatctaatctagtctaatcttctccttccatcttcctcatgtgcatcttctcccttcttcctcacgcgcacatgcacggcagaaacaaacacacacaaggataggcaaactctagatgcaacacaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaaagccagcagctcgacgtgacgatgcaacacaaaattcaacaaagcaaaaactgaagagaacaatgcaatggcacaatatggctaggtaaatgatacaaatttttttgtatggctattttctggttatgggtagaaaaaaactcaccgagcaacgaaagtctctgataccacctgctgaaccctgagttcctctcgacactcaaggctgttgttggcccgatctttcggtgagttgtgataactacgatttgggagaaacgttgacaatccgactacaactgtacgagacgttgtgttgcgccttagcgatcgatacacctctccgtgggttgttgatcttgccggtgcagatcaaccctattcctgcaagcaaatcgaagaaacaagtaataacaagataaaagcaatctgatattgcaaaaaggaatttaatacaaatgataagttggggttccgaatacaagcagacggacggtctagccgacacgcgcgctgcaaggaagtagcaatggctaaactttcatctaaacaaaacctgagaaaccctgaaggggtaactagctatattgacattaattgacaaaagttcgccgcgcgaatcacgaagtgagtttttgctatgaacgcacgcaatacgctccaatatgcccaaaaaacatgttttggcgctttttgagctttttcattccggtcaaaaacatcgcaccctcgtgtgccaatattcgcaattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaattgacaaaagttcgccgcgcaaatcacgaagtgagtttttgccacgaacgcacgcaacacactccaatatatccaaaaatcttgttttgccgtttttttgaacattttgattctggtcaaaaacatcgcacccccgtgtgccaacattggcattaattgacaaatgttcgccacgcgaatcacgaagtgagtttttgccacgaacgcacccagtacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtccaaaaatcatgttttggcgttttttgaactttttgattccggtcaaaagcaacgctccttcgtgtgccaatattggcattaattgacaaaagttcgccgcgcgaatcacgaagtgagtttttgccacgaacgcacccaatacactccaaaatgtccaaaa

SEQ ID NO: 9722 - DNA, 6590 bp, Oryza sativa
cgcacccaatacactccaatatgtccaaaaatcatgttttggcgttttttgagcttttttattccggtcaaaaacatcgcaccctcgtgtgccaatgttgccattaattgataaaagttcgccgcgcgaatcacgaagtgagtttttgccacgaacgcacgcaacatactccaatatgtccaaaaatcatgttttggcattttttgaactttttgattccggtcaaaaacatcgcaccctcgtgtgccaatattcgcattaattgagaaaagttcaccgtgcgaatcacgaagtgagtttttgccacgaacgcacgcaatacactccaaaatgtccaaaaaacatgttttggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccctatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttttgtgatccagaagatccacatcaaagtgccgttgttggatgctatgcaagtgccaacatacgcccgttatctcaaggacatactcaacaacaagagaccgctgccaacaacggaggtggtcaagctgacggaacaatgcagcaacctgatactccacaagctcccggagaagaagaaagatccggggtgtcctatgatcacctgctcgatcggggcacaacaattcgaccagacctggtgcgaccttggagccagcgttagcgtcatgccaaaagacgtcttcgacaagttcaacttcacagtgttggaaccaacaccgatgcgcctccaactggctgactcatcagttcgttacccagcaggaatagcggagaatgtgccagtcaagatacgggatttcttcatcccggttgattttgtggtgctagacatggacatggggaaggagatgccgctcatcctagggcgtccattccttagtaccgcaggagccaacattgacgtgggaacggggagtatccgtttccatatcaacgggaaggaggaaaagtttgagtttcaaccaaggacggaacaatgctccatggtcagaataaagtacgggccgaatccgtagaatattcaagtggtcgaagtggagccacccaaaacggacagcttggtgatatttatgcagaatttcctggagaaggaaacaacgatgcccaggaaccgttattggaaaacgccggtaaaatcacccgtaccggccaagaagtcagatcagccggctcagaagaagccgccgtccgcaccaaaatcaaaaaaggtgtggaaggaaaagctaaagatgcccgctccatcacctccggagacgggtgaaaaatcagtgcactaaaccgaaaggaggtatgtatccgcatatttgctttcaacaatttaaatttttgtatcaccacatatttgaatttcaaaatgcatttaggctttttgaatttttaggaaattcttcaaatgaattttccagagcaaaccaaaataaaattttcaatgaaaatttattgtgccacgaccacactgaccgttggaatccaacggctgaaagtggggccggttgggcccaccaggggtttggccgaacaccctggttcggcctaaccggccaggccaacggtcggctgcctctttctttgaggcaacgtgatgaaccctgagttcctctcgacactcaaggctgttgttggcctgatctttcggtgagttgtgataactacgatttgggagaaacgttgacgatccgactacaaccgtacaagacgttctgttgcgccttagcgatcgatacacctctccgtgggttgttgatcttgtcgatgcatatgaaccctattcctgcaggcaatcgagaacaagcaagaacaagatagaaagcaactgaattgctagatagacaagacgcacaaagatgaattgatacacgataaagtggggttctgaacaagcagatggacggtctagccgacacgcacgctgcaagcgaagtagcaatggctaaacttacaatttatcaaaaccccagcaaccctaaaggggtatctagctacttataggggtgggagaatgaccataaggatcctagggtcgtgctccaccagattggggcgcaccccacatgggccccacttgggccggggtcccaaacgaagttacaagcccaaaggcccatgacaggtgacacaacaccttgttgcttcaattgcggctcaataagatggaatttcgcaatgaggctggatccgttggaaagaggactccgagagctttccatcaagtactcacgggccaaaaacggagctcgtatggagatttggtggccgtttgaaattagcagtgcagcaggtggccgaatcggattccagcatttggaggccttgaccttgatgtcttcttgttcatccatgatatgagcaatgtttgtatccatagtagctatggtcacatcatcctccccttcttcacggaaaatcgtcgtcgttttttccatatggtgctcttcatatagtccattcaaaataacctgtttcatccaatcaaaactagacaaactcgaagtagtgtgattagcaaaaacatgtttctgtaaatgcgaacaaatgaaaatgctatgcaccaaatatattcctctatcattatattcgccaaagatatgaaaaataacattagttggacatggcaaatcaaacttagcaaataaattctcctccaaattattgagctcacaaaaatcatcaaactgaacatagcccgagtattgaaagaagttatcaatttacgttcctcaatatcattagcaatgtgaacaacatgcttaaaatcagcacacaataaaacactagaaatagcatgttcattcactagttgtggcatggatataagtgaagcattatcacacaactcttctctatcacaaggaacagcaagtaaatcaacttgtgacaaaggcatctcagcaattggttccactaatagttgctcttcactagcatgacaagtggaaaaatgtaattcatcagaagcatactcatcttgagtaatttctgcaccatttaatttaccttttatgccctcttcagataatgtaggtgcatcagccttctcctcattcgcgagtgatggaagtgacatctcaaacatatcgttcttctcattttggggactgttctgaacttcctgcaaaatatcagcgataggaggcacaagcatagcttgttgctccattgggttctccaaaattttgcgctcaatattgcaagcaagcatgaacaattggcctatatgattatatgtcacattaacaagcccaacctgaatattggaattaagccctctgaaaaatctagtcattgtgttctcattagattcttgtaaaccactataagtgatacaaattttaaaatcatgaaagtactccctaacagttttgtcaccttgttttatatgttcaaatttctcaaagagagcacgtctatagtatgaaaacacaaatctttttctcatcagtattttgcattcatcccaagtttcaagcttatttcccacagtatgccaccaaaaagatgcagaaccgatacacttattactaacagccttaatcatttgagcattagaaaaatcatactcatcaaattgtttttctactgctagctcccaattaacataagcggcagaatcatacttaccatcaaaaactggcaatttagattctacccttgcaagatcattatcaggtacctcatatgtgatgcgtgaagaagtcgctatatctcgttgatggtgaagatgttgacgttgagcatgaccatctcatttccccgtgcgcaatcctgccatggttagtagcaaacaagaaacatacacaaaaatatgcgcgttcctattaactagtaggtagtggcagctcaaaaatcacacacactcaagcttttaaccaagctcttacaacatcttaccaatgcaagcggaatggtgacatacaccgactcaaccaagcaccccaatggaggttggatgtatcgatgccttggcaaacacttactgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgtgagcctacacacaaatgataccacaagatagcactaggagcaactcatgcacaactctgatatatgaagttcagctcaatgataacaaaatgattttctccttttcttctttttttctctctctttttttttgtctttcctgcttttcttttctttttcttttctttttttggtgcggcttttgttttctttctttttagcacctttctgccttttttttcttttttttaaattttttttcagcaaaaaccaactcaaggaccttaatgcaagattacaaggactcaactgtaaatatacaaattacagggattcaaatgcaaaagtgcaaacccaaaaattaaaattatacaaaaatggaatgctgaatttatattggttccgtttttccaaacggatctccaatcggacactctgaaaattttcaccaagctatgcgggaagacacggtatggatctaaatcgatagaagagagggaggagtcggactcggaggaaggaaggcaccacagagaggtggagctgaatattgcggccagcactagtgtttggattcagtgcacaaaataaaaggaaacggatttccacccgatctaatcttctttttctttcctattctgttctttcctttttttttctttccttccacccaaccgaatccaaacagatcttctatattcctttccccttcttcttcctcaagggcaaaacagaaccacagcacaagcactaagcctgggtaaacaacaaacccttgatgcaacaccaaaaccgaccgataaaaacttttgaaaactacaaaaatagaaccatggcagcaagccgattccgttttcgtaggtcccgacgataacagagacacggaggcggcaatgactctggtataaaacgtgaccagaacacgaaacactaaacgaactagacgctaaggcgcaacacaacgtcttgtacggttgtagtcggatcgccaacgtttctcccaaatcgtagttacctacaactcaccgaaagatcgggccaacaatagccttgagtgtcgagaggaactcagggttcagcaaaaactgaatagaacaaagcaatggcacaaagatggctagggacatgatgtaaatttttttgtatggctattttctgcttataggtagaaaaaaactcaccgagcaccgaaagctctgataccacctgctgaaccctgagttcctctcgacactcaaggctgttgttggcccgatctttcggtgagttgtgataactacgatttgggagaaacgttgacaatccgactacaactgtacgagacgttgtgttgcgccttagcgatcgatacacctctccgtgggttgttgatcttgccggtgcagatcaaccctattcctgcaagcaaatcgaagaaacaagtaataacaagataaaagcaatctgatattgcaaaaaggaatttaatacaaatgataagttggggttccgaatacaagcagacggacggtctagccgacacgcgcgctgcaaggaagtagcaatggctaaactttcatctaaacaaaacctgagaaaccctgaaggggtaactagctatattgacattaattgacaaaagttcgccgcgcgaatcacgaagtgagtttttgctatgaacgcacgcaatacgctccaatatgcccaaaaaacatgttttggcgctttttgagctttttcattccggtcaaaaacatcgcaccctcgtgtgccaatgttgcaattaattgagaaaagttcgccgcgcaaatcacgacgtgagtttttgccacgaacgcacgcaacacactccaatatacccaaaaatcttgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtc

SEQ ID NO: 9723 - DNA, 3340 bp, Oryza sativa
  unsure (1)..(3340): unsure at all n locations
ggttccgaacaagcagacggacggtctagccgacacgcgcgctgcaagcgaagtagcaatggctaaacttacaatttatcaaaaccccagcaaccctgaaggggtatctagctacttataggggtgggagaatgaccatgaggatcctagggtcgtgctccaccggattggggcgcaccccacatgggccccacttgggccggggtcccaaacgaagttacaagcccaaaggaccatgacaggtgatgcaacaccttgttgcttcaattgcggctcaataagatggaatttcacaatgaggctggatccgttggaaagaggattccgagagctttctatcaagtactcacgggccaaaaacagagctcgtatggagatttggtggccgtttgaaattagcagtgcagtaggtggccgaatcggattccagcatttggaggccttgaccttgatgtcttcttgttcatctatgatgtgagcaatggttgtatccatagtagctatggtcacatcacaaaggctagtgggccccacaggttagttttgaccgttgtggatgcactatttaagccaaccggccgggagaggggactccaccccatttcaacacatttccattccctctgcaaagtttgctgtctagttcattcaagctgtgatattttccctcaaatttaaatctttagttgcatatatacaagttgctttggtgaaactaaccggcaggtgaaactcttatcattcctaacccccgccgagttagtccgttcttgcttcattgtgcagaatgaggaggcgattgtctcaactgttcaaagggtccggcccttcatcaagtcatcatgacgggtctagcactcgttcatcagctaatatctcgatggaagacgccgaagctccgcgacatgatacggacatcactacctcggatacacacaacaatcctccaatggtcattcaaggactgatagcaagagctcgtgcgcgacaattaaatttagaggtgagctcgttcctatgttcttctttgtatgaattcgagaaaagattgctacctaatgaatatattgtgattagaaataatagaggggacaaggagacacttggagaaggacttagagccatggaggatcatcgaggacgtccaagtcaaggtggaggcccaaaccaattcgacctcggtgcaattcggagtctaggaccagtctgcactaaaacgggcgcccaggtcgcatacgtgctcggattggggcgttctttatatgaatggaaaactaagaagataacctttccaatggttttggtcccacatccaaatactttccgagtcaatgggtatcgaccgaacaagttgacatccagaatctgtcccggtgctgtgtcaccgtatttgggcctttgggccatgtatcgtgttggaacccattagggttgcgtcgagagggggttgcacgagcctaaactctatatatcagtaccgctaccatctttaggttttagagttttgcttagattattctgtcgagaacagtttcgccgctagatcggtttgtaagaccccaactcgtgagcttatcattcatctgcaattttggttgttttctatctcgtttttgtttgtgttcttcgattggcaaatagggattagccttcttggcgaggtcatccgcgtttcgacacgggtgataaccagaggagacgtggtgttgcgattgcggggctcaagagcgtgcgcgttcaagaagccggatcgatttgtgtcgcgactccgcccaaatcattttttatcagaacctttcggaagatcgggaaccctagtgcacatcaagtggtatcggaggccgttgtaaagtctgtccaagatgccttcactaaaatcggcttcctgaaccacatggagaggttggacaagcagatatccacgctaactgatcgggttgccgcgttggagacaccttccaatgaggaagtggtgagtggtgatgacgatgctcattcggaagacacggtgtatgattccagtggctatattgacacaccagctacaaggcaagcacggctatgacgtcgcctacgcataaaccgcacaggtatgggtggcactcgccaccaacaaggtaataataatcgtgtgccagatgatccttatgctaaggttaagtttaaaataccatctttttcgggatattatgatgctgagaaataccttgattgggagatggcaatagaacaaaagtttaatgcccaccttgtacctgagcaacatagagttaaacaagctagtagtgagttcaaggattttgctatcatgtagtgggctgggttatctgatgagggggtactacctactacttgggaagaacttaaggtagctatgcacgataggtttgttcctccatcttatcatagagatttacgcaagaaattgatgcgtttggaacaaggggataaatccgtacaggattactatggtgagctacaaaagggtgtgagacgctgtggcatagtggagggggtcgaggatgctatttttcgtttttattctggtttgagggaggaaattcaaaacattgttgattataaggaatttaactctatgaaccagttgttttggtttgcaatgcttgaagagaaggaattgcaggggcgtgaccatcagggcaagaacaaggcaagcacatacactccacgcacgatgccatctacgggactacccagggccgtttcttttcgggcgccttcccagccagcgagcaagcgaccagctgcattcggagcttctgcggcaccaaaaccatctccaccacaaccagcagagtcaggtaatggttcttcgcaggtacccgccaagagtgcctcatctgtcgcctcgacgggacgcattcagtgccaccgttgccaagggtttgggcatgtgcagaaagattgccctattcaacgggcctatgttgctacagaagatggctacatcaccacctccgacgtggaagaggaagaggaggaagaagaagttgaggatgaggatggagaagtctttggccgtgatgacacaactgactacaggaccatcgttgtgcagcgggtgctcagcatgcaggtacagcagcctgagaggttgcaacgccataatttgtttcagattttcttcgtcatcaacaaccgtcgtgcacgtgtgatcattgatggaggtagctgcaacaatttggtgagttctgatttggtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9724 - DNA, 1178 bp, Oryza sativa
tgggtgcgttcgtggcaaaaactcacttcgtgattcgcgcggggaacttttgtcaattaatgccaatattggcatatattgagcccccacgggtgcgatgtttttgactggattcaaaaagttcaaaaagcatccaaacaggatttttggacatattggaatgtattggttgcgttcgtggtaaaaaatcacttgatgattcacgcggcgaacttttgtcaattaatgccaatattagcataaattggcccacacgggtacgatgtttttgaacggaatgaaaaagttcaaaaagcaccaaaacattatttttggacaaaaactcacttcgcgattcgcgcggcgaacttttctgaattaatgccaatactggcacacgagggtgcgatgtttttgacaggaatgaaaaagttcaaaaagcaccaaaacatgatttttggactttttggagtgtattgggtgcgttcgtggcaaaaactcacttcgtgatttgcgcggcgaacttttgtcaattaatatcaatattggcatatattgagcccccacgggtgcgttgttttcgaccagattgaaaaagttcaaaaagcatccaaacatgatttttggacatattggagtgtattgggtgcgttcgtggcaaaaactcacttcgtgattcgtgcggcgaacttttgtcaattaatgccattattggcatatattggtacacgtgggtatgatttttttgaccggaatgaaaaagtttaaaaaccacaaaaccatgatttttagacatattggagtgtattgtgtacgtccgtgtcgaaaaatcacttcgtgactcgtgcggctgatgaaccctgagttccacatgacactcaaagctgttgttggcccgatctttcgatgagttgagataactacgatttgggagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcaagaacaagataaaagcaatttgaattgcaactaggaatgaatgcacacaataagttggggtttcggatacaagcagatggacggtctagccgacacgcgcgctgcaaggaagtagcaatggctaaactttc

SEQ ID NO: 9725 - DNA, 2748 bp, Oryza sativa
cgtgcaatgtttttaatcggaacgaaaaagtttagaaagcaccaaaagatgtgttttggacataatggagtggattgggtgcgtccatattgaaaaatcactccgtaactcgcgcggcgaaagtttgtcaattaatgccaatattggcctacattgccacacgtgggtgcgatgtttttagccggaaaaaaaagttcaaaaaccacaaaaacatgagttttggacatattgcagtagattgggtgcgccctcgtcgaaaattcactccgtgactagcgtggtgaacttttgtcaattaatgtcgatattggcatatattgagcaccgacgggtgcgatgtttttttgaccggaatgaaaaagttcaaaaagcaccaaaataagacttttggacatattggagtgtatttggtgcgttcgtggcaaaaactcacttcgtgattcgcgcggcgaacttttgtcaatttatgcctatgttggcatatattgagccctcacgggtgcgatgtttttgaccggaatgaaaaagttcaaaaagcaacaaaatatgattttttgaacatattggagtgtattgggtgcattcgtagcaaaaacattaacgaacaattgtcaattaatgccaatattggcatatattgagcaccgacgggtgcgatgtttttttgaccggaatgaaaaagttcaaaaagcaccaaaataagacttttggacatattggagtgtatttggtgcgttcgtggcaaaaactcacttcgtgattcgcgcggcgaacttttgtcaattaatgccaatattggcatatattgagcccgacgggtgcgatgtttttttgaccagaatgaaaaagttcaaaaagcaccaaaataagacttttggacatattggagtgtatttggtgcgttcgtggcaaaaactcacttcgtgattcgcgcggcgaacttttgtcaatttatgccaatgttggcatatattgagccctcacgggtgcgatgtttttgaccggaatgaaaaagttcaaaaagcaccaaaacatgattttttgaacatattggagtgtattgggtgcgttcgtagcaaaaacattgacgaacatttgtcaattaatgccaatattggcatatattgagcaccgacgggtgcgatgtttttttgaccggaatgaaaaagttcaaaaagcaccaaaataagacttttggacatattggagtgtatttggtccgttcgtgccaaaaactcacttcgtgatttgcgcggccaacatctgtcaatttatgccaatgttggcatatattgagccctcacgggtgcgatgtttttgaccagaatgaaaaagttcaaaaagcaccaaaacatgattttttgaacatattggagtgtattgggtgcgttcgtgatgaaccttgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcacccctattcctgcaagcaaatcgaagaaacaagcaagaacaagataaaagcaatctgatattgcaaataggaatttaatacaaatgataagttgggttttcgaatacaagcagacggacggtctagccgacacgcgcgctgcaagcgaagtagcaatggctaaactttcatctaaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcaccttgtttcttcagttgctgccgactgagatggatattggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatgttgagaccccacgggtgcgatgtttttgaccggattgaataagttcaaaaagcatccaaacatgaattttggacatattggagtgtattgggtgcgttcgtggcaaaaactcacttcgtgattcgcgcggcgaacttttgtcaattaatgccaatattggcatatattgagcccccgcgggagcgatgtttttgactggattcaaaaagttcaaaaagcatccaaacataatttttggacatattgtagtgtattgggtgcgttcgtggcaaaaactcatttcgtgatttgcgcgccgaactattgtcaattaatgccaatattggcatatgttgagaccccacgggtgcgatgtttttgaccggattgaataagatcaaaaagcatccaaacttgaattttggacatattggagtgtattgggtgcgttcgtggcaaaaactcacttcgtgattcgcgcggcgaacttttgtcaattaatgccaatattggcatatattgagcccccgcgcggagcgatgtttttgactggtttaaaaagttaaaaagccttccaacat

SEQ ID NO: 9726 - DNA, 777 bp, Oryza sativa
tcgcacccgtgggggctcaacatatgccaatattggcattaactgacaaaagttcgccgcgcgaattacgaagtgagtttttgccacgaacgcacccaatacactccaatatgtccaaaaatcatgttttggtgctttttgaactttttcattccgaacaaaaacatcgcacccgtgtgggccaatatatgcaaatattgacattaattgacaaaagttcgccgcgcgaatcacgaagtgagttttttccacgaatggtgccaatacactagaatatgtgcaaaaatcatgttttggcgttttttgaactttttcattccggtcaaaaacaacgaaccctcgtgtgccaatattggcactaattgacaaaagttcgccgcgcgaatcacgaagtaagtttttgccacgaacgcacccaatacactccaacatgtcaaaaaatcatgttttggtgccttttgaactttttcattccggtcataaaacatcgcacccctggggctcaacatatgccaatattggcattaactgacaaaagttcgccgcgcgaattacgaagtgagtttttgccacgaacgcacccaatacactccaatatgtccaaaaatcatgttttggtgctttttgaactttttcattccgaacaaaaacatcgcacccgtgtgggccaatatatgcaaatattgacattaattgacaaaagttcgccgcgcgaatggtgccaatacactagaaaatgtgcaaaaatcatgttttggcgtttttcgatctttttca

SEQ ID NO: 9727 - DNA, 1293 bp, Oryza sativa
aaacttgggcttgggccttgtatcattacagcccattaggggtccacaaaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcagaccgccaacgtcgtatccttccccaaatcgaagtttaccctcctctcatcgaaagatcgggaacccccgttgctgcatcatgccaatattggcattaattgacaatagatcgccgcgcgaatcacgaagtgagtttttgccacgaacacacccgatacactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccacgaatgcacccgatacactccaatatgtccaaaaatcatgttttggctctttttgaactttttgattccagtacaaaacatcgcaccctcgtgtgccaatattggcattaattgacaaaagttcaccgcgcgaatcacgaagtgagtttttgccacgaacgcacccaatacactccaatatgtccaaaaatcttgttttggctctttttgagctttttgattccagtacaaaacatcgcaccctcgtatgccaatattggcattaattgacaaaagttcgccgcgcgaatcacgaagtgagtttttgccacgaacgcacccagtacactccaatatgtccaaaaatcatgctttggtgctttttgaacattttcattccggtcaaaaacatcgcacccgtgtgggccaatatgtgccaatattgacattatttgacaaaagttagccacgcgaatcacgaaatgtgtttttgccacgaacacacccgatacacaccaatatgtacaaaaatcatgttttggctctttttgaactttttgattccagtagaaaacatcgcaccctcgtgtgccaatattggcattaattgac

SEQ ID NO: 9728 - DNA, 679 bp, Oryza sativa
  unsure (1)..(679): unsure at all n locations
agagttgcaatcctctttcataatatactattttgatgacttcaacataccgctgtagaaataccctcccaaaactatattttctttcttaacatggaaaacatacaacacctaatgcataattttctggtgaactgtttttttcctctaaagtgctttgtatgtngaatgtaggtaagaggtatgcgacacnagttgcctttttgttttagaaagggncctaacttgcancttttacccagaggaaattgaggggaccggtatcgtcggaaagaaccctggcaatggcnnaagtcaactttgattcaagcaccctattccgcatcgtcgaacccatgtannttgggcaagtgttgatagaaatggccttgacnatttgcaccattnggactacatgnatctacggacaagattgagcatcattcctcaagatcctgtgatgtttgaggggaccctacgaaataacattgaccctttggaggagtacagcgatgagcaaatctgggaggtaattcttattttaaatttactagtacctccatccctaaataacatatggaagacaaattactatagaaaatacatgacattcataccccaaattaaatgagggatggattgaagagaaagggtagttagctttagaagcatacttattttggggacaaaacttgagtgt

SEQ ID NO: 9729 - DNA, 11318 bp, Oryza sativa
  unsure (1)..(11318): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaatggctgtcccaccgtagcgcacctgcctcactcaggggtgaaccatctatgcagggatactgcttccgctcggctatctactccgctaggtctatacccatacgagaagtgcggttgtacgagggtcgtttcatgcttaacttcatggctcggtccttaattgaccggggacggtactagccttttccagataccacccaaatcctccgtccgccccagtcgaaaacagttgtgtaattttatttctcctttcacaaatcatgtcatcaacatcatggcaatgtggcgctcatgtctccacatgccgcatctccattaccttcccaaaggtaattgcccaaacatatagcatttgataaatatgagtatgcatgattctagaatagcatttctaagcaattgtcatagttgactagggactcatacgtaaacatggttacaaagatctaagggtaatcaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcaggctctatagttacgtgcgaaaattgatttgaattcggttagaattcaaataagaatccaaataaatccaaatgacagtcgaatgcgaaagtcgattcctttttattaactttactatccgcgaactacggcaaacccaatttcgatttaaactattttgcgggtataaatattttgttgtcataagtttttaatttaatttacccgagcattatatccatataataggttaggaatttctatcgcgagctaaatatcggacgaaaccctagaaatattatacgatttaatttagtctaagactgaatgattaaatgtaacacacggctaaaatctctagtaattaaatccgaatttctaccgtgaatcgattacttatagggattacccaaaaataatctataataatctataagaattcatctatttgtttagtaattaactacatctaaattattaccgcgaattgatttcttatagaaattgccaagaataatccataatttatattaaattttgcaattctacgactataattaatccataattaaattctaattattttaaattttctaaacttccctaatcttcctctaatttctatttattttttttcttttctttttctctcctcttttctctcttttcttttctttttctctctttttctctcttttctctcctcccggctcctttctttcttttccttctcttcctctcttttcttttcttattcctccctaccggcctctcctttcctctctctctctcggctcttgtccacccgagcagcggcggtggtggacgcgagggggggggaaagacggctcaccagcggcggcggcggcgacgacggcggcagcgcggcggtggcgacgacggtggcgcaaggcgacggcgacacccggcgcggcacacggtgcggcgcggcggcatcgagggcggcggcgcggcggcacggggacggtggcgcgacggcacgaggacggcggcgtggtggagggagagaggggaggaagaggaaaatggagtgggggaaatggaggggggagtatttatagggaagagggggagaaggagaggggaggggcgacggggctcggggcggcgcgcggggctcggcgcgtggtcatgggacggcgacggcgacagcggtggctcgcggcgtgaggcgggacgcgacggcgacggcgacagcacggcagcggcggcacggggcgcaagacgacgcgacgggcggcagcggcgacgtgacagcgggcggcgcggcgcggggcgcaatgacgcgacaacaacggcgacggcgacgcggcagcgacggcgatggcgcgcggcggtacgaggcgcgaggcgcgacggcgacggccgagcggcgcggggcgcggcaggcgacagcggcacggcggcaggcggtgatggcgatggctcggggcgcgaggtgcgcatggcagggaaggggaaggggctagggaacctcgtcgaacacctagagtgcaatgaacagtgtctttttcctatttatcccgattttagtttatttcccatataaatttgattctataatttctaaatcttgcataaatgaagtttactcaatgtttctgttatctcaactaatgaattcaccctagattaatattactcatattttattggtataatttatttgaatttttaattagggttaattcttgttccattgcatttaaatctaattaatacaaatatggccgcgatgatattttatttattcctatccttacataatctttattttaaattataatttatttatttctttaaccaaatctaatttcagggttaattcctaattaattttcccctatttctgatcgatgaattctgaaatcaaaatccaataaaatcgtcgaataaaattggcatgatgcaatttatttaaaaagtttttgaaggcccatatttttagagtttagattttttttttgtcggtcgaattttcagggtgttacaaacctaccccccttaaataaatctcgtcccgagatttcttaccagttttcgaatagatgcgggtactccgtcctcaagaattcttcgctttcccaggtggcttcatcctcagtgtgattactccattgtaccttgtacatacgccacactttgctcctagtcctcttttctgctttacccaatatccggatcgggtgttctggatacgtgagatcattgctaatgtgaatctcttccagcggagcttgttcttctggcactcgtaagcatttctttaattgggacacatggaagactgggtgcacatcagcgatattctctggtagctgtaactgatatgcgacttctcctcttctagccgtgatttgaaagggtcccacatatcttggtgctagttttcccttaatcttaaacctttttgttcccctcatcggagaaacctttaaataaacgtaatctccttccttaaattctaggtttcttcttcgggtgtcggcataactcttttgtcgtgattgtgctacctttaaacggtcacggatcaagcgaaccttttcttcggcctcattgataatgtcaggtccaaataccgcccgttcacctgtcttagaccacatcagcggcgtccggcatcgtcgaccaaacaatgcttcattgggggacatcttcaggcttgcttgaaagctgttgttgtaggagaactcggcgtagggcaaacacctctcccagtctttgctaaaatccaacgcacaagctctcagcatgtcctccaggacctggttggttctctccgtctggccatctgtctgtggatgataagctgtgctaaaagcaagataacttcctagggcttcatgtacttttcccagaaatgcgaggtaaactgtgtgcctcgatcggatataatcctcttaggtataccatgaagacacactatcctggtcatgtacaactcggcgagtttagcactgctatagtttgtcttgacggggatgaatcttgccgtcnnnnnnnnnnnnnnnnnnnnnnnnnaaatggaatcatatcctgttgcggtcttgggcaatccaacaataaaatccatacttatctcatcccatttccactcgggaatcctaaggggttgcagcaagcctgccggtcgctgatgctcagccttcaccttttggcacacgtcacagagtgctacgtattccgccacatctctcttcatgttgggccaccagtatccttccttcagatcttggtacatcttcgtacttccgggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgctgctggggagtgggtatatatacccccaaccaccaaaactagccgttggaaccgaaatccccaactttgtgctctgccagtcagactgccgttgtgaggctggtcagaccggactactttgtaacggctacggctagaaaactagccgttacagggcaatcattgagcccactcaacctggccggtctgaccgcagtgtagtggccggtcagaccgtccacggctcggtctgaccggttgcggctctggcggctctgtatcgccaccaaaaaccagaccagtgcaacagactagtggggccggtcagaccggccttaccacgccggtcagaccggctaacagacccggtcagaccggcctaaggcccacggtcagaccgcaggtcacttttcagctcaaccgaccgttagtaaaacgacgatatctcttgactcgggtctcggaatttggcgttcttggactctatggaaagcttattcaaagggccatccaacccatgaaaaatccatccaagaaacacaacttaagtcaaggataatgggctcacactccaaaggatatccaccggacatacccacaagatgtcactcactcctattggacatgtccacttctctcttggtttaggacttgagaaaactaatcacacttggttagacaagcccaaaaaatgcacctacatgcatatgaactaatatggcacaagatcatccacaagctcgcttcatagaaccctcttgatagtacggcgcctatctagcaaatccgatctacaccaaacaccaagaccgggaaaagactaagaaaacattcttagctacattatacctttgccttgcgccatccatcttagggtcaagcttgagccgagatcaacacttgtgaccatccggttgaaccatgtttatgccgaggtcttgtccatcctttgtcaagactttattctcatcacaagcttgacttcattcttgccaacataacaatgtacttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatacaagtgtatgcataattagagaatgaccaatgggggtttatcttatacatatagagaaggcatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatatcttccacatctcattatcaggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagatagaaatcttataataaacaaaatatagaataagctccccctcaagatgtgcatacatatggatatgaaggaacgcatatgcacataatcaataaagatcaaataggaagctcatactatattttggatccacaagagagaccaagttagaatatgtgaagtttaatacatacctctcatcatttttactttcatatccaaatgagactagtcaaagaaaggctcataaaaatgattagtctcatatagttagatttgtcattaatcaccaaaaccaaattaaggcacttgaacttacatcatgacaccgcactccccggtgagctggtgcagaccagtgtaggtaacctgcagcgagccacggatctccgacaggttgttctcgagctctgacataaagtgctcaagcccctaccgttgccgctcgttgccggctaccagttccctcattttctagaggtcctcacaaacctccgccaagtcgcgcgccagtttgtcggcgcgctcgttcgccgacgacgccgccgctgccctcgcctccacgatctcgcgacttatgccgcgagcaccagcctcgaggatgcaccccatctcgacttggagctcctcccatgtgaggacggcagcaggcgggcctcgaccgggcacaagatcgctggcagggccgctgggcgtcacttcgcggctcctgggcgcgaccacgacatcggtcgaggccactgcaggagatgcgctggagtttcccccagacccatcttgcgccgccctcgcccgcgccgccctacgaaagacgatcatgttggtcatcataacaaaacgccagaatccgatcaagtcaagggcctcaaatttcgtccacttacttctcgccgagtgtcaccagcctatgccgtcgtggaggcgggggagacgcatccaaggcctaagtaaaccgagtacgatatgagggtgacattttccgactacgtaatcgataaccaaaaaggcttaccgatggggtgggcgtcttccggcggttgccgagcacggaggaaaacttcctccctttcctcggaactttgctgccgctggtcgtggcagcagcagcggcaatggccgcgtcggacgcctcctgggcaacgccctccttcaacgaagccgccgcctggtggtccgcgagcggcccaatgatgtcagtcagggagagtgcctgcacaacatgaagtcatgatgcgatctaagagttaaaaggtaaagggtcattgattacactcacgttgattgcggcttcgcgctcagccgcctctttctcgcaaagaggggtgggggcgttgctcgctgtcgtgggaccactgatcatcacctgggaaacacggtgctccacaattgcgctgttcaaacctgtagatcaagaaccaaatttcgataagtcaggaggaatgcgcatgaaaggagagaaacccagaatacaagaaaaatacctcgaggagaaacccgggtcgcgtcctctggcccagagtagtcaaaggctggatgggctcgagcctggagcggctggatccgtctaccaatgaagtccgcagcgacttcataccccgacaatcctcgtactcgtactcgtactcggagatccaaatactagagagatggggtcaaggcgggtttggcggtccaagacggaatcttgtctggttgctcctcaggaacaatgaagactggatccgaatcttctatctgaagatagaaccacctctgtggagattatggataccccatacctacacggcatgtatagtccgactgggtatggggtgtcatgtatagatagaatatttttaaaaggactcgggttaaattctaaacttgtatgtcaagaaaatacccgagatcctagtcggttacgattgtattttatctataactgcctattccgttaggaatatgggctgtgctttgtaatacggatcccttcccctatataaggagaggtccggatgcctttagggacacaattttcacccagatcatacgatcaataatacactcggtggatcaatccccggataggagtagggtattacttcttgattaagaaggcctgaacctgtataaaattccttgtctctaaacccatccacttttctagcttgatagccacccccttttagtattgccgaaatcttgtttcgacaacctcgcccgccatttgctacgagaagaggggcactggaaagggatgtatcgcgacttcaggccatcccgaagtcaaaaaccaacacacccggatacctttttagattccatccagcgcaactcgtagtaaaaacggaagaggtcaagaaacggctctaccccaatgtaggcctcacaaagatgataaaaaatgctaaggaaggctatggagttggggttcagatggagcagaaaaagaccgtagaagttcaagatgagaaggaaaactcagaaggcggaggaagaaaaccacagagaatataatcctcaaccgcaaccatgcggcccaggacgggttcaggttcagtacctcccggttccctctccatggtcccgcgaccgggaagagcgccctcctcctgcaacttcttcaaagacgcaccggtggaagtggacttgtcgaggtccatcgccgttggagatcgcgggagaagaaaccgaggcgagcgaattagggtttgcgtggaagcgtagaagacgaagagcgttcagaggctagaaagtttttgcaacaactggactccaaaatggattcccaaaactcctttaaataggcacactaccaacggtgcgaattgcaaggaaaggagagagatggccgccggaaatttctgggtccgttgcgcgaggcggtttttggacttcaatttaaattcactcataaccatttccatcaagtaattcaaatgcttgcatgcacatatttagggggagcatgtcctatgttttgtatttttgagactaacttcttgttaagtgtattttatgtttagtctcatgggaagtgaaacattctcaaaagtatgctattcacaagtggtaattcaattaccttttcatcgtatattttatctagctacctttcataatatagattaaattcccttgcttgatttaaatgtcaaataatgcacataaatttgccttccaccatatgtgtgcattacttttgggagaatttagtctatattatgaggtttcatgaataagtgatccaattttcctccacatcaaaaggatcattatatgtgaaactcgtgtgctttttatgctttctcttttctattgattcaaatagagaaaagaggtaatgatagatcaaggggagattgatttatgacaaccgaaggaatgggtgaagaaggatgagattggttaagcaccatcatcttgaaatgtgaggtttatgaaagtgtgctttacaattctagtccttaaatttatttcttttggtgatatttgcctcctgacccaaaatatagtgtaaactcctccccaattctcatttgagtaaagtgcatatgtatgcattaaatttatccttatatgcacaccttgagggggagtttattctataccttggaagactaatggtttaaattgagtttatacttttagtcttatgtcggaagtggacgactcccaaggtagacttcattattgcttctatggattttctttgcaaccttaatttcataatataggatggattcttttgttccttcatttcttttgtgaaagtgcataaagatttcttttcactcttttgtatgcacatatttagaaggagttcatcctatgttgtgatgctacataagtcttgatatgtctcttcatcgtcactatttattgggtcttggcttatgagacttttctttcgggcatacatgacttgtctatagcattatatgcctgacatactttttgccctccttttagtgagttttgggagaagtatgtgttaaagagaaaatattttttgaatcatgcttttgtaccttgctccaaattaagtgagtttatctaatcaatgtatttgctatatgtgcatatgggttcttaccaattgtgactacaaactaggcctatctcttttgattggtattattctatcaattggtgtggctcatatgcacaagaccaaaaagagcttgctttggattggtgtctctttggatcccaactctttctattggaattttgatgagttcaattgctttatttggtgttggtgcacatgattttcttgtatatcttcttgtgtgtacctcgaggctatttgtgctttgctattttgaaactaacgcttttgatagagtttcatcttgttgtagcctctttggaacaccaaaggtatgttaaacctttttcccttcaagtgtataggacttgtgtagttcttatatacttgatatgatttctttttctttatgctcccacccactcatttaatcttttggtgtttgatgccaaagggggagaagtataaagagaaagagatataaaggggaaagtgcatactcatttcatatgttgatgaaactaaccctctagtatatgtttcatgctcaagttaacatatactagagtattctctttaaattcctattcttgtgatagtgttgtcatcaatcaccaaaaagggggagattgaaagatctatgcactagagttgcccttgtaaggggaggttggaagatctatgatcctaagagtgtggtgattgttttgatgattaatgacaacccattgttggaactaactatttccatgagttggtgagattaggttaagttccggcatcaagttaaaagattgaagctagaagaagacgttataccttgatgaggagcaagtgaagacattgatgatgccgggtatgaagtggctatttatggcaaaacggtgaagggcaagtaaggctcggctacaatggaccatgcggagggtgaa

SEQ ID NO: 9730 - DNA, 11953 bp, Oryza sativa
  unsure (1)..(11953): unsure at all n locations
ccccccaaaacaaagcggcgagaaaactcggagccgagttagactagtttactttttcgctttgagtttaggaaaaaccatactattaagaggggttccaagtgtggttctgagataacacaagtgctcttagtggtgtccaagtgttgaaatatttttaggagctgtttttgaaaatggctctactcgggacagagagtcccactcggaggttctgtctggaacttcctggcgccgaggtgaggttgaaaattttcctaagtgctggccggaagttcctggcacttttaccccgaacctcctggtaggtttccagttcaaacttgtgagtaatggctagatgacgtcacctagccgttatatatatggatttcgtccccaggtcaccctttggccattccactttagttcttgtgttccctagcttgttctatcctctcccaatgtgattttgcttcctccacctaaatcttgtgtatttcttgagtgagagagtgattttgagggtggtggtgaggattggagaaggttttgaaggctaggttgacttgagcacttggggtatctcgttgggctgtcatttggagcttgttactcttggagggtgacctcctagacggttaggtgtcgcccgcgagtttctaacaaggttgtggattgacccgggcaagtttgtgagggcgttattccacctccaaaaggaaacggaatactcggtgagtgtaatcctaggtgaggtttaggaggtcgtcttggtagagcaagccttacttgtggtgttcttttggtgttcaagttggggatcttagtggtcacttgaaaccaaagagaagtacctaggggtgttggcttgaagaccggagacctcttcctaggccttttcttggtgaggcaagggattaatcaagacccagctctttagagctcctcaacggagacgtaggattctcggtggagaatccgaacttcgggaaacaaatcgtttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgatttaatttacttgttgtgaggtgcttgaaatagcaattaacaactgcccggaagttcctaggaagaaccccggaagttccgggcagctttctctgcttgtgagaaaaagctgccaggaagttccggaccttttgccaggaagttccgggccctgattttaaccgttgtgttttgaagtaaattttaggaacgcctattcacaccccccccctctaggcgacatcaaggccctttcattgtcgaccactccttgtctctacggtcctcacaccaagatcgaccagtcgagaacgacagcaactccgacatcagaagtcgcgatcggttacatgagttcatttaagctgaagtcgggggctactgtcagggttacggataaggtataccctctacccttggatgtacgctatacggcaatatggtacatctgcgcgtgtacggacattctctctatacgctaaggaaatctatcacgaagtccaccaatggaaaggttcctacccatataggactgggtcgtcactatatcgtgcagggtccgatgtctccgagtcctacttggagaccacctgacctgcgatataaaagggaccccccaggaagacctaaggcatcgaatctcatagccaacacaacgaccacagcctacgaagccggagcctacaggagccaagtcgatgggtgatctagtcgaatcaactcgactacgatctcgtcggtatcatctagttccattattccctttgtaatttgtggttctctccatataatcccatatcaactggattagggctattacctattaaggggcctgaaccagtataatcgttgtctcttgtttccttgatgtcgtactacgtagatcctcgtaccagcgtaccccaataccctctatatccggtctacgggtacctaccgtcgacaatattataaaagtaacttaaaacaaaacagaagtaattttgtcacgacattataagtaaatcatttgtaggaataaaaatatgattttatctagaaattaaatttaatcagcagagatcaacacacataagtttaacaatttttaaaagtaacttcaatgttaattggaagtaacttttgcatggttcaaaagtaactgtctataaatctatttaatcatcgatagtttctttccttacatttttgtttttcatgtagaatgagaaaagaagatactattgtttttttcaagttgaaaggagatacaaaatagagtacaaactagttaccactagctatgtagtcacttccaattaaaaaagacattcattaaagttacttagtttttgttataagttacttctataatatatgtaaattagttttaggcttcattgaatttacttttacatatctaagaagtaatttagatatattataaaagtaatttataatttttcatcagaatatagtcatgtgagatcttgttataaagatataattgttacaaacacaacggtgcaatcggttcgtagatcggatgagtagtttaagagaaaattatatttgaagtataggtagataatgtctcttatagatggagtggaactagctaccactagctgtgtagtcacgtcctttctctttctatgtggcatattaccatattttatgggtccatattaagctaatatggtattttttggataatgccaaacgtcatggactaaattacgatccctttagtgtacagtagagcttatatgactgatgacaacaagaacatgtagactctcaaagcatgacttggcagagagaatgaagggatgagggactgggagcgggcaactatataatcgcccgactacacacgcactccaagaatgacacacccacgctaccaggcgcgagagtgataggtcatctgcagtacaacagagttcctgtggaatagtgatctaagtctgctacagtaactatcgcatggtactgtagcaagagtcctttagcaacagtggtcgaattttactctcgagtctcccagaggaacggcatattcgatgccacgtccatcacagacgaagccccatgagtaggggtgaaaacggtacgtaaactttccagattccagatctattttcaaaaacggaatctgtcggtcggaattttttcggaaacagaaacgaattcgaaaatattttctccgaaacggaatcgaaaattataagggcagtttctgtcggaactcggaatcggtcggaaactttccggaaattttctccgaatttccggaaattttgtgactgagatagcctggattcctttttttaaaccacttaatagtgaataccatggtgtcaggccgaatatatcattgttgtgaaaatatcatcgttgtgaacagtggtttccgtccgtttcngnacngttttcaccctacaccacggtcagcaacgtctcctgcatttgccccgacgtccgtcagtccgacgccctcgtccatccaagcctccgaggctctgacagcgtccgccaggtcgccacctcgaccacccaggcctccaccctgggctgcatccccctatgaccaccatcatcggctcgtcgcccgttggatccgttgtggctgccgccgccgtcacccgctgcatctgccatggccaccgccaccgtccgtgttccccgcggctagcgctcctgccatcgttcgcgtcgctgcactcaccctcgccccgtcccgtgtggcagccactcttgcctgttgccggtagccgtaaggtcgcgccctctccccctccatccgctgcggccgccgccctcgccctcgctctcttcccgtgtggccactgctcttgcccgtcgcccgtagccgcaaggctgtgaccctctccccctttatccgtcgcggctgccgccgccctccatgcgtcccccgcgaccgtcgccctcaccctcgcaatcgccatggccaccgctgacaccacccccactctccccgctctggcgtgctcctaggtcccgtcttcactggccgcttgagagttgccttcatcgtcagagtaaaggaaaggaaaggaggaagaaaaagaagagatggaagaagagggtgtggctaatgggcgatcgatccccatgccccctgtacacacctctcctctcctccccttcttctcttcctactatactataaattttaaaaaaataaaaaaataaagttagaaaaaattatgtatagaaatactatatataaaaaatatttgaatttaaatttaaatttgaaacgggtatgtaaacttttgacttataaactttgggtttataaactaatatttgaattcaaattcaaatttgaatcgtgtatataaacttttgacttataaactttgggtctataaactttagatgtataaattttatatgtataaattttatatgtatagaaatactatatgtaaaaaatatttaaattcaaattcaaatttgaatcggatataattcaaattgaaatttgaatcgggtatgtaaacttttgacttataaactttgggtctataaatttaggtgtataaactttagatgtatagaaatactatatataaaaaatatttaaattcaaattcaaatttgaatcggatataattcaaattcaaatttgaatcggatatataaacttttgacttataaactttgggtgtataaactttagatgtatagaaatactatatataaaaaatatttgaattcaaattcaaatttgaatcggatatataaacttttgatttataaactttggatttgtaaactgtatatgtgtaaacttgaggtgtataaactttaggttcataaatttactaaaatagaaaagtaatgtggtgccaaaaaagaaaaccacgtggaggagaggggggaaaccgatcgctcctggcgatcaatcgccaactaggagtttcgggaagaagatgatgggccctacaaaaaataatagaatattggtattagagtaaacaagatatttctattgtatgcatgggctctattatttactataggtgacatggctacctattgcagccagtactgagttgtgttattgaacttgcttttagagcaagtttaatagtatagctatctactagctacaaatcatctatagccaatgtaatagccaaatcatataatagttgcttactatactattaatacctagtcccacctgtcaaacacacattacatcttggagtccgtgctgcaactagctacagatctgtagtccgttgctcttatctctcttcttttatctctttaaaatacgtttatagctggtttatagcttgttacgtacactagtaaccgtgcacgtgcaatgcacattccccacattatgtaacattaaacatataaacacacttaaactttgacgtgttttccccaatacatgacacaaaaaatgtagtttgagaattatatctattgtagtgtaatatagcacaacttaataactcccttttaaacacacggtaaaaaaatttggaaagcagccagtgaggataaaatcatccagcagccgtcaactggaagtatttaagccattaaaaaccctttggcagttatcagaaaatggggaacaattatccctaatcaagtaacctgtggcacctattagaaatgtttcagttatcaacccgataattcattttgttgaggcattaaactaaaggttgataaacggtgcatagctatatatcagtatattattcttcctctgtcctccctctgagtgttaagtctagccattcatcggtggagtacatatcaaacatgcagaaaatatacagaaggtaaaaagtatccaataattgattacatatttgtgctgctctatgataaaaagaagagatttaccttcccctaattctgattactaataattaccaagccattacatcgtacagtacacattcacttgacacttaaaactcacaaaatagtagactacctatcagttaactgaatggataaaacacttttaacagtacataacctacctcaaatggcattgtagatagttacaaatctctcttcctcttctgttgttccaaatctttcaattgcaattaaaagttgtagaggaatgggcaaggtacaggaggtgtttgtcagtgagccgaggccaagcagagagaggagaacaacaaaatttgcatcaataggacatgagctaactgacaacatatatgagtgaatgttaccaatctgcaaaacaaaacttttagaacaatatgtgaacttatattgaacattatttaagttttattgtgagcaaatgaaagcataatgtataacgttaggattatacctcaccattaagattcattctttctgatatggggaggaagactacagctgctgcactgaatcttgaatcatgtacaaaggtaaatcagattgaaaattgcatttataattcttttaaattcttcatttagagtgcaaatgaaataataccgtgagatattgaggatagttctcaaaaagatactggggatatatttgttgccaaaccgtcaggacatacaacattaaaaacatatgatttctacatcggcaaaaatatgcaacacaagcaatcaaatttgggaagcaaagagttgcccgggtggatgtgcagatcatagtaagacaatacattcactggaagctgcatagcaccttgagatcaggtctgtgttagcaaaccgattactcctgcagttcaagaactgtgaacaccaccaaacacggccgcatcaacaactgtcacctgctgcccttcttggaaaaacaaatatatgaagaacatgattaaatgacacatcaaaatatgatagcatgaatgcaaagcaattcaatgacctgaatcatctcatcttcatgctgatgtatgtgtgttctggacttctggtagaaagctggagcatccgaaacataaaactcaattaaatctctaatgtgcggcgtggttgcggcagagggctcagcgtgctcacagcgtcaacgacggcagatgtgggctcgacatggttgtggaggagagcacagcgtggccgtgggtgcgggtgtggggtgaatgagcgattcttgcggctgcggcggatggggaagaccacggttccggtggtggctggggacgactcggctccggcggcgactcgggacgacgtcaactccggccacggctggccgcggcggatgggaagaccacgtctccggcggtggctggggaagacctcggatccggcgagggcagcggtggagtgcgccgcggcggcggcggaaggggacgacctcggctccggcggcggctggagaagaagtcagctccggcgggggtagcggtggattgaggcggcggcggcagtacatgacgggaggagtgagccgcgcgtggagagggtgaggcatagacgcgtagtcttcgcgacgtcttcgcgcgaggtgaggctaaaatcgtgcggtcgagatgggtggacggtacagattagagatctgcggatggacggaccagattacaccggatttgcggatggacggtagagatcgatccgaatgattacaccaataggattggagggaggcgacttatctttttatattaatatagatatagatatagatatagatactcttacagtcttacgtaccatagtaatatttttcgaaccctttccataaagaaaaaaaatggaaaccggaaaagaaaacaaggaaccagtacactagcttacatgcttccattgattccccttctatgcattccgtccctcccgattctccaaacccactcacacacccaagaagatggaaggtcagggaacgcaccctgccatgcccgccgccgccgtctcggtggtgctcgacgacgacgacctcctccgcgagatcatcctgcgcctcgccttccccaccgacctcgtccgcgccgccgccgtctgcaggcgctggctccgcgtcgcctccgccccggccttcctccgccgctaccgcgccctccacccgccccgcgtcctcggcctcttcgccaagcacgccggggctcgctgttcgagcctctcccccatccccgcgggctcgccgccgccgcgcgccgcgccgcgaagggcgccatgctcggctccatcggcggcggcgagccgctgcccgtgtacgactgccgcaacggccgcgtcctgatggacctctccgacccgttcgaccgcggcgacggcacgctcgcggtggtcagcccgctgctgcacgcgtcgcggtcgctcgccgtcctcccgccggtcccgctcgccgcgcgcccgccgcccgtatccgcatgggcgacgacgacacgctgctcggccgggccaccgacgtctgcatcctcctccccgaggacggctgcgacggccagtcctacaccgtggtgacgctggtgcgcagcaagcgcgtggactggcgcgtgtggtgggagttcttcgccaaggtgtccgtcctgcgcgcgggcgcctgggacgacgacgtccgcgccacggcgccggtcgagctcccggcgcggtgccgcggcgacacgacctggaaccgtgccctgcttgtccaaggcaagctatacgtcctgggcatgcagtcccacgccattcttgtgctcgacctggcatccatggccacctccttcatcaacctccccgacggagtgcgccacgaggaggacggagacctcgacctgttccggtcaaacgacgccggcgtcaacctcatccatgtcaatgggtttcaagctcgtctctggcgtcgcggtggcgacgacgatgacggcgacggcatgacagcgggcaattgggtgttggtggacgacattggtgttcgtcgagggttcgatcacctcgcgaaggttggcggggagatggacattggtggtccggttggggttatcaaggtcggcgacgactgcgagttcatgttcttgtgcgttgatggcgatgtgctgtacatggatatcaggacgaggatggtgaagaagattttcaaggcgtcaccgaagagaggaggtgttctgccagtgatccatccactgaccatggtttggcctccaatcttcccagtgctggagtagatcaaggatggaggccatttcagtgatccttgaagaggaggtttggtttttggtgctttgtgtcttaagttcttgtctactgctggcttgctgctggattgatttatcatgtgtgtttgtttcttccattttgtggtaatggacttaaaaatggtatggtcgatgaattaatggattatgaatatatgggtatcctttactaaaatcaatatctgcttgtatatttgatttaactctgaaacaaacaagtaaattattatagcagattattataatctataagctagattattataatctaataagctgctctaggtgagcttttttcaaattattgagtggctaaagacccactactcctacataattgagaaaaattacccacctatgccatcaaccgaacagatagctgagggcattatagactttagcttttcaaacccaataatccatacctccaataatccaaacaaataaacaactcacagcttattctatgtcagcttattataatccagtttatagtaatctggcttaataatctagattataataatcataagctgaaacaaacaggaccttagttacttctatcgtaagcagagcctagttggcatgataactctggtgatgcattgatcttggagatttgttactgtaaccatgaactgcaagaaaggaagatatattttctttgaagcaaacaacccgttgatggaaattttaaccatgttgatggcttatgctccatatatccttccgatcgagcagaacgataaatatcttacgattagtgtacgatacaatgtttctatggcccaatcaagtatcatgcatgactggatcgtatcaaaatcgtaacaagtttgtcgtacgtacagcaatttcccgagcggaactacctcagcagccaggaactagagagccccaggcatcagtcgtttagtaattttgatgttcctattctcatgagttgccttgccgaatcaaaatgaaaaccgaaggattataggttctggatgttccatgctcaaaacaaaacaattgttgccatgttagaatctgaagcattatcaattcagcagtttcttttcgtagctgtgacttaccactttcaattatatgcatgagctgcttcaactatgacctgaaacccaaattcaactcaattttaagttggaacaaaactagataaaacatgctgggtaggcccacctggtgctagtgtctatcgagccatagctagacttatgcttggtgggtacaagtccaaattttccaacaacatcacaattgtttatatgatctgccatatccctgtttttcatttggatatgttgctaagccgagcaaatattccttttttttaaaaaagaaagtgttagaactcaagctatgacagagttgctctgaaatccgaaaattcctagttcagaacaagcagcacatggtacaacacacaaggatatgatttcttctttgttcctgtttcgtatgcacaaaatcagatattgagattcaatataaatgctacataatgttgtacctcctccatttcataatgtaagactttctagcattgtccacatacatatacatattaatgaacctaaacacatatatttgtatagattcattaacatctatatgaatgtagataatgctagaaagtcttacattatgaaatggagggagtattaagtacgaacagaataaagtctgatactacaaaaagctcacaacataattcaatcctaaattgtcaatgacagttattcacacattccaggtttccagtttttggactaaaaactcagaagcagtactttgcaaataatctccaaaacaggctatcaaaattaccagctcaaaattcctctgtagcatacctggaaaaaaggtgaaatttaaacctgaaatattgcttgaattcaatttgttaagcagaagaatatttttgaagtagatcaggttaactcatacttaaatcttattttaaagcataacaaaggaacatcacataagatgcctgactctcctaaaagaccagtaacaattagattgttacagcaagataactacatgctgaattgagaatcggttagacatcgcataaagcactagagaaaaatcctctgggatcattcatactgaattactgatcatcgtcatcgtcatagttcaaagccgggaaagtgggaggccatatcatcatgaagggaaagatttcaaaaccaatatcttcctttggagccatctcgaaaaccttgttcgctgtcctgctcgcaatatgtatgtggaagatcacgcggtctatcgtcaagaacagctcggcattatcctcgactctacgaagtgaaacaagagcatccccaagtgaaggatcccccgactcccaatcgggcctcgcaacttgaccaaacgattgatgcagagacatggtatcaaccatctcccaatcaccaccattcccaccgccgtctgtcgcacgatgccaaacatgaatctgaaaccccttcagatgagcaagatataatccggaatcgccgtcccgcaacaactcaaggttccccatatgctccagctgctccacaccatccgggagcttgatcaagaacaagctcatcgacgccagattcaacccaagaacatgctccctgcccagcatgtagaggctcccatggaagagcaatccacggttcatcttcttgtttgg

SEQ ID NO: 9731 - DNA, 10187 bp, Oryza sativa
taagagcaggtacaatagcaggctataagctagctataaatatattttaaagagataaaataggagagagaagagcaacgggctacagatctataaccagctgcagcacggactttaaaacgtaatgtgtgtatgataggtgggaccaggaattaatagtataataagcactattgtatgaattgactattaaattggctatagatgaattggagcttgtagttggctatcctattaaacttgctctaaacaccccctaagcacaatgaatatgcagtcagcaaaatgggaagtacgaggagaaagctaccagttcattaaaaacgcgaacattatgctgtaggatttttagtattatacaactaacattataaaactaaccatggtgagccacaatttcatttggaagatttgaaacatacaaacagctttatgaaattaaatcaaatagtagtagtactttttcaacactattcgccttatccttacaggtttaaattaacctatacaaaagagaaccgcgtattcagattaagcaagacgagatgggagatatctcccagtccaattatgttaacaacagtcacaagtaattataatccctcccctagcaagctaggattgagattctcagcagtcactgtaccgtgcatttgtcactgacatatgggcctgatgatctatgggcccacatgtcactgataaaggcgcggtgcagtcgactgcagaggatcctgatccagcagtgtcgatcctgatccagcaagctgacactgcctggttttgctcccggcgccgtattgatcaaaagtcagatgataattacaggcaataaccactaccttttgacaattgcaaagctacatgaggcatgtacagattctgcacaagatcagcaggtcaaatgaaatgcctctcctgctgtaagcctgtaaagtacacatatgtagtattatttcaaaaacgtgctatacatttagtccctttaaatctatctcttttctttgtcagaaatctctttaaacatcgattgaacatgtgcaatcaacatgctaaaactttgctacaaaatagtttcttacttcttagcttaaagccattggttctgaacatgataccaaacattcagaattgcctaaacaacaaaggttacagagttattgcacaaggaatatgcagacagcaacaccgggaattatgaggaaggtaccagttcatcgaaaacgtggaaattatgctataaaattcttgagaatttactacatgttgggcgccgtgtgctaaaccacccaagtacagtcagtcgatcaggttaacacaaagagagcagaatagcagacaaagatagcatcaggtaatatatattcttgatgcatagtacattaatcttcgacctcatcttaaaagacagagatacataacataagcagattctagcagtgagagatctacaagacaaattcaggaccatacttgcaaggcaccagacaaatgcgccttcgaggatcactgatcttgatcatgatcattcctaagttgtgggaaggtgggaggccagagcatcatgaatggaaatatgtcaaaatatctataagcctctggtgacatctcaaacactttgtttaccgtcctgttcatgatatgtatgtggaagatcacacggtctacccgcaagaacacctcagcattgtcctccaccctatggagcgcaaccagagcatcccctgattcccaattgggctctgcaaactgaccaaacgattcgcccaagcagatgttatcaaccagctcccagttgccaccaccgatgtcggaatcggaggcgcggaaccaaacatgaatctgaaaccccttcagatggatgagatataagccggaatcgcctgcgcgtagcagctcaatgtttcccatccggtgtagctgctgcacaccatctggcaatctgaacaagaatagcctcatggatgccaaattcaacccaagaacatgccccttccctcccaacagatagagattgccattgacaagcacatcacgccttatgctcctttcccagctttcctgaatctctatagttgccgattcacggacactgttcagatccgaaatttcagcccttacagaaactgccttggccaacatctcctgatctttgcgtagaaattccacgaaagtgtaggacggatcgtcgctgccgacatctgggaagaggagcatacacgaggcatgcagaatctgccccggctggcgagggagttcgtagaccagcgggagagccggtgggtggcgggcggggtgcatcgggctgatgatgctgacccgtggcccatcgggagggaactccgcggcgaggacgcggccgttgcggcagctcaggatgacgggcgcgtcggggccggagccggaggagccgggcgccaggcggaggcgggcgccgcggagcgcggcggcgagctccggcggctggggcagcggcacgaacgccgggacctcgtcctggaagcgcgccctggccgtgtggtagaagccgaggaggcgcggcgggtggcgcgcgcggaagcggcggaggaaggccgggtcggaggcgaggcggagccagcgggtggagacgagggcggcgcggacgagggtggtggggaggccgaggcggagcaggatctcgcggaggaggtcgtcgttggcgagcaccgacgagatcgccgcggccgcggctggctccggtggctgcgtccccttgtcttccatggcgttcccgcgaagcgcagctgagagggagaaggggaagcggtcgtctggtccagcttgtgacgagtcaatttccacgcggatttttgacttttggctgactttattactccttgatggaagtattaactaattataaattttgaaaaaatggatttatttgatattttttagaaaaaagcttttccatttttaaaaaaaactgcttagcagtttagaaaacatgtccttttttcctaattaaaatagtctcggattgtaggtcggagttgataacaagaaacctatatatcgaattgtaggtcggagttgaagtttagaactcggccttttttttcatgccaagtggttttagttgtgttctaaacattttgatatgcaaaccatctgtttaaaaatcaaaatgttttaggggctatcctcatttaaatgttgaaatagtcatatcacccatcttatgttgtttggagaatgagatgggttttgcacctactgttgtgtactctctctgttttatattattacaaatcacatgacatttttcctaattaacgaagtctctctttggtccatatattagatgaatacccttgatacaaccgaattttcgctgggttgtttgtaagtaagctaggtaaactatattaaatatttgattgagtttataaaaaaacatttagcaacatctactacaacaaattattttattaaattcaatatttatatattttaataattgcataggtaactaatcaatgtttagtcattgcagtgcttgtcacggtctcacagaccaaagtacatgcgcatttgatatgctagcttcgagggtgtgtttagtttcacgttaaaattgaaagtttgactaaaattgaaagtttaaagaaaaaagttgaaagtttatttgtagaaaagtcttgatgcgatgaaaaaattaaaaatttgaagaaaaagttacgccgcaagagtctatcgatgggctgtcacttgacccactcgaattctcatcaccaaactgcacaagagctcacagtgagccagcccccacattcattcaaatcgctcggcaccgacaccgacaccttacagtgaaaacgtaacaaacaccgctagaagcctagaacgatgcgatgtatgtaaccgcaaaattcgccgcggtgaaaccgaaattccaaattctgaatgcaaatcaaatcgctccatcccatttcgaatctactacaacaaatcaatataatcccaagtacgtacgtgcgtgcacatgccaacgcaacaggtatatatatatatgcgcatgcagcatatggttgagctagctacagcgagaggccggagaggaaggagacgccggtggccggcagccacgacgcgccggagatgaagcgcgccaccgtgaaccgctccgcctcggcgctgtcgttgatgacgcggtggcccggccacgccacgcgcccggcgaccccggccccggggccgtagttcatgtactccccgtagtagagcgtgtcgagcgcgaacgtcgcgttccacgccagccacccctccggcggcacgtgcccgccgatgtacgacatcatcaccaccaccctcgagtacagcttccacggcctccccaggtacgtcggcgccaatggcgccgccacggccggcgccgtcgacggcggcggcggcgaggggacgacgcggcaggcgtggatgacgaggccggtggattggccgggatcgcggcggttctgggcggtgacggtgttcttctggccggggagaggggagcgggaccagaggttgcagcgctggaggacggcggcggcgttgccgaagacgaagtcgacggtgccgtagacgtcgcagtcgcggtagaagtggcggttggagtgggcgtagagggtgtcctggtagccgatgatgctgcaccggtagacggcggcgcggtcggcgctcacgcgcagcgccaccgcctggtgcctctccggccccgcccagttctccaccgtcatgtccctcatcatgaacccgctccccgacgccgctgccacaaatttcacacaaattaattaagctgctttcttatactagtacgagattactaatttgcaacaaattcttgtcaaatttcagcagtgctcgcgacgtgccatgtcgcgccataccgctgcctgcctgcaggctatccgatttctggttcagttaagtgattaagtcccccacccactacactacgccatgttaccgcaatgacgcaaacacagcaagaatgcaggtcgagtagtccatttctaccgtttcttttcaggaaatttaccagcttttatacccagtcatctacagcagctattagtacgtgcctaatactacgagctaatcctactcgaagtggtcttcattgcggaacagtagaagcgttaggagattgcagaagtaacagcaggaataacgatcgatcaattgcccagcaaaaaaatatataaaagaaagaatccaccaatttaatagaactaatgaccgcaaaataaattggatggttccatcatcagacattcacaacaggctggagtagatcattattgtgattagtgaagtttcttctgttgttggcatagtgttgtagtatttaacttcggtagcaatgaattaattgtgttttcctgtaagctcattgcaacccgtcactgctcatatcactaaaataattgcaatttaataacttgcctctagctagtttttactactaccttcttgcgttgagcgcaaaagtaaaattagtttatttagacaaactaggaaatcgtccctatttgtaacacttaatttcttgtgcaaaatcagcataggtctatctatggtgaagacaggggatgcaatgtcagttgaaaagtaaaaagtgaaaaaaatatacttttataaaatataattgtttttaattattactccctccattctaaaatataaggcacaaccactcttaatccaaagaccaagaaatagttattatcatcttgtagtttgaatcatcctaataaatataatgcatgcatctaataggattagataagatgagagtacagaatttaaaaagtaataatttaatggagaagatgtcatagttaattgtatgcttgcatatatgccttatattatcgaacatataagaaaagtggttgtgccttatggaatggagggagcaacagcgttcttttctaaacttatgtgatatgaaaacagtacaaaagaaaaatgcactaatggtagcaatgaaaagtttagtttcagagaacgtgatagatcaaaattgtttcttcttgacaccataacattatcttttttaaaaaaaaaatgttcgatgaaatgacaatggagtgagtaaatcgtggcgacaaatgacataccgaaggtggcggtgtggaacgtggtgaagttgtcggcgacgctgcggccggcggacacgacagtgacgcccttgccgtcgccgacgaacaccaggttcgtcttcttcctccccaccttcacgttctcgtcgtaccgcccggccttcacgtgtatcaccgtccgccgcccgctgcgctccggcgccgccttcaccgcgtccgagatcgtccggtgcgtccccgtcccgtccttcgccaccaccatgtccgcgctctccaccaatggcgccgcggggaccagcagcagcctccggtccctcgccgacagccacctcgggaagaggcttcttcttcttcttctccctctcttcctctgcttcttgctcttcccgccgccgttccggacggggacgccggcgaggccgtccttgttgctggttgccatggccgccgacgcggcctccgcgtacattgtgaggcagtcgcggaccatggcgcgggcggcggcaaggtggggcgcggcgtccgcgccgtgggggatgccggcctcattgaggctgtcggcgcaggtgtcgtggttggtgagcgcggcggagagccacgtgaccgcgtcgtcgtgggcggcactgggctcaccggcgccggcaaggaggtcgagggagtcctcgagcagctccgcgcagtcgtcgcgcgcggcggcggcgaggggcgaggaggaggaggagcccgccgagaacggcgttgtcatcacagcggaggccggcgcgacggcggcgcccgacagggcctcgagcgccttccccacgtgcaccgccgtcgcgttgagcgcaatgcggagccggtggtggcgcgccgccacagcctccgcctccagcgccgaggccgggaaggcgtgcgcgccggagagcggcagcaagaagcaggggaggaagacgaggaggaggatgaggcggcgagcgacggcgtggcccatggcgagccgagctagctagctatggaagctggaagaagtcgacgaggtgctggactaccagcgatggcggcgcggccatttatagggcgattgggggtggcgagaatgatgggacgcgcgcgggcggcgagctgggaagcttttgcgtctcgcggaaagcgcggcatgtaccgatggtttgcctgccatcgccggagaacgatgggctcgctcagctccggcggcggccgcgtccgcttggtttgttcgccgatccatgggcgcggcacgagacgagagccgcgtgggctgggctaccacagcagcacacatgcagatgcactgctcgtttggcccccaccccacctggctggcgcgcccaccgcgcggcattgcgcttgcgcgtgtgcgcgcgctagctagcgcgcagtgcgtcagtgagacgctgcgtggtctcgcgacgggtacaaatcctgctctgtgtgcacgtacaaaccacggctcacagatcactgatatgtgtcacttgctcttgggcgcatattttcggtctatattactactcatggagtagtagtagagtagtgcacctctcaactaccgtctcacacgaagcttacgaaatgagataaaactaaaaagatgatgtggctagtgaactaacgttattaggtgcatgagtaacatggaaatcaagagattatatcataagtaatgttatttgaccaacaacatctataaaactaagatgtttaaataaaaatagttgcatattattgtagtttgtttaatgataaatatagtaacatcaattttatatgattgaccttttaatattttttttctattaatagtcatagttaaaaaaatgacttgacaatattttaaaaatgcttacattctgtgacggagtgagtactatggatatataaactacttactatattacggtagtttttattcaccgtgtattatctatggtagttttatttaccatgtattatcttagaaacaacactgaattttagtttggatctaattttcttatgaaagttaaggctcctttcgaataaaagaattttggaggattacatttctatcgaaataaattcctatatgatgctttagaatgaaggtattgaattccttctaaattccttataattgtctcaaatcataggtttttttttgcaaaattggttatatatcatcaaaagttcactttttttttctttttatagcatcgaaagatactaaatagcacctaaagctcaccacgttcccatttttaacactttcgttaattttcaatcgtttttcgtccgccttgattactattgactcagccacacacacaatatgatgtttctacccctgattgtcatgcattctacttgtgagaggtagttaggaattcatattcctctcttcttaagaaaaaaaaagtgcgctcacaactcgtatacattcatccatataatatatacacgaacatcttacctttatatgaacaccttgcaaagatcggacatattctttttatctttacacgccttattaacgtacactaaaaatgtgaataagtgaaccctgcatagccatacatgtttataaaagaaaacaaaatagaaaggcacgaggagaacagtgggacagccaaacgtgacggtgatttcacttgaaaaagaaaaataaaatactgtgtgccgatttagacaatgcaaatgcattattccaggctatatatatagctagttagctctgtcgtcgatgcttcttctttttttgtcatttacaattttgctgcacatttggatgtgattttcgtattgtattgtacacgtatatatgggctcacgaagagatagctaaagggaatcgtgtgacattggcacaatggcacatgtgacgagcgcagatggagctctcgcctcgtggaaagaaacaaaaaaagtcgcggcaccgatgggcgatcgatcggtggctgggcgagtcgtctcgtgcgatcgtgtgcggttggtttggttttgctggctgcctcgccacaccggcacaccgcccgtccatcataccacgctctggctgacgcgctgcttgtttgccgtgccgtgtgccggctgcatatcctctcgatcgccctagtacatgccgcacactccattttcagctacctttttttttatgataatggatcttattaggactaactgcaaaacacgtgaccatggaataataacgtgggttcaataaatggaaagctagcaagcttgaaaaacaaaggaaatatatatattttgtagtactaagaaatttgatctacagtaatattgttttatttcatactccctccatcctataatataagagattttaggtggatgtgatccacctaaaatctcttatattttgggacgagtatctcctatcattcaattcatcttgtgacaacttttttctctttacctttctctatattgttgccgccacattaaattgcttctcttgatctcaagcgtattttccgatcataaaagaccgagagatgatcttgatgttattactttgaagttgcacaaaccccaagccccgaattctcgattgggattcacagatccgatttgttttttagaatcgcttggttttcttgaaaccaatggcggaggcatcgtctgggcaggcgaaaactccattaaaattttatattagtgagtaaattggtgatgaaatttctataacaaatactagttatatttatccggttttaaaaaattttctagctccgccattgcttgaaaccaccctgacccaatttgtgaattccaattgattttagttagttttcatacatagttaacaaaaaaaaaggtcaccggttctatggtttgtatcggctttcgcgctgttttggtaaaacctaccatgatcggttttcagttttcacctcgatctcctccgggcaaaccgcgacatttgaaagaactttctcctttacgaaatgcccaaaataaatacaacaagtaaataaaaatggaattcgaaccgttagcgtacgctacacccggccccacgcgtcagtgaaacccaacagtctcctgaaatcaacccgccacaaaggcccaaagccc

SEQ ID NO: 9732 - DNA, 2425 bp, Oryza sativa
ccgcgccgtcgggcaaggccaagaaggccaagccggagaagtcgtcgtcggcggcggcgcctgagcccgctccctcctcgggcaagtccaagaaggcagccaaggctgaggctgcgaaagcggctgccgctgagccggctccttctaccggcaaggtgagcaagtacaatttggcgccggagccctcgccgtcaagcaagtctgggaaggccctatcgcgatggacgacggatgacgaggtcaagattcttgaggtcctcgtggcccatttcaagagccacggcactcagcttaaagttgaggggatcatcgctgctgtcggcgatagcctcgagaggaagagcatcaagtattcggacatgtatgagaaggtgcggaggctcaagcagcggtacgaggccactgccaagaaagttgaacacggcggcgacctaccagctaaagaggatgacctgcggatgtatcagctatcgtcggaaatctggggaaagaacgcaaaggatgctggcaattcgtcaaagaacaagaaggggcaagctaagaaagataaggtgagtggagattcaaaggaagccgccaaggaagataaggtggatgaagccgccattgctgtgaatgaaaagggtggtactctggcagagaataagaaggggaaaaccaacaagcagaaaacaggtatggaaacaaaggttggatcatctaaggaggctgctcttgctgctagtccaaccaagggtaagaagaagggaagccacaaagacaaattggatgaagaagcaaagagtggcacggcaaaggtgacctccacaattgccactgatgatgatgatggaactttgggtgggagtaagagggagaaggctggcaaagaggaattggatggggacacacatatcgtcatgccaaaggaggccaccacaactgccgctagcgatgatggtactttggttgggagtaagaaggggaaggctgacaatgggaaattggatggcgacacacacagtgttatgccaaaggaggccaccgctggcacccaaaatggtggcatcctaacaggaggggaaaatcacaaagaaaaagtagataaagatgctaatgtaccaagcatacggagggagtatgctgaattgcagagtttgtatcccaaccttgcttcctttgtgaacggaattgaggcccagcatccatgtggatcaaccttcaagagagcttttgagttcattagtgatgataaggcttgcaccctggaatccaagatcaagaagcagaagatagcggaagtgagaatgcagctccgtctagcagacacgaagaaggaagtagccaatgctttgttaggattgctggactaaaacattgcggtgctgacatcctttttgtgcggtatacattcttcttacttgcgttattatgttcccatttgtatattaaagttctgttatagctaaatgcatttaaagtgtttttgttgcttctaaaatttgagtgtgacttctgaactaattattgaaacaaccctgttcttatgtggtcagtttagtgtgaaacatgtgcaattaaggaaagtgtagccaatgaaagatttagccatatttgacacgtacaaaccatctaaatatttgattggtttgtatatcaagctaacttacactttgtaggtgttgagagggtgagtttgtcatacgtagcaacataagggagtgatttgaatatatcatctgttggattctactattcttgattggttgtaaattaaactgtacctacactttgtaaggattgagaggtaggagtagtgaacaagggaacactatgaataaagcatctcttgcattctactcctgaaatagttagctttaccttattcaaacgcacagttgttgctttgctaggttgtcattgtaatgttttgtacctactatactctactcaccgtgaatagtcattttttggggatggttttcctttgcagaactgagttataatgctttttttttaccacaactgatatatgcaatgtttactggtagtttgtccatatgaatcttgtgctgcaaaaggcagcatagtttattttcaagttctttgtagttttgtttgttaattgtagcttaggttgatataaatagcttaatgtttgaagttatgctttatatttttcaaagtaaattattgtgtgatgtccattgctctagtgaatttagggtttctcttgaagaattttgttggctgctccaactgctcccaataatgccactaaaagaacagttgcatttttacaagccacctgctagtactgacatggtattggatgtgacatttcctagtacaacaaatctgtcaggagcttatccagatttgttgtattagggaatgtctcgtccaatactaggttggttttttgtgggacggagggaactacctt

SEQ ID NO: 9733 - DNA, 3200 bp, Oryza sativa
ggcatgaagattataagttggcaccattttagttagttcactgcttaaaggctgagccaatacaaggtagcttagtgtaacagccgtacataacttttctcaatatctcaaatctgctttatttgttttcaaactacaatgatgagcatatgagtgcattgctaagactttgatttgtctgtgcctggacaaaacatttcttttcgttgcttcaattttcttcttgcatccttagtagtactaatttatattgcttcattatccatacacttattctgttcactgttcacaagcagatggttgtattgaagattcaagttgcagaagatttttggcttgtggagctaagggatatgacgtgacgagttgagctactgggttttctgtctctggttctcgagagctattctgtgaacggttgtttatgtgattagatggtagtatccctttaatctatgagttagcaatggagctgatgacagtttaattaactcctgtatctatgatggcatttggctttaattaggaggtgtgcctaattaagggggttctataactttgggatatgcgtgatgctgatattgacccgaaatcccgtaatcctgcttattttgttgcccggtttattcgacctgcaaccgtttcgttttgttgtaatgctccaacatgatctcagtctcgtacaattctgtgcaactaagtcatgcttattcatgaagtgaaaaatatttcatttcattacagagagtgaagaatttcagtttccggatgcatgatttgcacgctacgactacgatcatcttgatcaacctgtacggttctccaaatttgattcggcaatcgacttgcaatgcagatagctctgaaccatcatccctcatttatctctttagggttaagtcttatttacccccttcaactatcatgaaagtaaaaaataccctcatcaactctaatactagataaatagctttggccgatgtccaaagtgtgagcttggtgttgtcttgcttgtttaggcggtgcctccaacgatgtcgcgatcgccatggagtcggagttgctaggtcgctgggcggcaagctcggcaacgatgacacgtgccttgtaatatcaaacttgtatgccacttcttcagcatctcaacatcgacgttcgctcttggattccgccgttgtttctttggtagtttggctagtgttgtttggtgcttcgtgtgttgtgtggttgtaccagttgcggtggaggaacttggcgagtctctacttgtcgagaggttgttttatttttctgtaacccgtctgggtttttactccagcgagaggttgttttatttttccgtaacccgtctgggtttttactcatgtttaattgaaatataattgatagttgtcctgccggtttagtttcaaggacgtgactagacagacagtggtagctgatttgtctaaatcaactaccactctatctaagaaggacacaatccacttatactttaaatacaattttctcttaaactactcatccgatctatgatccgattgcactgttgtattcgtaacaattaaatctttataacaagatcttacatgattatattttcatgaaaaattataaattacttttatcatatatctaaattacttttagatttcactaaattacttcttagacatataaaagtaaattcaataaagtctagaagtaatttacatatattatagaagtaacttataaaaaaaagtaactttaatgaatgccttttttcatcgtacgagaagtcatatttttatccctacaacgaatttagttactttcattttgttttaagttacttttataatataatatatgtaaattacttttagactttattgagtttacttttatatgtttaagaagtaatttagttaaatctaaaagtaacttctatatatgataaatgtaacttacgtatataataaaagtaatttacaaatataaatattttttcatcataatataatcatgtaagatcttgttgtgaagatttaattgtaacaaacataatggtgtaatcggattgtagatcggataagtaatttgagagaaaattttgtttgaagaggaaaaatgacatgcatgtctattaaaaaaatgcatgcatgtagtacgatgtagtaaactccacgtcttctccatattcaggtatcaccggttaacgcaaaaatgagaggcctctccgaatagattttacgtttcaaaaactattcgatccggatagagaaaccccccttcctcccatttaccggcggttttgggctaattatagagattaatctcctaatgaggactgaggagacgggcccagcctgtcacgtgaggagcacacgatggagttagctactgcatgtagaggccatgtcactctgtaattggcccaaaatggttcaagagattagtttaatagtatagccaactatcagctctaaatcatttatagtcaacctaatagtcattcatataagagcacccgcaatggtaaagtaatgtgctctctataaaacatgtacatctcagcaatatactcgattaatagtaaaccaccttaatagtatgtctacattggtatttatagctctctcatgcattgcctcgtttttctctatagactatctctaagttagtagatagctttgctctctctcttcatttaatacctttcaagtaggaaaatatgctgacatggatttcttgtagagagtatatagataaccattgtgggtgccctaatagttaattacaaatatatactatatcattaataactggtcccatatatcatatacacatagtgttctagagttcgtgctgcagctggctacaaatctatagcccctgtcggctattttttttttcatcctctgcgaaccgtctcaccggaaggaagctcagcgccatgctcaccggaaagaagcagtcgtgccgtccggtgcctcctgcaccctagtgttagggatttgggctctagaggatggggaatttgagggaaagagagacgagaggagggaattatttaattttttgctatgtcatccgtcggagtgtcatgtgagataactctggaacaaaactggctataaatgggaatgagggggttgtgtgtccggactgaatagttatggtgaaaatgctcgatcggtcgactgggggagggggga

SEQ ID NO: 9734 - DNA, 2213 bp, Oryza sativa
gcaacaaatcacccacatattttagaaaccctttattaagggaattcgtttcatttttttgttccacccaaaatatttcatctagtgtactcataatgtttcactatgtatagatccaatgttgcagtgaactgaaatattcttttacaacaaatcacccatatattttggaaactctctattacgggaattcgtttcattttttgttccacaaaaaatgtttcgccttatataatgtttcactatgtatggatcaaatgttgcagttaactgaaacattctttcgctatttgctgaaacctgtttttatataaggcgaaacaacgcccgatttaaacgattgaaacattttcgatctacttagtgaaataattccgatatacctggtggaacatcgtgcaacatttaaaaaatatcaataataagctaaacttttttcgtcggaatatatccatgggtggttttgttttgaagatttaattgcaacaaacttaatggtgcaatcggatcatgatttggataaataattttaaagaaaaattagtttaaagtggttttgcacatatgggtggcgctgatgtcagcgcccgctttttggagatttgtatcgggcgaccgatccctagtcatcccctagttacggggtgtgacttgtttggaattagagttgaggaggctaaatcatattttcgttatagttggaggggggggggggtcaatcggacttgagccttatttctttatgcttagctctctgttaatattcaaatttcgatggatttaagtttgagtgtattcttcaaccgtttttgttatagacgtcgaattatttttttagcctgattagtcgaatttatggctggttgatctacatcaagatttttcttttgcagggaaaatagactttattaaatcacacgggacctattacaatcgtttttgataaattatgagttctcaatatttcaaaagcccatctcagcacaaatcttgacaaacaaagctagaagggactattactcagatttgagtgggtttgagtacaattctgctttgcggttatcgaaagggacaattacttatttgactctattttagagtctaaatatcaatttggccctacttcttttaatttgcttatttgactccgcatttgtaaaacgaagttaccgtttggtcctatttccatttcgctgttaggatttcatttagaaaaaaaagaaacaaaaattcaaatcatattcaaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattacccccatgaaccacaaaaccggacattcttcacccccaactatgcaaaccggacgaattaccctcctcgaaccaattcagagcggttttgtccaacgtggcgcacatgtggcaatccggtcagcctttttttaataaaaaattgtaggacccacctgtcatactcttctttcccctctctctttattctctcactctctctcgctcttttctctctcgccgctcacgcagcgcgcacgtgaggacggtcggcgaggacggcgcggggacgggcggtcggcatgggcggtcggcgacggaggaggcatcgagcgcggcggtgacaaggcgaggcagcggtggaggcagcgagcgcggggaggcaagcggcggggtagggcagtggaggaggcgagcggcggcgggagctcgcgctgctcaaggcgaggcgaggcggcggtggaggcagcgagcgcggggaggctagcggcggggcagagtgatggggcaaggcagtggaggaggcaaaaggcggcgggagctcgcgttgctcgaggcgaggtggcggtggaggaggaggcgagtggcggcggggtgtggcgaaggaggcagcggcagcggtggaggtagcgagcgcggagatgggacc

SEQ ID NO: 9735 - DNA, 17428 bp, Oryza sativa
tccgtgtatacgtccgggccgtcctcgcggagcgctcgtccatggtctgtccttgccatgtgtgttgtgcgagccgcgagagagaacagagcgagatagagagataatagagagagaggaagaagagtatggcaggcgggtcctgcattttttaattaaaaaaacgctaactggattgccacgtgtgcgccacgttggacaaaacctctctgaattggttcgaggggggtaattcgtccggtttgcatagttggggggtgaagaatgtccgtttttatggttcatggggtaattcggacgaccgcgatagttcgggggatagggggtggggggttattcatactttttccatttatttttaacggcagtcttttgtctatttggcaccttgttaggatcgttcaaaaacttgtcacgtcacaattcgagatttcgatagcaaaggacacatgtacgtttttttagaagccttataaaaaattgttataaataacacaataagatggtgaatatattagtagtagcatttttgtctatggtgaagttctggagtagtgctttctgaaagataaacacatttgcaaacacatcatcgcctatgcgtcagcattgcaattttcttagtcagtacacacgtaaatgcaaaccaatgagcaaatgtaataatatatgaatgttccattgcacattccgaatacacaactgatcatgttgcaacaagttaccaagaaagaatatttaaatttaagccaaaaatttagtttcggtgatatatttggcccctctttcatctacatagtttaatactctgatcccttggtgtattctgatacaagtttcgaaaataacgatgaattgtcttccagaagttttgctggcgagtcatcctctgcgattttacctgtttacaacaacatggaattaaaacgggagaaccaagctattaaccgttggctactaattaaacacaaagcacatgactaaccattgtccagaagaatgaccttctcactatcaagaacagatgcgatcctatgtgctattgtaatcactgtgcattcgaaaaattgttgcttcagggttttctgaatcaaattgtcagttattggatccactgaagaagttgcttcatccaaaaccaagatctttcgcttctttagaactacccttcccaaacaaacaagctggcgctgacctgcactccagttgttgccattttctgtaactatatttcatattaaaatatcagttatgacttatgagtttgacactgtggagcaatgcattatagctttctgatatagatataaaacctgcagagtcaagcttgagctcattctttctaacttcatcgccaagatgacaagagttcaatgcctggataacacaacaaatataagttatgcattagtttgacaggtgcacattgaagaattaaaatgtcagtaaattaaaattaaaagacctcccaaatttgttcatcgctgtactcctccaaagggtcaatgttatttcgtagggtcccctcaaacatcacaggatcttgtggaatgatactcaatcttgtccgtaggtcgtgtagtccaatggtgcagatatcaaggccgtctatcaacacttgcccaatagatggctcgacaatacggaatagcgcttgaatcaaggttgacttgccactgccagttcttccaacgatgccggtcttcaaccctccgggtaaagtgcaagtaaggcctttcaaaacaaaaggcaattgtgttgcataccttacctgcatcacatacaaagcacttagaggaaaaaataacacttcaccagaaatttctgcattaggtgttgtatgttttccatgttaagaaagaagatatagtgttgtgagggtatttccacagtggtatgctggaagtcgtacaaaatagtatattatgaaagaggattgcaactctacagtactagaaaaaaaatctgcatgccaatttttgtggaataacttcgatataaaattaatttaataacacactgtttttctcagaaaatattatgaatagaaatgttgagagttctaatcaataattgacatagctccgacattgttagaagtgaacttatataacaacatagagttcaagagacaaacatggaggttgcgaagctcaatttcaccatttgtcggccactggcagtttggtctactttttgatattgtaaggggtggttcagaaggaataaacatgtattgaaaaattctttcaacggatatcattctattttccaaactacagagcactgcaatagcccacccttgtaacatattcagactcaatccataagtgactgcaagaccagctgtctctgtgaagtagtaaatatgagagttagcacggatgttaatacaataatgaactaatttgatctgactaatcaaattaaagcccaccgtacttacttgggtcaattagagcagctggcaaggtgaccagaagtatcaaggcaaatgcgaagataaaggatgaaagaatgtccaagcgaaagcacaaccattccattgaagcagcattatataaacttggtctagataaattatccatgaaatgactgacggcattgataaactgtatttccttgccaaagcatctaatgatatttgatccagctactgattcagcaaaatgctgcatcacaggagctctgcaaactccagtcaacctctgcaactctctagcaccatctatgtaatattgctgaagggaaggaattgtggtaattaaaaacaaacacaaaatatgagtcgtcttgaaaccaataatgtcatagaaaatgcataattatagttttgaaatatggtaacaattattattgttcaatagcatattttaagacaaaatttgattgttcagaagaacatcggaaatgtacaaggacactcctatatacactaggatcaacctgaaaatttgattgggaatatttttgccaagtaatgtatcacatcatatatttacttaatgattttattttgtattatctgtaattgctttgccatccctttaaattttaaattaaatctgtgaaaagaaaaacactgatgttcaattttcagttgaatctgtgaaaaattgtcaatatagtcatgaatcaatgtatttttccttctacatacttaaaaattataaactggaaccacaattggtatcgaacataagatatataataaaaagaatatctgataccacagagatgctgcaataattgggacaaaaattacgaagactggccatgctacccgtgacattaaaataattgttccaagaagttcgatagcaggaaatagaacatatcccatcaggtcaaaaattctggtgtccactgtgctttgatcactagaagcctgcaattttgtttcaactttcatgattaattgaatatgaataaaaattctaatggcattccaaggagataacttcaattttttcattaaaataaagatggtgaaggtaaattacttctctggtccaagatcgaccgttagaagtggagtcaaagaaagccattgaggccgggaataggcatcaatgcttcttatcaaatagcatcattgcagtcttacatccacccatgacaagaagatgggatcttatgaaaatgaataacgagctcacaaaagctaacacaacatatacaagtaccattttcaagctattgactggaggattcacatctttggatattggagcagcccaagccatccaaaaattgcttccaatttgaagaacttgaaaaattatctgagcgagcaaaataagcggcacaagtgctccaccatatgccattgtaatatatttccaatagacagaaatcccaacccgccctttctccctttcttcttcttgtaccaactgaccattttgaacaatcccttctgctccttcattttcatccttttgcttatcttgtctgaaaagcatacttccactgtcaccaggaataagactactttcgggattgccacttgagtgttctaaactttctagagtagaaatgtcatccttatgggaaaatactaattttgtgaactcttctccagaattaagtatttcagcgtaattcccaacttgtattatttgtccatctttcatgacctggaacaacgaaatgaattgacaaggtaaaacgattgttgcgagtagaataaataagtagatttgatagttgttggaagctcaccatgatagcatcggctgatggcaaaaattcgacatggtgggtaacatacactacagtttttgaagctaagagtccaagtagcactcctgaaaaatacaaggtcgtgttgaataactttcatacagtagatatactcttgaaccctgaatattgttcaagaacaggctacctaaaaactgtttagctgaaacatacaaaagatctgattaagacattaggtttctgtccacacaataaactatgcaaagagataaactgctattacttattttggaagttgggaaatgaaaaatcaaacaaaacaaacatgttctattcgtctaaggatttgataacggcactagcactgacaactgaagaaggttaaaaaaaaaccccctaaattgactgggagaaaatggcgttgaaatcatatgatgtaaatatatattttgtagtattagaagtcttaagtaccaacaataagttattagtttaagcattcagtgatgatttacacacatatagaaataggatttaaagatttgttttgaaaaataccttgaacaagtgcaacccagtatgagcatcaacagcactgaagggatcatcaaacagaaagatatctgcatcttgatacaaagcacgtgcaatttgtatcctttgcttttgtccgccacttaggttaatgcctctctctcctataattgtctgatcacctaatggtaatatttccaagtcctttttaagacagcatgcttcaaggaccttttcatacctttccctatgcagttttgtgccaaaaagtatgttatgttcaattgtcccactctgtatccatggcgattggctaacataggcaatcctaccacatgtttgaacatctcctgataacctcggtatctcaccgagtatgcatgacaacaaacttgattttccagatccaacagttccacagatagcaaccctcattccttgtcgaatacggaagttcaaatttcggagagtaggaacctcagaagatgtgttccaagagaactgaccgttcctcacctcaatcgatacatcagttgtacctcttagaagtttagttacaacatcgctcgatagttcctcgaggtgcataaaagagcatatcctgtcaagtgatacttttgtctggatgatcacagagactgtgtctgggatactattgattggtccttgtagctgcctaaacgttgctagagcagacaatactttccctgtttctaatggaatgcctagaagcaaacaacttccaaaggtgaccatagcaataaaagcaggagctccaaagaagacagatataagcataactgaggtgtatacatctttctttagccaatgcatctcctccttcctcaactccatgatcttcgacaagaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataacctgcacaggaaacaaccaaagctcatgcatggacgaattgaaacccgcgacacgcaccgcatcaacgctcacggcattgatgatctctccacttgaaatgctttccctggactgatttgagagggagagacccttttggtaaatgatggcgacaagagctgagcgcacccgcacaccaagttgttgcgatctgaagagcaaatgccttgatgagaggcctttgatgaactgcgcaacaacaaaactcaacaccaaaatgtagccttctttagcggtccgtggacttcgattcaggtaatcaacaaagtactcaatcaggtatggaccaacatatgaagagacagtacggagtaaggcacaaactgcagtgaagaggattaatttccaggttgtaagaacaagagctttgaccagcttaattgttgtaacaccggtgtacttccctgaaccagaaactgagatgagcttcgcctcaaagttagggaggatgccttgaacactgtcattatcatccaaagttggcacatcatcaagatctagtgctttcctccttccaagatcaagtaacggccccatccaagaaaaagtgataacactaaagaatccagcatctgtgaaagctgctctactgcctgtggccttagacgaggaagaagctgcacggtccaatagtggctgatccatgataaactaataactcctgaacatagaacaacaaactttagcaagttacaactgattatttatgagaaagaaaagtataaaagtgttaacgtaaaaatgataatttaagtctgttcatggacattaataggattacagaaagtatagctaatttaaaggaaacaaacataactgtgagtgttaaagccatatgttgcatgaaaaacatccggatgaatccgcacgataccacagaattccattgtcacacatggtcaagatgatatcacaaatctccaagtaaacaaaatcgagacctagattacataaatagcatatgtaatatgtatgtaatctaatatgtgctaaacttcctagaagtaaaaaaaaaagaggatgtaccgaacttttaaatttagcaattgagtttttttttaaaagtatccgatctcaccatgcccatctcagcattgaagcacagacttaataaaaatagcaaaattagtgcaacagactgaaaatgagaatatatattacgcattactccttgcatacctcaaaaagaaagaaaaaaaaagcacgcatgtggaataggatggtgtcagccacaaatcgaaatctgtgcgaaatttttgtaaattaaccagatactggctattcggtgggagagatggaggagaagagaagttggcgatctcgagccctccggcaaagaggcggtggtggcggcggcgatcacggagagcctataaatgaatgcggcggtgagggtcttgagcccaccagcggggctagcgcaacggtgccgagccgaccgaagaggagcacggacgtgccgctggtggctggggcaagccgccgccgccgctgccgccacggccatccgggtgtctgcgtggtttttctcagtgatcagaagttggaaagaagccgcgtctcactgaaaaatttgataatttaacgcttttttccgttgcccaaattaatttaattgacgtttgtaaagatcgccgccacggccatccgggtgtctgcgtggtttttctcggtgatcagaagttggaaagaagccacgtctcactgaaaaatttgataatttaacgcttttttccgttgcccaaattttaaggagtgttaaattatcaaatatctccgtctcgctcgactcacgtgaccaaaggagacggaaattacctatgcttgcggtacgtgggttttttctaatttctcaaaatcttataaaacacatttgtttgttatagatttgggtggcgagtttattaacgacttaaaagtaattcctatcacaattatgaaaaaaaagctgttatagaacttatttgcaaatctgaaccccggttttcttcacagttcacacgctgtacgaccgtagcattatcaatgtcatgcctaaaggttattttaaaattgagtaaatttggagtttatttcaaacaaaacaataaaaatgttagttaagttcaaattagtgcggattacggatttcacatatgtaacgcttgaaaccaatatcataatccccgcttgttagtaacggttcccttcttccccttaccatctattttcctccatgtcataggcaactaactaaatatcttcaacgaatgttcacttgctctcgttctaggggtgggggtgggtgggcatgagttgcgcaggcagccgccctcctattcaaccggcggtgatttggagaactggtccggtatttcacgaggctcaaaatagtttgtaaggggtaaaaaacaatattaaaattcggggattcgtgaattaagagcaggtttattagtgtagtaagctaccagcgatagtatttgtccgtgtctgatatagccatcaagagagaagctcatgcgatgaactagctgtttcgctagctaaatggaaataaacaaacatttaattcatgcatgcacaaccaaattggcatgatcaaaactaaccaccatccttgtagctatgtgtgttgcctgtgctctagcgtgttagatagggagaaaaacagaaatacatgcaaactagatcgtggagatatgtcggaggcccaccaaatacgtaggtatcacccatatcagctgcaagcgagcagtagaggctcgtttcttacactatcgcccggtgacagatctagcgtccgctttttctctttcttcttttctccctcacccacataggatttcgctaatgtggaataacgtatagcctactgactcaaccttattatatatacctgctctaagaagtgtaagtcgccatcttcctcctcgtacatcgtaattcgttgtaaagaaaccacctcaacaaaaacaaacacgtgtgtttccatccaaaactcatcccaccagtaaaaccagatggatgaaactcaagccttgcaaattttccttctaatccctttgcaaagtaagggtatagcgctagtaaaatttagaagttgagttaagtaatatggactattttttttgaaaaatgaaataaaattaagatcgttctcgaatcgggtatacatggatgaatacaaaggaaaagaaaaaaaaggaccaatgtgaagaatcaaaatagagatgacaaagtctgcaggcatatacttacctgctagcttcttcgttatgcctaaaagcctaacaaatcgatcagaagatcggccgctccccttctcaacgccggctgctgcctgctatgcgccgtgccaaggccagccgtcttccacggggtttcgtagcagaaggggttcatatgtactgcactcctgtatttgtgtggggatttttttattacagtacaaagtacagatttgtttaggctaatccaatagaggtaataatcatatagaaggaaaccattgcattcgtacccttcttatgtggagaattaatgccccttttatttgacacctacagctacccaaaagtatgattagtcaattaatgaaatataatcgtacctgccatatattgaaatccaaatttacagccgtgggcctatttggcaagtttagagaatattgcgagtttatagaagggaaatagtagtgtggctgcattcggcatgtttggcgatggagaggactgatagttttgagaggaaattaattaatagtaagattagaatttgatttttaagtctagcatgttttgcgatgaagaggatggaaagttttgatgggaaattgattaatactaagactagaatttgactttcaaatcctagtatagcatgtttggtacaagtggtgcgaagtgatggaaattactactccgtcccataatataacaaactagtaccgaataggacactttatagtataacgaatccggacatgcttcctgtccagattcgttgtactatgaagtgtcacatctggtcggagggagtatcttcctagtttctctataaaagtttggttagtcccttcggatacaagaatgaatatatatgtctagattcatcaacatctatatgaacgtagatccaatcccacaaccgaaaaaaagtacaatttcctataaagcgaaaaacaaaaaaaatccataaaaaataaaaaaaatctagaaaacatctagaaaggatttatatttgtcgttttagtagtccatatatatctcttctctatctctaatctaactaaaaaatgcgcggaaagataaaaacggtttaaaaaaacacgtgaggaaaaaatatcagaaaaaagcacaaaagaaaacacgctagaaaaaaaggttttcgtagtaaaaaaaacacgcgagaaaaaaatatttccatcgtctgtaaaaaagcaaaataaaaagcatacgaggaaaaaattgtcagaaaaaaaggctaaattgatggacgcttggttggttaggatcatcgatttttttttcatctcctaggcttttgtttcatcatctattctcctgtattggagaccctgcacacctctgtagtcaattatcatactattttttgtgaagtatagctactattcttgataacatattatatggaaataatattagaaaataaacatattgtaattgttatttagaaaagagtgcacagtggctctattttgtgtagacttgaccatgcgagtcagtgtaggatttgattggttgtaagaatgagattaaaataatatttaagattatatgcatgttgtcacatgaataatccaattattttaggtaaaccaaacatcggtaaggttgccatcatcgaggttgggccattacatttaagatgttctaattttctaattttctgattgtcatcaatatggttatgtatgaaaaagtatattatcattaggttttttcatccgttgcaaccacaggtatgtttgctagtatatataaagaaactcagtcggacgtccatggtagagtgaaatgtggaaatcaactaaaacaggggagaaagaaatagagttggtttcaactttcaagaaaagaaaagaaatagaaaaatacacacaacaagggaaagacgagttaaaagaactgggacttttcctcacaaaaataaaagaagaaatcgattgggacttaggggtttagagttagcagtgatctctacgatcgatctgttgcattgccacctcgctcgtgctcttactttaatctgttgcattaacacgattgattctcaaactttggtttcaagaaagaaaaggactcaaattcacattgggttctatatataggccttgtttagttaattagttccctaatttttttttctaaaaaacatcacatcgaatatttagacacatgcatggagcactaaatatagattaaaataaaactaattgcacagttaggggggaaatcgcgagatgaatcttttgagcctaattagtccatattagccataagtgctacagtaacccatatgtgctaatgacagattaattaggctcaaatgattcgtctcgcggtttccaggcgagttatgaaattagtattgtcattcgtgtccgaaaaccccttccgacatccggtcaagcatccgatgtgacacccaaaaattttcttttcgcgaactaaacagacccataatttgtcacgcccagaaattcactagtaatttccgaactaatttgcgcataaaattcttgtccaggaatcaaccgaggtacacaaactgacaatttaatatacatattcatcaaaagaactaaagcgataaatacttactgaagaggcacttagtcctcacaacgaagaaatctgcagcggaaaaataaaaataaaatctggcaaagcttcggctccactcccacagcagctcaactggggtataagctaagcatcttctccttctggatcatttttcttcaactgagatttgattgattattgcaaggtgagtacatggaatactccgcaagccacacagcaaatatgcaagtgcacacggataccaaaggatggcataatataggctcatttgcaaaagcagcatttagcaaacatttaggagtagtaaataagtagagtaattaatcatcaatattaatcaacactgaatagcacacccatgctgcaggcccaaccaaacctgaacaaccaaccccggtcgtacagatcaaacctctaaaccaggaatttaccattccaaaccaggagtcaaattaattatcacattattatcattaatgagtagtgtgggactaatcacgaaaaacattgctcaacccacccataaccgcgggcatggctattcaaatagttttactctggccagaggtgtacaaatttacccacaagacataactccacaatatgtcaccatatcaccatgtgcccatgctgaacatgccaccatttgtgtagttgtgacaagacccctcgcatagctcaactcaaagcagcgcacctttcctggatcataatcaccccctctacaaccagaggcgtggactccccagcgacccccacggacttctcgccgcttcacagtctagcgccccacaatgagccttgctatacaaagtgtccagccgttgcccattctggcttgtgattagtacggttaatgtctcacaacagtagcttgcgaaccggtccttaattgtcatgagcatgaccttcaaaaccatgtgctcacaacccaccattatcaagttttaattatcaattatttatcacaacacgattaaccatcgtgagctaccataaagtatccatcattaagtaatagtgaaacattaatcatcccaatagtatgctagtgtttctaagcatgactaagcaattattctaatatatagtcgaaccaatatataaagtccaactagtcaaattataacccaaggtatcaaagaatagggtaatcaatgcaaattggccataacaaatgaataggttcacaccacccggtgacatttaaaaataaatgcatagttgaaataaatagagaatttaaatataggagcaacatgctcaaatgattgtgtttaggatctgtgtgacttgccttgcaataatcggtcttcaattagtcttcttgaacacttctgacgcactcacgaaccttcacaacgacggaaatgacaagctaacatttataacggagaaaaaactaataaaaaccaaataaacagtactaaaaagtaaacaaacatgtagatcatgattttagatgaatttagagacttgaacggcctcattccgacttcatatgaattagttatgaattttacaaaattaattccaattaaacctattaaagaaaacactattccaaattgattaaacaatttacaaacgatttatactgagattaaagattaaaacatcctccgaaaattattggaactaatttagtggatgatatatagtaaaaagaactaatatgccattgaaaagggataacatgatttatattgactttggatggctgagattaatcttgaccgagtcgaccaagatcggatggtttggattgatctggcaagctggcctcacgagataccgactcaacgagtcaattctacgtgacacgggatcaccgaaatgattaaccgaaaccggcggctctgaacggctctaaactaaaggacgactcaacatggacgaacgaacgaagcacggggaacacctcgttcgaacgaacgagcaaacgactcaacaatggttgcggctaaaccgatgagctagacacgattcacggtaaaaccctggtacgacaaacgataggccggtagaaacctagggatgcacctacggctttgcaactcggctaacggactacgggaagcaaacaaaccacgatgacgatgacgtgggatagaggcggcgttgcacaatttggagcaacgactaagcagcgacagtgacacggtttagcagcggcacgactgcgtcaacgacttggcaaggcgcggcagcagcaacgactcaacaatgacttagcaagatggctaccgagctacggcaacgcggcagcgacacaacgcagcagcaagtggctcggtcgctgcggtagcgggacgacatcgacttttggcacgcacgagcagcagctacacagctgtggcagggagcggtacaacggcggctaggcggctagcgcagcggcaatgctaagccaacagctaagcgcggcacggcggcggctactcaacgacacaaacaagagattaaaacctaaactgagggaacacagatagaaacctcaccaaaccaaagcgatcggagagggagagacggcgatgactacccggcggcaacacacggagacgacgatgacgctagacatacagcggattagattagattggattaataccctaggaaaaaaacctaaatcggtgaacggcatgggagcggtggttgcaggcgaaccacggcacaataatgcaaacgagggcaccgggagaaagagaaggcgacggcgattcttaccaacacttatgcgacgacgaacagtgaaggagatggccggcgacggactccaaagggcggcgaggttcgggtccacggcagcgacgattttccggcgacgagcagcggcaacggatggatggacgggcttctccccggctgcgacgctgtgggtggcgacggcaaagcttggcgacgacggaaggagcagtagggcctcgccggagatcaaaacgcgacggcgaacttcgggttgacggcgacgatggagctccggtgggtttcggctacggggaaggggtggacggggtggagcttgaccttgcggagccgagagaggcgacggcgtaggtcgtcgacggctgaggcggctgctaggggcggctggagcggctgccggcggtggacggagaagacgaacgcggcgacggcgctacaagcgacggcggagagagggagaggtggcggccgaaagaggagagggagggaactctatttatagccatgggagagagatatcgatcctacaacgagagaatcgaagccgggattttctagagtttggtttggagagataaactcgaaaacgaatccaaattcgcatcgaattcaaagggataaaaccggatttttgggggaagagatagaggaggataagggggatattttgcctcaactaattttggaaatacacgagagaggaggccggagttggagggggaaggcggcggcaatggcggcatcgggctctgtctccggccggctggaggttaggggcgactactgtagcagagggaaggaaaacagactttcagctgggcttcttttactcagcccgattgaaggagggacatgaaatggacttcggagaagggatagaaccagccgaaaggaagagagaatggaccgagaactaaaagtgaacttttctagtttcggcccggaaaggaaaagggtgtttttttattactttcccaattaaattaatcactgaaatgatctctaaattgttaaaaatacttccggtgctctaataattccaagaaaaattattaaaatacttgaacactataagtatttaaaaaaattataagaagaccatttaatgattaatttaatatgcgaatcattgctgaactgctctttgtattattaaaattagtaattgagctctgaaaaattcgagaaaattgcagagcgtatatttaattatggagaatttaataaaaattaaatgcagccatgatttatatttaggaaattttatttctcacatttaacttcacttgtaaattaatgaacatttaacataaattctaataataatttattaaataatttataaatcataaaacaaaaatcaggatgtgacataattgtacaatctcggattaattaattaatttagggatttgctagacaactgccggctagacaatcaaaaaaaaactcaaaagcttttaaaacgcacaatataagtaagaagataaccatataaaattgtaagaccaaactaaacttagtttcggagtcattaaattaacaaattaaatggctaaaaactttgttcttgagtttttatttttttttcttaactattttgttaatattatatctaataattgaagtcgattttaattaatcttgtaattttgtaggtttactaataacactttagcagtgttcaaaatacataatctatatattagctatacagaaatgtccggttttgagcttagaacatatccccctgatgagaaatgtgtaagaaacatcaggaatacatgttgtatctgacatgaaagagcaacaaagaaaataaaaagaaaaatatgtgattatctgctatatatcctcctggttatgcatggttttagttctgttccaaagagtgatgttgaacccccaccaaagaacaatcttcccaattcccacaaatgacagcagcattcgtacttagacatccaaccaaaccactcaaactcattctcaagcaatgcaactaaataaatgaaaatttaaaataccatattattttgccatggtttattaaatataaattagaaaaattctaaaccgttacgagtcattcatgttaaaatgcattttcaatcgtgtgctataaattactccctccatctacaaaagttagacatatttcacatttgagtttttccaaataaattgtttctatttgtagtctttattcacttaaggctttatttagttccaaactttttcatcaaacttttaacttttccattatatcaaaactttcctactcacatcaacttctaacttttttattcaaactttcaattttaatcaaacttctaattttggtgcggaactaaagcccaagaatctcagttactacctgttagctcggtacgacaccatttaagaatctcatcagacatctgcagcattttaatttgttgggggtgctaatgagctttcaagatggaagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatctccacactactcctcgagtagtccatctgcacatgaacagcttggtggataggcagatcggacggtcgtccacgggtgatgaacgaacagtgtaacagttttactaatttgttgacaattagtaaaaatctattcgattttcaacttttttgggttcaaatttcctgaaaacttagaatttcagtctgccgattcttttaggactctgacatcttcatccttcctcagaagttagcaacaggcatgggattgcaacagtaattagaatagcttccttcactgttcttcgaaaaaaaaaagaaaaagaaaaaaaggagtcgaggacgagaagagagcacaccatcagttttattttattaagaggggtgcaggaa

SEQ ID NO: 9736 - DNA, 11436 bp, Oryza sativa
ccctcagcgccaccgagtcgactggccgtggcagtagtacacctggtatagatatggcatagggtggcacgccaccacggcgtcgccgccgatccgggcgacgccgtcggccgctaccacgtacctgcggggctccctcccgtgcacgagcgtggtgaccgcgcgcggcgcgctggtgcccagcgccgaggcggcgaagtcgagcaccgcctcgcgggaggtggcgcagcaggcgcgtggctcctcgccgccgccgccggcggccgtcagctcgctgcaggcgcggagggtgtcggcgacctgcgccgccttgtcggatccagggaggatgccgaacatggcgaggatggcgtccatggcgcggaggtcgaacggcacggcgtcgcccttgtccttgtagatgaaccttggcgccgccgcggccacgccgtggtcgccgtgcggcagcgccagcttcgtgccttccggcaagacggcgccaggatgcaacttcttcattaagaagagcatcccgcgctggatatgtatgcctgcagctgcatgaattcaaatatatattccatgaaaggttcgctgaaatgagtacaaaatctacctatatgttcttacctggatgagccagagaagacaaggcagccggtggagtaggaggcgcaacactacgtggattccagtcgactgggtaagcagcatcagtgaattgggccttgttaccatcttgttaacacaacagagtgatgggatcaatttgattgcattgctagtcaatgaaaatagcacatgcatatagcataaaacgactataatatatactacttactagaatgttgagcaaagatgcccggtgctttaggaggtgcaacactacgtggactccattttaccgagtaagcagaatcagtgaattcggccttctcaccatcttgtgaattatgtaataacagaattaattacagggtcaattttgtttatggtttaattaactactagtactagagaataccaatccaattgatgtagcataaaacagtacttacttggagaagcagggaaggtggctggttgtttaggaggcccatcagcacgtggactccacttgactgggtaagcagcatcaatgaagggagcattgccatcttgtcgatcatgtaacagaattaggggtgaatataattggactaaattactagtactagtaaatgggattaaaaacccactatgtataatattcgaggtagaacaaccctgcaatacttagagcatctccaatagcttctccaaatcgaactctccaaacacccatatagccaactctccatctgatttagctagtcaaactagatgctctctccaacagactctctattaatcctctccaaaataacaatggacccacacgtcagcctctactcctcttcttcttttctctcccccttccttctttcccctttcttttcttcccattcccttccctgatgccgacggcggccgcgcgtggtggctcgatgatgcggggaggcgggaggcgagacaatgtcgacctcccctcgagctgccagatctacaagggggcggcggcggagctcggcggcgacgtctcgcgacaatgaccttgacgacgacctggggagacgacgaccttgacgatgctcggggcggagctcggcggcagtggcggcgacggctcgcgacgacgacctcgacgacaacccggggcgacgatgacctcgacgatgctcggggcggagctcggcggcggcggcggtgacggctcgcgacgacgacgacccggggcgacgacaacccggggcgacgacgacctcgacgatgctcggggcggagctcggcggcggcggcggtgacggctcgcgacgacgacgacccggggcgacgacgacctcgacgacgacccagggcgacgacaacctcgacgacgacccggggcgacgacgacctcgacgatgctcggggcggagctcagcggcagtggcggcaacggctcgcgacggatctagaggagggcgacggcgagggcggcggctcgcgatgacctcgacggtggctccctaccgccgccgctgctcgccatcgatttttggcaagcggcggtggtagggatttcagcggcaaagggggagagagagcgagcggatgcaaagaaagagaatagggaataggtggggcccacagatggctagtgagtttggctggccaaatttggctactgaggggaaggatttggccagccaaatggcttggcaagttgaatagagaggctattggagtactttttttttcaagaattgacaaaatttaacttggagagtcttttgaagaggctattggagttgctcttactcggtagatgatgagcaacgaccagcgatggcgtggacggatcctgatctggtttccacttcgccgggtatgcagcatcagcgaattgcccttctccatcttgttatgtcacagaaacacgggttacttaaatgaattgctactgaaaacgacaaatacagcgtagaaatgacaatcaaacattctcactcggcttttctcaagaaaaagaaaattcttactcgtcggcagagtaggagaagccatcttgttattttgtaacagattaatggagtcaatttaattgatgtactacactgaaatgcagatatatagcacttaaacgacgcctgtctgatgatacttactcagttgatcaacacagttattacttaattactagaaaatcggcgtgcttattggcatgcttgcttaagttagcccgtaattttgtgtgtgtggagtatttgtatactgcttaattagaggttatttagaacgtgagaatttttaaagcaaataatccggtacttaaaaagttctatcagcatcatacctttaaagtacccttttagtgtgtttttagatttttttttgtggaatactgaggaaaaaacactgcatcatactaatatacgctaacaaattgatgaaggttgtatattagatgaatagaaaagtgtgttttatgaatatttcatctcacttttataaattcaaaagttttgcctataagctgttaaaaccatataattagaaggaaaatatgttcatgatgtttacacttgctactaattgttttatcttttctagaaatataagataaaaacaaagccaagttatatgtttccaaatctaacctaacgcaaattgtacttatttggattatttctcaatgacttttccaaagcaataaattggtataataagaaaaaatattgcatttttatattttgatttctttatactgcacattcctttttatatatttttattatttatttttttttcttttaaaataatattatataggatgctgataacatggcctatgtacttgccttgattttcactttaatctacagtaaccgtatctgttgttgaggaaatatgaatcataaaaatgacatcaatattgaacgtcgattattattaatttttccaatgtatcacaagttcccaacatataaatatgactaaatatgctaatagctttgtggctgagttttttttttaaactcatggatagctggtactgcagctggttcaggcgttcagttgcacatgcgtgtgagtgcgaatatgcagccggctcaaccggtcagcccgcattctcttgtgtatttgtgcacgcactgccatgggccaaggaccaaaggcggtaagcccattgggctcatttcatggactctgactaggatgccacgctagctatatataggtgcaaaaagttgttgaaaacaaaacttgcactattgacataataagtactgtgattaaatcatatatatttttttataataactctaagatataataattagattaaacggttaagaagtttgtttgtaataagcttttggtacgcgtacgtgccgagtgtttacacgagcggagtaataataataataataataataagcagcacctgctggagtatcatgtccgtggccgacgaacgacacctgcaggttggtgatcttgttgttcgtcctcgccgcctgcgagctgtcgtcgacgtaccggccggcctccttctccaactccgatgtcatcttcgtcgtcgggaagcgggccaagagactgcgcggggcccgggccgtcgccgcgtgcgcgcggcagcagccggcggagagcgccgccgccagcaagagacaggggaggaaggacgacgacgacgacgacgccgccgccgcccggaggctgaagcggcggcgagctgcggcgcactcgttgcccttgcccaccatggtctcgccaccaccagcttcctctagctaaacacacgtactgtgatcaactctttggaaacgaaattgaaggaaagaaagctagctagctaaacgcttgctgctgctgctgctgcgtttggagcgcgcggctatttataggaccgtgagcggcgagccaggcagccagagatcgatcgatcgagccagctacacattatattacacacacgcgtgttgcgtatacgtgcatgcttgcgcagttgcactgcttccgccttgtgaggcagctgatcaggtgagggactcggtcggtctctggttctggctgggtacgtctcgccgtgcaacagagctgcaccgtacgcacttacatatcctcatgcgtgcacgcgtacacgttttcatgctctctacctagctatgttgccatacaaaagtgacgcgacctgcatgtcagtaattaatgatatatatcaagtgagcgacgacaaatgggtttttgaaactgaaaatccagaaaccacatgttatgtcaggctatatatatacataaacgacaaattcccaaccgctatgctatatatacgtgtactcaaatactttatttaattttattactagccttttaaccaagtcagtcattattactgccatgtgtatatatatgcaacacattttgtgctcctattgtactttctcatctcacatctttatatgaatgaagggaaatggtagtttttaggtgactgagatttggtgttcacctgctccctacccattggattgaaatccaacgtttagagaattgtcttcaaccacttctcggcgatggcaacagtgatgaagagatcctcgccgatccctttatctttctcatcgccagagacatccgattgcggtacatgacctacggattagagttagggttttggggctagggttgggggaagccgtggggttttgggaagaaaggagcggtttctcccaggattagggagatggccttctggggtggcctgatcgacgatgagcggcgaggcggcggaggcgctgctggagacgcggagttagaggcacgcaggtgggtagggttggtggcaggggtgagggatgtcatggggtttggaggatgtggtcatcggcagtgaacccgatagcaccacgccgccgccagaagattagagaggaagagagaggtggccggtctagagggggctcgccggcaccgttgatggcttctggctagctagtgagccatggggcgaagtgcggtggcagtggaggcctcagtgctcagtaagaaagcaaggcgtggcgatttgtcctgagtctcatgtgcgtgcatgcgaactagaaaagagaagaatcgttaagggagagataatgagtatgcacaaatcttgatgcgatcctagtcgtccaaaaaagtgactgaaatttttcggatttttcatcagttacattaaagctagacaagaccttatataaatatgttataaagtatacttgtagcatatcttatgtgttactatgatattggattttcccctgtaactcacctgtttatgttttactgggatatatatatgtaatatgctacagtagacatgccctgtagttatgacctcactttatgttgccatacaaaaatgactcgacatgcatgtgaactaatcaagtgagctacaaatggtatttgaaaactgtccatcaagaaaccacatgttatgtcatgctatatctatacatctatgacaaattcccaaccgctacacatttctaaagcaacaaaatgctatatatacgtactcaaatactttacttatttttgttagtaatcttttttaaccaagatagtaactttcttcaattcaaaaattgaaaatcagattggggaaagctgtatataatactctcctaccgctttactctagtactctcctaccgcttgtacactataatagtgaagcgcagcagcagagaagtagccagtattaatgatactactcaaatgtaaatataaaaattatagggactcaattagaaaagtacaaacccaaaaattaaaatcatataaaaatggaatgctctcgaccggtaggttccgtttttgcacacagatctttaatccggcacatcaattttttttcaccaagatatatgagatatcacgatatagattgaaaccgagaggagtgtccctgggatctcggactcaaaccgatgccgaaaggagtggtgtgttttattttccgtttttaaggaggaatccactagaacggataccctcatctcaattgggcggtaagccccatctcaatcgggcatggcggccgtcacaggctagaagtcactgatgtgaagagttatctcaatcgggaaaatggccgtcacggatgattctatctcaatcgggccctaagtaaagcccgtcaccgatagctttgacccagacgaccagtcaaactatagcctgtcacagatgaactatctcaatcgggccacaactagcgcctgtcacagatgaccctgatctgtgacgggcattacctatagcccgtcacagatgagtcatctgtgacgggcattaacccgtcacagatgagtcatatgtgacgggcgttaactatagcctaagttaatgcccgtcacagatgagtataattaaaaaataaataaattttattttttggctagccctcactcgtgtgcacccacgcgagaagttcaaacttaatgttaaagttctttaaagattggcttccgaaaaagtagttgtaacatgttggtatgagtattctattaatcctattatgccctaggccaggatgtcaaattggggttattaaatgatttcaaatggaaaagtcaccaaaaccaaagttgtagaactcatcgaggtgcaaaatttttattttgatcatttctccatttgactctatttaaacaatttgaaatttgaaattcaaagtttgaaaagttcaaatagaattttagatcagcgaacgacttcaactgaaaaagtcatcaataacaaagttgtataactcatcaaaatatataacttttattttggtcatttttctatataacattttttgaaccgtttgaatttgaatttgaaaatatgacaacttcaaacaacattttcaaatacctaatgatatcaactgaaaaaatcatcaaaaacaaaggtaaataactcatcaagatctacaacttttattttggtcatttcttcatatgacaaagtgataataacattgttcacaaaattgacatatctcttatcgggttttataaactataacacatatatgtaaaatttgtgaataatattactaacattttatcggatgaagaaataacaaaaataaaagttttagatcttgatgagttattcaactttgttgttgatgacattttcaattgaaatcatttagtatttgaaaaatgttgtttgaagttgtcatatttttaaattcaaattcaaactattcaaaaaaaaatgttatattgaaaaatgaccaaactaaaagttgtaaatcttgataagttatacaactttgttgttgacatttttttcatttgaaatcatttactacccgtaaagttattctgacttataaaatgaattattatactgcactaaattattttgctatagtcaacttacaaatataaacatttcatatgaaaaatggaaaaatagtcatcggtgagggatttagttaatgcccgatagagattaagtatattggccgtcactgatgagtcatctgtgacgggcctaattgttatctcaaacgggcctcaagttggtgcacgtcacggatgatggtcatctgtgacgggccacaacttgaggcccgtttgagatatggaatgttatctcaaacgggtctaaagttggtgcccgttacagatgatggtcatctgtgacgggccgcaactttaggcccgtttgagatatggaatgttatctcaatcgggcctaaactacggcccgtcactgataggtgtcatccgtgacgggctttagttttatactcatctaacatgtctgtgcaaccatatctcaattgggtacttttcggcccggttgagatgacttccttgtgacggcccgctatttctaagcatattagagcccgtcacagatagaaggatctgtactagtgatcggatatagagtcggactttttttttcgtttctgagagagagtcgaacttttttttttattttttcgctatttattttgttttgaggaatgaaggaaacacctcttttttacatagtagagattaagtagtagagaatcgggctgatttttttttgattttttttcgcccttttttaccagagttggattcatttttcttttcgtttattttcgccctttttctggatcggacatatttagtttttcttttctttttccggttttttcgcccggtttttagatcggacagattttttttttcttttttcgcccggtttttttacgtttggtttttcttttcttttccggtttttcacccggtttttttatcggaccgatttgtttttttttcttttttttttagtttttttcggacgatggaagcaccttttattttttaagtagtagagacagacatagagatctctacttaaaaacaggaaattcccgtcctccgtaaaaaaaagaaaaaaatgtccgactcaaaaaaggtaaaaaaagagaaagaaaaaaaagtccgacttaacgagcgaaaaaaagcttccatcgtcagtaaaaaaaaagaaaaaaaacatctcttgtccgactcccgtagaaaaaggaaaaaaatctcctagtaaaaaaacaaaaaagttcgtttggttttctttggcaccggtatttttttctgttttttctttgcacgcaaaagagtttttttatgcagcgcacacgctaagccttttggttgtttgtcccctttttttaacccgatctgttcaccgcgcgtctcccagacgcttttagtttttttcgtcaatcttttttgtcaccggttttttctcccgtgagctttttgtttttctcatctgattttataatcccatctgttcgctgcacgcctcccgaggtgaaccctagcgctgtgcagttgccatatcgatcgtgtgttttctcctccaatttgattgcaaaaatcgattccccaatcctctctcatcattgtctccatgattttcccttcgattcagctttaattgccggatttaatctctattttacacttgcctctctcatcattttctccataattttcccttcgattcggctttaattgttggatttaatctctgttttacagttgccgatgatgacggcgatcttccccagtcatttttatcctgagttttacgctctgattttggggaaaacggaaagagtagatcgagtggataaaaaccctcgaccaattttggctgatctagaaagattcggctagatttgatggggcgatttgattcggcaaatgtacgggcacggacacaggattatcttcgggaggttgaagatggtagtcatattcgggaagttgaagatggtagggtcgaagagaagcagatcaaatggagggaggtagcgcactagcatagggctgaaaaggaaggaaggctttcgaccgaaaacccaggaaatattttcattaatttttttaattataattatagcgatcccaatgttatgatttttattaactttttcaatcatagtgtatagtgatcccaatattttaatttattactcagctcttaatataacactgaaaaaagtcgttacccgttgcaacgcacgggcatcttttctatatattgagaactcataaactttatcattatttgagaaacaggtaggagtagatgatttatgcaattcgctgcactgattgttttcaaagatctagcatagcagaaattgttagattactgaatgaactttggaagccatagtaaaaaaaagtgacttaacaaaggagacaatagttcattagcccagttaatttattttcaacagcagacttttgtatgttggtagcttgttaggatcgttcaaaaacatgtgacctcacaattttagatttccatagcaaagcacgggtacttgactagtcttataaaaaaaattgatgcgtctatgaatcttatataacctatattagtagcattcttgtctatggtgaacttctggatatagatgcaagcggggcgggcaagcggccttttttgtcccgcttatcccacttttagtttttttgtttttctgaattgtgtacaattatgcgaaaaatagactagcaagtgggtttttatatgggtagcggaactacccacttgcatccgtacttctggagtaatgctttctcaaacataaacatctctgcaaacacatcatcggctatgcatccagggatttccgaacaacattgcaatttcttagttccattgcacattccgaatacacaactgatcatgttgcaacaggttaccaagaaagtatatttaaattcaagccgaaaatttagtctcggtgatagacttggcccctctttcatctactaatcatggtttaatactctgatcccttggtgtattctgatacaagtttcgaaaataacgataaattgtcttccagaagttttgctggcgagtcagcctctgcgattttacctgtttacaataacatggaattagaacgggagaaccaagctattaactgttggctactaagtaaaccttaggcacataactaaccattgtccataagaatgaccttctcactatcaagaactgatgtgatccgatgtgctatggtaatcaccgtgcattcggagaattgttgcttcagggttttctgaatcaaattgtcagttattggatccactgaagaagttgcttcatccaaaaccaagatctttcgcttctttagaaccacccttcccaaacaaacaagctgacgctgacctgcactccagttgctgccattttctgtaactgcatttcatattaaagtataagttatgagtttgacatcgtggagcaatgcattatagctttctgatatagatatgaaacctgtagagtcaagcttgagatcactctttctaacttcat

SEQ ID NO: 9737 - DNA, 27537 bp, Oryza sativa
  unsure (1)..(27537): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgtctgatccaagtttgtcaattccattcgggaggccatcccggtttggctcttggaattaggggtgagaaaaaaaaaacaaaccaaaaagactgaggtttggctcttggaattaggggttagtagaaaaagactgaactgaaagaccgagaccaatttagtcctaagtaataaaagactgaattttgtatggtaaatccggttagtctcattggttaactgaaaaggccaaatttaaaaaaattgtcaaaatacaacctataatccactaagttcaataggattaaactctaattttcacatctctacttattcaggcatgtaacctaataagagtcttctcatacgtgtttgcgattttttttgtgatttttgtgttgaaaatttcaattatttctttgcatatatgaaaatgttactgaatttcggtcaggactgatatttttgtgttgaaattcggtcttcactttttaaagacgaactaacataaagaccaaataccgagactgaaattttcggtcagaccgaatacccacacctacttggaatatagtgttctagtacagtcgatactggtgtactattatacagttcaataaaacaatataaatatattaatatacgatatattatcaaagtttcacatgtaatcatgaattaataaaccactaaagctaccatttttctctttattttatttttttgggcgcctcgggatgctgccacgttttttttttctcctttctttttttttaaaattttttggcgtcttgagatgctgccacgtttgtattgctctggagcatgactcgatcgggtgagaggaatcggcaacacgccattcaactggtcattgcgctgttttagcacgcaaggggtgtaagtgggtcagccgcgaacccacttatagatcaaaataaacggacttgcggcttattttagcttataagtgggtttcgtgggttagcctaagcacggccgtgtacatccgcgaaggaaaagacgcgtggtagtatttttgcaaaaaaaaaactcctcacatttacactgaatatgcatataccctcgaaccgactaaggcaccggtgtgttttatccggaaaactactcgtctttgacagaaatacaatcccaagaagcgaaaattccgcttataaggatagcgctctaaaacagggaaacgtagggtctttcttaaaaaacaaccacatatatactactagcaatattttgggtcggaagaagtagaaaacttgccgcggctttgccgccttacggtgatgatcagttatttgaacattctctcacgtctagagatatgtaaagtttaggaaagttagcacgaaacatggcacttgacaaaaatataaaacattagtcactaaagaaaaaagttcatcactctccaaatttgtttggtactatttcatttcaaattccaaaaatacgtgattcttgggggcacaccctggcatatattcagtaacgaaagtttcataaactaactattcaataaaattcaagggtctatgctatgagcaagggagcttctggatctactgaatgtttagattccttcatcaagttcatcttcgcctataaaaatgaaatggaatgaaatcagtactgttaaacacatgcccaaaagcatcccttaacactgaagtaactgttcagattatgctcatatgttctgttcactgctttaacgaaaacatagataaggcatgattagctgctaagtagttggagaaaattgcacaaagaaaaagaaacaatataaatttagaaattttaatatctgcaggaatgttggagatcatcataacacttccctactcaaatccatatgaatattttcaagttctttgatgaataaagcattttatttacttttaatacttttattttgctatatcataaaagaagttgccaggaaaaaaattctaatgtggtgcatcgaacaattatcttatctggaacattgtataagggtgatatcaacctaacagcaagcatacatgtcaagcacatgtatttcgcaacaaaatcaaattatttactactctcatatgcaagcaataggacactgttatctgcagatgccacacagttctatttagcttccatagtatgaatgaaaactaccatgccagtacatatagaaatatgtagagactttgaatgttgaggtgttgaacatttcagaacacttcacagagcaatagcacttggcaaattggcaattacatactccctccgtactcataaaggaagtcgtttaggacaatatttaagtcaaaccttgggaatataaatcataaataactctcaagttgttgagtttgaaaatgtaaaaattatatgaatatatttgtcttgaaaaatactttcataaaagtatacatatatcactttttaataaatatttttatagaaacaagaagtcaaagttgtgttttggagaccgtgtcgcgtcctaaacgacttcctttatgggtatggagggagtatctcggaacctcttaactagttaaactgtagcagttgatgatcgtggcagtccttaatcattggtcaaacccaacaatgttttcaagtttttttttctcgaacacacaggagagctgcacatcattatattaataagaaggaaaagagtccaaaaggactcacacaagcacattagggcaggttttagtacaaaacggcttgccaaagaaatacaaaaggattatgaccatctgaaatagttagatggaatgttttcatgttttcagaggaatattatctgaggaataagcatcagctaattttgtgccaaaagctacgctaagacaggatgaaatagttagttggaatgattgggcataaagtattctatcccagatttcctggaaaggtgggggaaactaccaagctgaagtgaagtaggggcacacagaatttccagtggagtgctgaattggatataggaaagacgaacgtgaaagtactccacttggccaatactattttatatttcacttattagctttctcataagggattttagtcaagcaacaccttttgtgacgttttttttgggggtattgaggggtccttttggatccctcgtttgtacatatttcttcttcttaataaaatgaagcgtagtcctgtgttttcaagaaacaaaagggattttatttttgggtatattattctagaatttcccacagttctctttaccctggtgtctccaaaaattatatctcatctggaacatttgttttatttaaaaaaagtaaggatggctaccaacagcaacctcctgtcaggcacatgtaaattaaccaccaactataaagctaataagtagttcagactgagcagcagccgtacccagaagaaatacaacatttctgccttagatctatgttcacatgaatgtcaaaacaaatgataatatatacttcctctgagactctgattccaaatacaaatggttttttatacttgtgcacaaggattaagaaagtgatgaaatcagctcgttgcccttcatttatacacagtggggacatgttcacgagtggtaacatgtattcataaaggacaaagaaggaaaaaaaatgagagtaaaaggtgcctcaagttatgacttatatttggaaatgagttaggaattcaaagatgacttatgcatggaatcagaggaagtataatcttacctttttcacatctgaatatagatcttcaacccttttctctgtctgctttgcaaatgaccacattttgtatatactagactccatctttcttgattcatcaattagaatcaagaagtaccaccttctcgattaagaaagtggtgtttgcagacaggctatcttagaggaggtgtttgcaaatgacccaagaagcaccaccaaccacacagaacacagcgccacagcgtccaatctcctctctcgatttgacataccttaggcgacggctgcaactatttgtcggcgttgacccacagctcccggaaccacggcgtggaagggggcagatcggacgtacgtgaggacgaggatgccttgctagcttcggacgtctgtgctgcgtcagctgttcccctgaaatccatcaaccgctcatgggtcacagcggattccggggagcgaaaaatactttcttcgcacggtttgtgggtggaggggattttgcttcgcctcaaatgacacgcttagcattgcttacctcaggaagaacaatgcatcgccaggaaccaatctttttttgagctgacaaagacactccaaccggttcacggttgtaagcagatgtctccatttgttgtcctgaaaaaaattggaaagatatgagattgcaatccctgcaagtgatatgtagtgtaagtattccaagaaaaacatcagtagctgttacttattactctgcacaatggcaagcataagtgagaaaaagtgttacaccaaaacatcaagaacaacagtgacaagaaggttaaaacagaatcaaaccaaataatgagattccaagctcaccacggaagatgtgatggaaaggtcactcagttccatggagatctttggcaacccaaaacaatgacggggccagaacaccaagtaatttactgagtgttttatgtcacagctcataagtcacaactaaatgttctgtccctccctgtgtacctctgatttgctgatacaaacttcccaacacatcgtagatagaaaacctatcttggtgctgaacatcactggctacaaacaaatgccgtgtcttctcaacctcaatccagctgcatcctgcaggttttttcatatccttggatttcatcagtttcctgacatgctcaacactttcccatttatcatcagccgcaaagatgtttgacatgatcacatagttcccgatgtcctcagcctccatggagaacaagcgatcagctgcaagctgaccaattttgacctctccatggaccttgcatgcccctagcaaggagccccatgcattggcattgaccacatgaggaggcatatccaacgcaaaactgtatgcatcttggagacgcccagaacgggcaagaaggtcaaccatgcatgcacagtgctcttctgttggttcaactccatagatctctctgatggacttgaaaatcttaattccagcatcgacaagccctgcatgactgcaggctgacagaagagcagtcagaactacatggtctggcttaatgtcaagtgtaagcattttggagaatagttctaccgccttttctgccattccatgcattgcataagctcctatcatggctgtgaatatgacaaggtccttatgcaggctaacttgaaagaggttgtatgcattggctatgttcccacacttagagtatgcatcaagaagtgctccttctagatgaatatcttctagggatgctctaagcatgtaaccatggcattgtttcacaagttgcactgagctcagatggatgcaagccgaaagaatatttgtaatgcttatagtatcagggtttagtccttcagattgcaactgatggaacaagcaaaaagcttgatcacacaaatcgttctgtgcatacaaccggctcatcagattccatgtagttaaatctttctcagccatatggttgaaggtcatctcagcatcctccacacaattattttttaggtagcaagaaatcattgtattgccagtaacaatgttccgtcctgcaaggcttctgaagagtgtttctgcatcatgcaggtagccacactttgcatatgcgtctagaatagcattcgcaactgaagaatcaccagtataaccgactcgcaaggaatatccatgagattcttgaaccatcttaatcccacagaacgtactcatgcggataatattcaagatcgtgacagagtcccactgagttacgtcatgccacatttcaccaaggagtctaaagaactgttcaatatggtgttcactgtttgcacaagcagagagaattgcgttccaggatactgagtctttgttctgaatagtgataaaagatcgaaaagcagcatcaaacctgtcacactggctgtaaaagctgacaagagcattcattaatgatgtttcttgaagaagttcaggatgtcgaaaaatataaccatgaaccctgatgcccactctgagattgcctacttgggcacaagcagtaagtaggctgataagagaaacagaatcaggagccattccggcaaacaaaagcccctgaaacagtttcaatgcccttgagggataccgattcatcacatatcccgcaatgacagtgttccatgtaacgatatctcccatttttgaacttctaaatattgattctacagccctcatttcacaaaccttggaataatgtgccatcagcgcattgctaacagatatatccatttctaaaccatgtcggaccacaaaaccatgaatttctttcccatagtgcctcccatactccacaagtgaacagaagggaagaacattagccaatgttgaatagtttggaaggcattcctctgagatcatctgaccaaacagtgcaagtgcttcttcaaacaacccattctcagaatatcccgcaatgattgagttccatgaaaccacatccttgcaacaaattgtagaaaatgctagatgcgcatcatccatagctatgctcccaccacattttgcgtacattgataccaaagcatttccagacagagtgtcaaactccaaaccagtcttgatgacatagccgtggatactccttccagccctcagcaccctcaactttgcgcacaccggaaggacgacagcgaccgtgactgcagttggcatgctctcatctacaccactagcaagcattgcacggaacaaatggaacacatcgttgtaaagtccagcacgggaggaggcagtgatcaggatgttcctacataccgcgtcggagcagctcatctcatcaaacaccgtgtgggcgtccgcgagagacccgatcctcccgtacatgtccatgaccgcctttgccaccaccgcgccatccgcgtacccgaccttgacagcgagcccgtggaggcacctcccgagcgccgcgccgccgcggcagtcggggagcgcggacgacgatttgaccgccgcagcgagcgccagcctgttggggcgaagtccccgggccagcatccaccggaggagggaggtgcacccgtagtggtcccctcccactgcgcgctccctgagcagcgcgctgcaccgcatgcggtcgtccagggcaggcactgcatcgaacacgtcgggcgcaccaccaccgcttgtggctgcggctgcggcgcggaggtggtgggagagccgccactgccccctgcggagcgtggcgtcggcataatggcgacccggcggccttgcgagagggaacataagcatagccccttatatcaccagtattaatttccatgactgcaccccataaccaaatcattgatgcaatgaaaatgtgaccatctcgttaaataatctcatggtaggtgatgcacactttatttttcagcttctcgaacagcaggccacaagatcaccataaacttcaatgtagtactacctccgtttcaggttataagactttttagcattgcccacattcatatagatgtcaatgaatctaggcacacatatatgtctagattcattaatatatgtctagattcattaacatatatatgaatgtgggcaatgctagaaagtcttataatatgaaacggaggaagtaccaaattgtcaatcatctcaacaacacaactcacacaagaacaccagaaatgccacaaactatcattatagaggaaaaaatcaacttgacctatgcactaatttgcttgaatattaatgctaaaaccgatcatacacacatcaagtcaggtacagccatgactcatgtacgattttttttaaaaaaaaatagcacttcttccctcagcataagcatctcaatatgttattccctcatacatgtacactgaaaaaactatgagtggacatattttgtaaatatatccttatgaccaattaagaaggactcagcagattcatttacatatggagcattcatattgtggcagctttaattataaacatgtagagaaaagtgataaaaagttaagtcatttcccccttgcagattaattgttcagaacttgagagatcaaatatctaagtgcacgttggaaacgtacgagatcaagtatataagaaggataagcaaaaactgtattttggttgattctaaaatatactatttaagaaccgaatcttagttgatcatgatggcagaaaaaccatggtcggagctactctgcctagactcaactgaacaacaaacttaagatcccctgcaggtaaatatttgagaactttcatctatactgaagaaagccacaaactcatatcagcggcggatccaacttgggacatgggggtttgggtgaagaaacaaactgttattacttgaattaagagaggtttaaggctatcaaattaaggaggaggaaaagagcttcttccagatctagaagagaagctagtagggttcacgaacgcaagcaaattccagtcccggtggggtgggagagagagagagatgaatcagaaagggcacgcggatgctcaccaggatcccctcccctccgctgctctgctcgtctcgccgcccggccctcccctgttcgtcttggcggcggcacaaggagcggaggagacttagatttttctttttcttttacgcgatacccgcccttttctcaatatttttagagtaaattgcactatggtatagtaagttacattatgaaaaagaaggaactattacccaagttgcataatgaaccatgtctataccaaacttttcacttaacattgcttggaccaggtatagcaatctaggtttttcactgccagcgcggctccaacatcgcgtttacttagtagagagatgaagtggctctcgtagggcgggctcaaggccgacgtcgacaacgccggaggagattgtgccaacagcgtgagtggtggacggcaagtaccaatccctattagccaatccattatccagcctcacaccctcgccgacgcgctgtcgggcgcggtgaaccatccactccgaagcatggcggcagccggcaggtaatgccaggcatactggcaatggcgttgatcttcttgtaatgctagtgtgagctgcatcatgaactgaataaggccacgctgcgaattaagtggcaatgtcttctacttcgtgcgcttccaccatcgatctacagcctgcataacatcctgttaatcatatcatccgttgcttctgcccaaatgaaaatcgtaatcccgttacctgtcccggtccggcagcggcgccaacagccactggaggtggaggctgggaaaataaccgagaaagcaagcatgaatcaatccattaactcctcccaaatgtatgtggctctaatctttctctaagctgtactgtcctgtgctcctggccaccgcctcctctcctaacttcaccagcgccgccgatcccctttctggtttgcgtgatgatcgaggctcgctcgagcttatcgtgatgttaattacatggctggagtagaaaagtcatcttagcagccagcccaactctctcagcctggtccatgttgcaaataattgcaaagatatatggcctaaattgaaaagactaaccatgacctggtccattgtgaaacaatggtcaattcagtcaatatttttattattttaaaactagctaggactatttctttatataactggtgacccatgtatcatcaatacttaagaaaaaattaagtgattgtgtcgacaacaaattcttcataccaccagcaaccactaactgcaccgccatcaccgctctttctccatgagccaccatcgttcctcctctttgcctttacatgcgcagccttaccctttagtaaccgacaaatctttttctcctctcctatcgtgatgcacactattgttatggttgctgttgaggtcggggatgtcgggcttacatggactttgggaggtaggagctgacctaacaaagagcgaaggaactatatctaggctccttgctagatctatcggttatccaactatcggagggaaaaagaaaatggagagagagagagatagttaatgtgcggagtaattgctgagtcaccggacttggagatggatagaataaggtggtccaaattgaaatgtaaagttagctattgtgtaaatataaagaatggttaaagaataacattatatgaagcttttaagaatttttaagaatacgtagtatggactgtaatttactccctttgtcccacaaaaaatgaatctagaactggtgtggcatattctagtacaataaatctgaacatatgcatgtctagatttattttactaggatgtgtcacatccagttctaggttggttttttatgggatggaaggagtacttttttctctagcacaattaaagataattgtccattacccgatagtcttgtgatatgctaagtatggttgggtcggtgtacttagctataactaataatctcatgatatattgatgcatgacgatacagacttctactcacacgggctaattaattatggttagatagattcctctaaaagatgataaaaataataccatcatttttgctcaataataaagcattcgactatggtcttcttttctcattgcatgatatatgatgactacattagtaggtatttccataattctttcatattgttttttattttctacatatatgttaatttgaactaatatttttctcataattaaatagataataaatcattttccatatttctcctataaaatgagaatagggtattttatattttgaaaattatattataagtgtatgtaatttaatgtgtaagatatggacttatagtataagatttaacttttttctaaaattgccgcatcatagtagataggtagttaaccgaacaactataaaaaacagagacaattcattgtgtgtcactgattttgtccttgctctacaatatgtcgttgggtttctcaagttctaatatggcatcacattttacttaacttctataatataccattgtcatctagttggcctcagttagcattatacaattttatcatacagatagtaaaacttacaaagtttgagatgggcaacttctctgtctcgtttataatatgatatttcggaattttcggccaaattttggaaatttttttcctagggatatttcgatcattaggacaaaattaagtactaatggaatttaaatggacggtgatggtatattatagaatttaagcaaaatacaatgacatactgtagaacttaacaaactcagtggtatattatagaacagggacaaagtcagcggcacacgatggattctctctaaaaaataatctagttgaattgtttcttttttattcaaaacaaaacattattacctaaatatgttcaaagaacttcgaaagaagtaagaaaaagaggaggttagtcactagcgcaaacacatgagggtggttgctcacattcatggtatggtatatactcacattaatcgataatatactaatattattaaaattgttctttgtagtaaatggtgtgaaactaaaaactttaaccttatattctattcttctgttgtttcatcttcttcttgttttctcattcttttttatttttgataataatattactacaaccagcactattacttgcacatgaatactactccctccgtctctaaatataagagattttggttagatgtgacacattctagtacaatgaatctagacataaagcctgtccagatttgctgtactaggatacgttacatccaactaaaatcccttatatttaggaacggagggagtagcaactagctcatgtgtgtgtgctccataatatatattatctatgtttttacatgaggaaacaataactattatctttgttaatgatattatatttataaaaggtatttgactagtttttttaagagaaagatacttttgctaaacattatctagaatgctataaaagttaataatattaaacgatatagtcatatttttttttggatgaactagtgatcaacacttgttatgaatccaataatcataatgcactatatatattgttcgagtgagttatgacattcactatttactagttactccctccattcctaattgatcatcatatatttttttagaatatttccaaatgatcatcatatttgtattcattcattaagtctattcgttatttgtgcattcgataaatgtacattgatatccatgcacacaagtatttataaccattatacaatgttttgatttgcacaaagtatttataaccatcatgcaatgttttgatttgctattggctaggaaataatgggatggtacatgcatcgagtttgttatccgagtaaatgcgagaagactaattagcgcgtacgcgcgagatgagttactggcgcgcacggacatgtgtcgttagtgtaacgcacgagcggtgctatggaaaaaaccgatacaaaaaaaagcgattagcatttggactagcttggttagttctggatttgttttcttttcccggataattaggcataatcaatgttgttttttttgtaacttttcaaatataatttaagtctttcgattacccaaagttagaaacttcatattccaaattgaaaactttcaacactaatttgaaactttcaactcatatttgcaaactttcaagttaagatttgaaaacttttaactaaaatttaaaaactttcaacttaaatttcaattatttaaaaaaaatcaacttaaaatttaaaactttcaactcggatttttaaactttcaagtcaaaattttaaaactttcaactcaaatttgaaaattttcaacttaaatttaaaaactttcaacttaaaccatgaattctttattcatatttgaaattttggtgtatccatataatatgatgatcaattaggaacggagggagtacatgcctatacatcatataaaccttatagtttttgcctacaagttttgcccatggtactgttttactatactactgttcagccaacagctagtcagcgtgtctacttcgtctgatctgccacgcgtcaacgatccgtcccctcttgtgtgatctgccacgcgtcaactatccgtcccctcttgtctgatctgccacgcgtcaacgatccgtctcctcttctgcttctaccctcccatgaggtcgcgattagtttctcctttggtttccctgtcgatccccttccgcgctacctattcttcttcgccgccgcctgctagggttcctgcttcgtcgcggccaacgccactgccgtccaccgccattcttgaccgccgcggctggccgggtgagcttcttctacgcccccggtgaccatctcgcgtcgctcctccggcatctcttcagcacctccactcccctcgacctcgcggggctggatccggagtcgctgccttcttctcaggctttcagggccagccgtcgctgtctccgtgcagggccagtgatcaccatcgttgcttcccatcgtgctaggtgcggatgccggtgtcttcttgcgggtcacagtgttaactgtagccgttgttttatctcctccctgcattcctcgcaggcttggttttgcaagatttatggtgcatcgaccgcccataagcacgtggtaaccaaaacgtgaaaattcacgtgggtgttcctgctgattggattcctcaaattaattgttcagttctccttgcaatcctttttctcacttctctttttcatatcaactttgcatgactagcggcagcctgtactttatttttctatttttctatggtgttggtaaatcaagtctaaagatatgaggtaaatcaagtctaaagatatgaggttacatatgttttacctacaatatgcttatgaactttcaatgttagaatgacatattttgttgatacctgcagttatttttttaagcacaaacactaagatcacatatgtatgttctgtttgttgattaccttttcctcagatacacatgctccagttggaatgtgcatagccattatgtcttgctttacatgttaattaattaactgatttagtgaatgtttactacagtgattggtccgtatcacaaagtacaatggacaagtgtgactgaaggtaattcactagccttttatgtatatttatagttataaaaatgtctgcagtgtgcatcagacaagcaaagagtatatatgggcggcgatggcacattcctatggaagggatttatgagtccaatgtcaaaatcctctctatcagtccatataatagcaattgcctaccatttatatgtatgtcaccccatcagagttatattcacgtgttcttatattctaaatccatatgttgttgagatgtgttcttcaatcgatatctatgcagagtgtcctatcataacattaacaatgttagaccatattttggcccttttcatagaaacctaccaaaatagcacttagactgacttggcaacaaagaagttacttggtcagatatatttttatgtttgagcttacttccatagtttccatctatgcagcgctcaaatttattcacccgtgttgccattcgcttaataaaccctattgttttgtcctataaactttccccacgttagatgtctacctcggctgccacgccgttgcctgatttcgcaccgtcgtagttgctcctagggttcaggttgagtttgtgccatcctttatgcctttatttttcacagtgatttaatttgtgtttattttctatcacttaatctctgctaaatgtgatctgcaagtattgattggctggtgagtttgcagtgcaagactcgtggctttgttttggttgacgaaggtagtttgatctaactataacttttagttttactttattttacttctatccatacagtctcgtagcctcatgctttcaactttctgatgctatagtacaggtgctacattcagctgtgctcttatgaattgataaataggtttattccactgaagaaacacttctggtagatatgttgtgccaaaacagcacttagattggattgacaggaaaaaatgcttgctcagatgtccttctattttgtgcttacttttatggttcacatatatgcggtcttaaaatttattcagctatgttgccagtgctttctacctatagaattgaacttctttggtttacctccaaggtaagtactatctacatataaaagtaaaaataatagttatagattcagtatgcagacatttttgttctccacaacattcttatgcatagaaagcaagtccatctgtttgcatgggtctagcaaatggtgtgggattgctatttcagtttctttttgattaatcggggcaacaacatcaaattaaaaaaacatgtgcatcttcctcctttcagtagcggagccaggatttcaaagttgggtattcccgtctaagcgctgaggcgctggccctgcccctcgtggccaccggccacccaaccggcctgaccgcccgagattggcggagtggcgggcgtcggccaccgctcgccacggcaatggcctccccctccgcgatagcacggtccagctcccgctgccggttgccgcctcgccgcgccgccgcctagggtttggaaatggggagcggcgcgaggggagccgagccagggagggatgggtcacggagagagagcaagagggggccgtctagaagggtggtggataagtgggtcaactgatgtctgatgggtcatgacggaatgggtcgggttggtggaggcgtcgcaagaggccggttgggctgtgtttggattgaagaattgaggatttaggtgcactaatatgtgtacatgtgtatatactagaagtatacttgttttgtgataaaaaaagttgggtattcctgggaatacccaggaataatggtagctccgcccctgcctcctttatgcagctgaagtgatgcttcttatacccaggttatgttcagaacacagccatatgtgcagtttagtcgacttgctttccacctctctatatggaaacatgcatatctatgtgttaggattaattccactgcttgtgcaatccagttcaaacactgaaggtttattctacttatcttttgcaccttaatttcactcatgagcaaactgtcttggtctctgcagctgcatgggaggtgaaacgcaggaattcggcaagaatgacatgctgcaatttcgtggtctcttcaagcacgtgtactaattatccttacattctgttgctaaactactgatatcttcatactagaaatatgaaattattttgtttgtcacatcaaggcttcgtagcagccaactgcatgtactatttcttttgaactaaaatagagtgatagaagcccaatgaggtactactgaactgctagcagcatctatcttattctccttatagctcaaaatgtattgcatagttatcagtcaaatgaaacatgactccactatctaacttattgttctatttctaccagattatgtagttctgcaacattcagcgactgtaatggcatatattttttttatggcatctcagatttatgtcccgggtttttctgcgcacaatatttttccctttttggtaatttacataactactccctccttccctaaatgtttgacaccgttgacttttttaaacatgtttgaccgttcgttttattcaaaaacttttgtaatatgtgtaaaactatatgtatacataaaagtatatttaacaataaatcaaatgatagaaaaagaattaacaattacttaaatttttttaataagacgaacggtcaaacatttttaaaaaagtcaacggggtcaacattttgggatggaggtagtataatctttaggtgtaaattagaacatatcatagatactaatataatttaggtgtgaattactgatattataacatatatactaatctataggtataaagagaaaaactaaaatagatactaatctttacatatgaattaacacttgaactgctttcagaggacccagcaaagtggcatgacatggcttgcatgtaacatagctgtaccttgcaatattcttaggtattttctttggctctgtgttgactggaagtgaaactgtaatgtttgacataatcaagcactgctttgaggaactacaggagagattaatactttctttgctccaatacccaccattatgagtttatttttgttcttttcttaaactgcagcggttcagaaaggaaattttaatggttagggcaccaacaattgaagctgtaattccctgttccaagttaattcatgattctggagaccttaagtatcatggaatgtaagagttttatctttgattcttttccatgttacctctgtgcttgatattaggcactttgatgcccattaaaaaaaatatatcctttcatatatatcttgcctttttgtcatgtaaaatgagttcccttcatatcatctctgggacttgtgaagtcagttatacatataaaataaattaatcaagtttagcatgtttgcccatctatgtgatgtttgcacatttgattggataagtggttgcaaataaaattgaatataacatctatgtccatatatggctatgttcgcacccgcggcaacgcgcggggtaccgtctagttacaatgaaatctacatataaaaaataagatttagtttatttctagtctagtttttttatgatgtattggattttttacatttctttagagataatattttataacacttagataatttattgttttataaatagattagtttatcgtgcccctatttataaaatcctacatccgccactgactcatatatgttaaacttgatttacactatataatatatcacaaatagatatttttgaagtgcaaaatcactttctaatatgcacttgtttgtactacctaccctactgtgatgaatataggagtatagggctacgttgtaagcactgcccatgcactggaccagcggtgtgtcggtgtggacagcgtggggtcagcgctttctgatatgcaccttgtttgtactacctaccctactgtgattaatataggagtatagggctacgctgtaagcattgcccatgcactggaccggcggtgtgtgggtatggacagcatggggtcagcgcggacggaggcggtggtgacgatgtcttcccggatgtggaggtggcgacagctgagtggaggcgggcaacggatcggggatctacagtaccggcggcgggataacacgacggcagcgacgtgacagtcggcggtggaagagggcaaggggtgggaggggcgattgacagagggaggattgtgcagcggagaggaggagaccagtggtgaatcggggtgagggagtcgattgtgaggagggcgacgggatttgggggccgcgggttgttactgatgtaatagctaattaaagcaggactttgattcctccgaatgttattgtttccgaatgttattggtgcattgatttaattctttccatagcatcgtacgggcaatttgctagcatataataaaatttgactcgttaagtgctattctacaaacacttttaattcgctaaatgacactttaataaattaaatcgaccatcgattttcaaccatttagacagtaatatctattttgtaaaaaaaaaaccggaaaccccatcccgaactttccttgcattacttcatctgttttattatcttcatgacaaattaaaattatttttatgggcaaaaaacccataaatagacctctatctactatgtctagcggctctccctatgtcattttaagaatgttttctaactcactacgtggtgatactgaattagataaaatactagaaaatctaagaaaaacaaagtattcgactatcagtttcttattttaggtcgttagttatttcctttaataaaagaaaacaacccaaacatctctccctccctccgcccgtgtatgatgttaaagtccatttaacatcttatatatgcttctaagccactacataacattattaaattagagaagaatctggtaagttcttaataaaaacatccacaaaattgtgacttaaatcgatggacacattattttaggttggtatatctatttttttccaaaaaaaaaatcccaaacctcccctccctctacccccatgcagtgctaaaagtccattaaacatcgtatgctaaaagtccattaaacatcgtataaacgcttctaatccgctacatgatgttcttaattatggacaaaaacaaaacatccaacaatcagttttgactcaaattgatggacacattattttaaatcaattgagacattattttaggtcgttagatctatttttttttaaaaaaaaaatcctaaacctccttccctcacttcctcctccgtgcagcatgcggttttaaaagttcattatacattctataaacgctatgttacgttgttctcttaaatcagacgaaatcctaaaaatgatgataggaaaacaaaacatattatcattggttttaacttaaacatccaacccattattttaggtcattagattaatcattcagaaaaacatcccaaacctccctccctccctgattgcccgtgtgcagcgtgcacagttccttttctctttcttttttttatctccctgacaattaaaattaaaattaaggtagatccaaacaacaggctaatctagcacacagtgtttcttttttgttttctaagagaagtctagcagtactatttgatggcatcagagatctgtgattcttcaatcaaactctcagagcaagtacattcttatgtttcaaggctgagagaccccaagttggtagctttagcttttaggccctgttctttcatgattctggattctaggtttttgtttgcatgcttccaagctcttagatggtttgtttcgtgcaaaatttttataatataatttttattgtaatacttttctaaagcatcttttcaactttgttgtagttaatttattcgtttatcccttaaatagatatcataaaaaaaatagattatccatcaatccaacgtgtttagctatctcaatcatggccttagcgctagctaacagtgcggctacaagaattcatatatagtcgagcaaatttgcaacctaggaagagtttgtaccagtacatgcatttctgatttctgtatatactataaaaatacccgtgcgttgcaacgaaaaactaaaattataacaaatataaaaatattagatgattaaggtttagttttacatattgaaataaaaaaagttcaactgaagggacctaaagtgaacttattccgtgcggagtgtacatgcggtccatgaggtggcccaatagtgcgggcggcctgggaacaattcggggacaacttgagcgacataaagtaaacttatttgtgcggagcgtacatgtggcccaatagtgtgggcggcctgggaacggcgcccggcccgacgcgggagaagccgtagccatccgatctgatggacggtcctgattgatcccgatctatacaaatactcagcagcccaaaccctaaccctaaaaccatttcctcttccccatctctctctcactcaaaacaacgtcggcggcagcgcctctccccaaccttcctcccaccagcgccgccgctccccctccccctccctccaccggtgaccggcgccaccgctccatctccccctcttcctcctgtctcaccggcacggcgcggcgactgggaggggacccaccagcagcgccgcttcccctcggccactccccccttcctccaccggcggcgctctccttccggcacgaatccggcggcggcggcggctccctcaaccccttgtcacctccctcccgcggtatatccggcggcggtggcggtggcggtggcggcgtcggcgggaggaggtggatccggcagtggcggcggtggctccctccgccccctctcgcctccctcctgcggcagatctagcggcggtggcggcctcgcggcggccatgggtggatccagtggtggtggcggctgcggaggacagatccggcgacagcggcggcggctccctctgccccctctcgcttccctccctcggctgaaacgacggtggtggcgggcgtcggcagcgcagctcggcaagccactgccggcggccactccgcgccccttcaccggttttggccatgggaggcggtggcagcagaggcggctatggaaaaatctgctcgatttctgttcgatttgttttttttatctccgtttgctgttcttctattcttatatttgggatctaacataaactggattaaaactttgtgtgttatttgatgcgcactctggatgatttgttgtttgttggacttatgatgttgcggacgaaatttttttaattaggttaggtatatatttgggagggagctatcggggtgggaatcggacataaaatttgggtgctacggatgcgatcgatctgagaaaaaatattgggagcgatctggaggcggagtaaaaaaaaccgtgcgccattgggaagttgaaaaaaagaccatgcgaaaaaaaaccctagcgctatttccatttgggggtgacttatgaaatttttcggcaaaaacaccttgaatttttatctatactaatataaaaagaaggagttcaccactccaatccaggagttcaccactccgatcctataggccaaatcaactatactccatccccagcgtcccacggccctcccacggtcccacctcccaccatcgccttgcccacactggggataccatgactcggatacagaaacaaaatctgtcccacctcccaccatcgccttgcccacactgtggataccatgactcgaatacataaacaaaatcgcatgatttcctcccaacctccacgagaaaaagtacaatatgccactccattcggtgggtttagataaaatgctatccaatacattgtaaaggataaaataccactcaataggttacttttaggatattttgccactttgagagattttaagaccaaaatacccctggccgtggatagagaggaagagggaggagcggaaggttgacccggacgacgctaatgctcgccggcggcgggtggcgagcgcacgggggtgggctgcgacaggtggacagggggaggaagacggcggcggagagggaggaagacgacgactgtgatgggggaggaagatggcggcgatgatgggggaggagggcaacgccgatgggagggaggaggaggcgacgacgatgacgcggagggttctccagcgctgcccgcgcgtacgctcaccccctccggtgccacccccgcgcgcttaccggcgtcttcttcctctcctcgtcgccgctagcgggagcacagatggtgcttgttcttccctcgtcgctgcctgtggccgtggtcattgggaggaagacggcggcggcgatcggggagaagggcaacgccgacgggagggaggaggaggcgacgacgatgacgtggagggctctgcagcgctgcccgcgcatgcgctcaccccctccggtgccacccctgtgcgcttatcggcgtcttctttctctcctcgtcgctgctagcgggagcacggacggtgctcgttcttccctcgtcgctgcccgccgccgacgaccacggccgctgccgttcgactcctctctccggctctctctcccttcctctctctctctccaaagtaggggcatatttgtcttaaacctcctcaaagtggtaaaatatcctaaagataacctattgagtggcattttatcctttgcaatatattgggtggcattttgtcgaaacccaccatatggagtggcatgctgtcctttttctccaacctccaccacacaattttctccgccttcatcgccggagtcttttacccctgtgccattaagaaagttagaggttacgtgtgtgccacaaaaaagttttgagtcacctgtatactatgacacaaactttcgtttacctatgcgccactttggatggaatcagcactaacggagactaatggaggtttaaaggtttattttgcccttgctctatttcagccactttgaatgaaacattgaacatttgaaagagaaatcggctcacacaccgcataaaggctgaaatgtaggttgaaggaaaatgaaataaagtaaacattctaaaaaattgaaaataaagttaaaacaagaaataaatatggaaaaattagtaaataattttaaaattatggaaataaatagaaaactgggaataaataagaaaaaaattcgtaaataaattttaaaaaatcataaataaatatgaacatatgaaaaaataaggaaaattcgtaaaaagataaggaaaaaaaatgcgtgcataagtaagaaaatgcaaaaaaaaaaagaaaaagcagaaataatacttggttataggatcaacattcaagcaacagctagcattacagaatcacacccaaactgaacaaactctgaactctgcaacaatatgtagcagcaagaaagcaataaatgcaacaagctgttcgtcctcacagctgcttcagtccgtcggcgaagcatgagctgaaccgcgccatgtcggactccggcagcgccacgccgatctagatgccgaccctgccgtcgcgcgcctccgccatggacaccgtgccgggcgtcttgtcgatggacaggagctccaccttcatcggccggcccagcccgaagtcggtgtcgtacacggcgtaccgcgcgagccggcgatggacatcggccggtgcggcatcagcgacacgatcttctggaaccacccatcggcaccgtccagaacgccgttgtcgagccccctgatggcggcgccgatgcccgccgccgccgtcaccacgccgccggcgccgagcaggccggccatgtcaagcaagggcggaggcagttgccgaggtactcctgcggcaccgagccggcctgggggagccggcctaggcgcgccgccggatctggcgaggtgacgcgagacgaggcgaggcagcggcggcggcgtgccggcgccggcgacgaccggcggcggctataaaggcggcggctaggctagggtgaaattgctcgggagaggagcagagatgaaaatgcttcaggggcaatttagtcattttcatacgtgggtcccacatgtcagagcttattatctaacaaaagatggatggaatggcagataggtaaacgaaagtttgtgtcatggtatataggtgactcaaaatttttttttggcatataggtaaccttcaactttcttaatggcatggaggtaaaatactctcgtcgccgcctcttccccttccgcgcggtgcctccatccaccgctgccgcatcggctcctgcctcctgtcgccgcttccgctgctcctgtcgtcaccgatgccgctcccgtcttcgccgacgacgccggtgactccctccaccgccccgcctccgtgccgctcgccaccacaattggacctgctggtccagggttccgttggcgccacagccccgtcgccgaccggtggtccagccttccgccagcgccactgctccgtcgttctccggtggtccagctttccgtcgcgcctccggtcttgccgccgttacgaggggcatagtctgccgtaggtacttccagccgtgcgtcaaaatttcttctgctggtgagatcgagtgagaccccattgactcaaattgactcttctgaatccccattagtcttctgtgtggattcttattcagctgaagggtatgcacatatattaaatctctcctcttaatggtgtgattcggttcttatcaatccatatgtgcatcattgcaggctatatcctatcaaggtgactggtgttgctccattcagactaacattgtagacttgtagttgccatgctgcgtctcttccagattactttatagagaaattatattgtacaggtttgagaattgttcaagtgatactgcattccaccatttgatttctttagctagggatactataaaattgtcgtaatacaagcttatacggatatgctggggatgggtgaacaggatggaaggcattttttataggcccttgtcagatgatggcttttggctttaagatgctctatgagaagggtcaaggagattttgttctgttatttatcattgattggcatttggttgatatatatgaattaatatactccataggcacaacaaaaaggtaatattcatatatgcaggattatttctttgctttaagtttttactaatttttactatggttattggtcactggtcagataaggtacatacatatatttgcgtagtataaacatattaaagaaactcagcttagtgtatgcaagggggcatggaacaactctgattctgaataggaataacttcttcctttttctgggctaggaatttgagtgtttactttttcattaacaagccttatgtgctcctagctagcagctgccggtgaattgataaaattttggtgattttgtcctaacgcttcaaattttgttttgggtagatccaaggacaaatatattctccaaacagatgaacttttattaaagaaaaataagatattttattttgaggcacaagtatgtgctatagccccaacctctacccaggggcacacgaccaaaacacattccatgatgctccagaagtctagcactgctacaacatgcataatttcatctttatattggcattgatccgggattatcctagccattgtcacatgctgctaagaggcggtccttttttccttctttgtgagaggaggcaaccttcatataagcctggtggcatctctgaccacatgcttggaggatggaattaggcaatgtgatgcacatgacttcaatgaagcgagttaatcggggttgtagatttggaggatggcatcagggaaggtgatgcacatgacttaagtggagcaagttaatcacgattgcaggtttgaaggacgccattacttacacataattccctgtcagaataatatttgacattcatatgcttgtacacatatgaaatcccaaaattatctacctgaatgttcttgtttgccacatgcataccacaacactattgactatttgtgaattatctgaaatttgcattttacttatgtatgctgatggttctctctgctcaatctcaattcaaagagttacatgtcattttccttataatctactgttaagttcctattgaatttatattcgctgaactctacccaaccatgtttgctgttgctccaaccaaaattaggaggctttatagtctttgtgtgccatacaactttatatgtgaatttgaatttagttttacatggtctgaacttgggcttgcattgctcaagaacttggttgacaacattctgaaattgtccttgcattatatggcatcctgtgtagtgtaattaatgtattgtttctattcttccctgtgaactattggttatgtactgagttaataattcctgacagcctttagaaatgtggaacactttccttttttttgttacaaatttcctaggagcaaaaaaatttccaatcacatctcatgttgtgtcctccaaaaaaacaaaaaaaaatgctgtaattttctgtcatgctgatgacaaattctttatatatacctcaaacatgctattcattttctatatttggagtctttgtccttgcaatatgtgtgaaccatagatgtctaacatttgccagattagtgattgaacatttcatatattattttctgagcatttggcatattagtttctgacttgtccttatgatgtaggagcatctgaatttagaatctgaacttcgacaagcatctaaatattgttcaatgttttaatttgctgtgagctaattaaagttatgaatttctcatagctcaagtaccggaagtttagaaattctccacacaatgtaaggtttgtgtgggtttagtgtctgaccttagccattgcaatatgtgtaaacaatatactcctattatcatttaaggttgaacatggaatgtactccctccgtttcataatgta

SEQ ID NO: 9738 - DNA, 20149 bp, Oryza sativa
ccttgcacgggcattattactagtaataggtaaagatataccaagtgcgaactgccaatactttttgctacgagaaaggagagggcataggtgtgttgtgttttcggtatattggtgggattgaattagcaccgccgctgggaaagaaccagggtatgatggagtaatgaatgcctgactctagctagtgacaagggtttacatgaaaacatctataaacttgaaaactattgcaaaaaatactcaaaagcttttaaaacgcacacatataagtgagaatttagataaccatataaaattgtaagaccaaactaaacttcgttttggagtcatgaaattaagtaattaacaaatggctaaaaacattgatcttcagtttttattttttcttacctattttgttaatattgtatctaataaatgaagtcaattttaattaatcttgtaattttgtaggtttactaataacactttgcagtgttcaaaatacataatctatatattagcgatatagaaatgttcagttttgagcttagaacatatccccctgatgagaaatctgcacaaagaagtgtaagaaacgtcaggaacacatgttgtatctgacatgaaagagcaacaaacaaaataataagaaaattatgtgattaactgctatatatcctcctggttatgcatgcttttagttctgttgcaaagagtgacgttgaacccccaccaaagaacaatctttccaatttccacaaatgacagcagcatttgcacttagacaatccaaccaaaccactcaaactcattctcaagcaatgcaactaaataaatgaaaatttaaaataccatattattttgccatggtttattaaatataaattagaaaaattctaaatcgttacgagtcattcatgttaaaatacattttcaatcatgtgctataaattaaataacatgatatggttagaggtaatggctagcacagcatgtgtatatatcagaagcccatgtatcagatgctaaaatgccatggcacatttaacaatgtcctcgataagcaaaatatgacttatagagaaaaccgtaattttggctcaaactgaagatcaagacagagagaacaataattttgctcaatctgaagaccaataactgcactgaaaggaaattctaccattataagtacgagaatcagtccaccatttgggtaattttgtttggcaaaatttgctacaggacacgtaaaaaacatgtaattagctgggattagctgggagacaccgcgaaaacgtgatatggctgatggacactacaaaaattgtgtaattggttttaggacactggtcgtattattttattatttctgggtcaaaagagatgagatattttcctaaatacccggattgccacttctctttcttcgttttctccttcgccgggaacgcgcgcggtgagggtgaggtcggcgaggtcggcgcgagcggggcggtggggtgagctaattacatattttttgtgtgtcttgtagcaaattttgccattttgttttactaattacattatgaggcaagtactaattgcaagcatattctcattttacccactattatcttgtaaaaagtcgaaaactgaaggcattcctaggcccctgacaagtcttgtaaatcaaatatgttaaagataaaatagcatgtttatcttctttctgcttttgccgatctcctatccaatcttcccgattctgttatacatcggttgagagattctggtatggatgtagctatatatgtacacatgttccgtgattaatcgatatcgcgttgagctatccctgctttcatggtatcagatactcccgatccaatcgcttccgctaaaccctaaaacctcatcgccgacggctctctctcctgccggcgcccatgtagtccgtcgacgacacggctcttaccgcggcggtcgcctccatcaccgacgccgccacctctgccatccggcaggtccttcggcccgacgactcggcctcacctgacgaccgtgccgccgccacggctctcatcgacgcgacttcggccgcgactgccaaggccgtccaagcggtgatttctgctctcgtcatcacgcctatcaacgacacggtggccacagcgtcaagttctaccttcccgacaacggtcaccgttgacgccgcggctcttcgcgccaccctcggacttcctccagccagcgcgaccacgcaaccgcccatcggcctcggctcttcttcaccggccgaccacgctagcctgttcgctgcactcagccttcaaccaccacagcacgaacgagaacgctaattagcgttcagtcgcgcgccccctcccccgcgcgactggacgcgtgtcgcgcgcggggaggagggtggaggacggcgcgtggaaattttttttttctggtggacggtttctttttttcttttttctgtttttttctttcctttttttggttttttctgtttttttcttttcgtatctttttcagttattttcgttttatacgtatacagactttgtatacgtctatacaaactttgtatacgtctatacaaactttgtatacttctatacaaagtttgtatacgggtatatacaaactttgtatacgcgtatacaaagtttatatatgtgtattttttatttttatacatacatgtaaataaaaacccaaaacttttgtatatgcatatacaacgtttgtatacgcgtatacaaagtttatatatatgtgtgtatttttttatttttatacatacatgtatataaaaaccaaaaatacacgtatacaaagtttgtatacgtgtatataaattttgtatacatcatatataaactttgtatacgtgtatatatatatatatatatatatatatatatatatatatataaacaattataatagtactagtattacaagtagtagtaataatgtactagtggtagtagtattagtagtagtagtagtattgtagcagtagttgttgtactaatggactaaggcaggcaggactgaccgcacgggtgcaggcccgcgcggttggtcgccgatcagccacaccctagcacgaacagcccgccggctccatgtccgggggcgctctgccaacctctgacactgtcgatgcccttcatgcccaggcggtgtctgttctcaatgtcaaggtgcttgtccccgtcgtcctcgaccttggcgccgcaaattaccaaatatgccctcaccgaccacgtcctctctgacgacgcttttcctcatcatgcgtcctgggctcggacggattgtgtcgtgctctcgtggctctatgggaccatcgccaccgacctcctggagaccatcattcagcctgatggtaacgcacgcctcgtctgtctctccctcgagcagatgttcctcggccactaggaacagcgcgccatcaacctcacggctgaatttcacacgttcgtccaaggtgacctcggcgtgaacgactactgttgacgtctcaaggctatggctgacactcgcggtgagctcggcgaccccgtcaccgaccagcaacttgtccttgcaatgatcggtggtttaaaccctaaatatgaaattctccaaactattattcctctgcagtgtcccttcccgatgttcgtcgaagcccggatcgagtaagctaattctcaccgagatcaacaagggcccctccaaccgctccaccaactcctccaccgccctcatgaattgcacgccacggggttcgggaacctaaatcaaggcggcggcaacacacaaggtggcggcggcaacaacaaaaatcgctgtcgacgcaacgggaacgggggcggcaccgccggcggcaatggcggcgccgctcagggcacatgtggccaaagcgtagggcaggctgcccctcagcctcgcgctggacaggcctggcccactcctcagcacccctgggtcggcacgattcaaatgtggctgggcggcccgatgctgcgtgctccagggattttgggccctcggcccacttctccttttgcgggcgtggcaatgtccggtgggcaagctgccctcccgcagccggtctcccaggccggcccttaccttccagccggcctcactcagcagcaacaacaactgcagccatcggcccaaccaacgtcctggtacggagcctccagcccaacacttgcttgggaccaacagactttggcaagtctgtttcaaaccgacaccctcacgacgcctgcctccaacggctggtacatggacaccggtgccacctcacacatgacatcggacaccggtatcctatcctctcacccaacctacctacgccactctgtcccacattatcgtcggcaacagttctcttttgcccatcattgctactagcagtctggcaatgcttcatttcttcacgctaatagaatgtttgttctcaataacagtcttgtttcacctaacattatcaaaaacctaatctctgtttgtcggtttgtcactgacaacaatctctccattgagtttgacaagtttggtttcactatgaaggatctacttaccaggaccgtgatcgccaggtgcaatagcttcggtgacttgtactcctttctggcgaacttcttcacctccattgccagttccttcgctgccactaccaccacactctggcatcgccggcttggacacattggtcacgacgccctcacccgttttgctcactccttggtcatctctcctcccaaatgcggctcctccaccgtatgccatgcgtgtcagctcggtcgccacatacgcctatcttttgctacttctttgtctagggctaaggccaattttgagttaattcattgtgatttgtggacctctccagttctcagtgtgtctggttttaaatactaccttgtcattcttgatgattgctctcattatgtttggacatttcctcttcgtttgaaatccgacacattcaccactctttcgcattttttttgcctatgtcaggacacagtttgctacacccattcgcaacatccaatgcgacaatggtcacgagtttgataactccgccgctcgatctttcttcctcaccaacggcgtcgccatgcgcatttcctgcccacacacctcgccccaaaagggtaaagctgagcgtactcatcgttctcttaataacattgtacgctcgcttctatttcaggctcacctccccggctcattatgggttgagtctcacccaaccaaaactttagcccaacacactccctacttcgcccttcacggtgtccacccctcatacacacatctttgcgtctttggttgtcgttaccccaacctatccgccaccgcaccccacaaactctcgccacattccaccaagtgtgtgttcttggataccctagcgaacgtaagagataccggtgtttcgatccgatcaccaacatggttattatctctcggcatgtggtgtttgatgaggatacatatccctttgccgaaatgactggtgacactgcttgtgctactgatcttgctttcctggaggattttacttctcctatacaggctccaattggctccaatcgctcggggaaggctgcctccacttctcttgggcccaccggcgcatgcatcgatcggccgacccctccctgcttgccgggctgggctgggcgcctctctcctgggccggcacctgcggcctcatctccgacggcccatggggtctctactttagggccagcttctccggctcggtctgcccacgatgatgccatcttggcccatgacggcgctcctcatgtccacgacggcgcttcctccctggctcatgacggcgcaccttccccagctcatgacggcgcgtccagtacgcgcttgctgcgtgccccgcttctctagccgtcgccactcgcggtaccgacgtgcgccagaagcgcccgcgccctagttacatggccaccggttacaggcttcggcatctctcccatcgacaacaaccacgccatggtgacaaggggcaaggctggcgtccgggttgccacttcacgcctgaacctccatgccgccactctctccctgatacctcgcacctaccatgctgcgctcgccgacaccaactggcgtgatgccatgcaagaggagtactcggcaccgatgtcaaattgcacttgggaccttgtgcctcttccaccgggcacaaacatcgccaccggcaagtggatctttcgtcacaagttcctcgccgatgggagtttggaccgctacaaggcgcggtgggtcctctgctgcttctctcagtgccccggcatcgtcttcgacgagacctttagccccatcatcaagccagctacagtctgcacagtgcttagcttggcagtctctcgtaactggcctatccatcagctcgatgtgaagaatgcttttctccatggcaccctcgcagagacagtgttatgcatgcagccatctgggtttgttgatcctgctcagcccaactctgtttgtcgcctgaacaagtctttgtatgggcttaagcaagctccttgcgcctggtacagtcggttcgccacttttctccgctccgttgggtttgttgaagccaaggcatatacttctctatttatttgtcgacgtggaggtgatgtggcctacctcttattatatgttgatgacattgttctcactgcttcgtcgacatcgctgcttcactggacaatctcttctcttcagtctgagttcagtatgaaggaccttggtgagctccatcactttctcggtgtttcagtctctcgccattccttcggcttgtttctcactcaacggcagtatggcttggagatattggagcgtgtaggtatgttcgactgcaaaccgtgtagcaactcggcctggtattcagtatgctgttcagcagatttgcctccacatgcatgatcctcgagagtctcatctcatagctctcaagcggattcttcgctatgttcgaggcaccctggatcttggtctccacattcgtcactcagcctcacatgatttggttgtctactctgacaccgactgggccagttgtcctgacactcgcaagttcacctcgggatatgctgtgtttttgggagataatcttgtttcttggtcctccaagcaccagactatggtttcctgttcgagtgcagaggctgagtatagagttgttgccaacgctgttgccgagacatgttggttgcgccagcttctccatgagcttcatgctcctccagtcaaggctactctggtctactgtgacaatgtcagcatagtttatctcttgactaacccggtgcaacgccagcgcacgaaacatgttgagattgatctacactttgttcgtgagaaggtcgccattggttccgttcgcgctcttaatgtgctcacacattatgctgacatcttcaccaagggtcttccaactccagtcttcacagagtttcggtccagcctaaacgtttgttcgaacgacgttcagtctgcgggggcgtgttagagataaaatagcatgtttatcttctttcggtaaccgcgcggttaccggccttaccgcggggtacggtaatagaaaaactgcagtaatctttttaaattcaaataaatttaaaaaataatttaaattttgataaattttacacggtttttcacggcgcggtaaccctggccctgacggtttgggaaaccctttttggcatgcatactggatgctcgaaatcggtggaaggctgcacaaaatttgtactgcccaaattagcagcgagcagagccaatgaaaatctgtaaatcccccacagtaataaaggaaatggaaatccccaaatcagctgcagcgagaggctctggcgccgtcctcgtcatctccacactactcgagtagtccatctgcacatgaacagcttggtggataggcagatcggacggtcgaacacaggtgatgaatgaacagtgtaacagttttactaatttgttgacaattagtaaaaatgtattcgattttcaacttttttgggttcaaatttcctgaaaacttggaatttcagtctaccgattctttttggactctgacatcttcatccttcctcagaagttagcaacaggcatgggattgcaacagtaattagtatagcttccttcactgttcttcgataaaaaaaaagaaaaaaggaaaaaggagtcgaggacgagcagagagcacagcatcagttttatttcatgactacacaacgaccggtctctggtttgcctaaagcagcgatcactccatcctagatttaaatcttattttagcttaaaaagtactatagtgcatgtttttttacctctttaatcacttgtatcttttaaatcatatattatttttaagatctatttgtatcattgtactccacttaaaatatgtgataaaacgagatccagattgaatatattaaaatattttattaatttaaaagtaatttatttaaattgtaaaagtaacttagctatgtaatagaagtaactctatatagaagtaattacattatgagtgagttccaataagaaactatgtggagtaaattcaaaagtgtagagaagattttcatgtaaatacatttatgaaagtaaatttaataaagcctgaaagtaatttacaaaaatcataaaagtaacttagtataaaatgaaagtaagttgttatgatattagaagtaaattcgtcgtaggaataaaaatataagtctatttagaaattaaatttaatcaacacaaattatgaaactgagtaaaaacaataataataaaagtaatcaactcaaagcattatgaaattatgagaagtaatttaatcaaatctaaaagtaatttgtatataagataaaagtaacttacatatattataaaagtaatttataacataaatgttttttttatcataatattatcatgtaagatcttgttataaagatttaattgcaacgaacacaatggtgtaatcggattatagatcggataagtaatttaagtgaaaattttataagaagaaaaaatatgcacaacctaatagaaaaactgcttacatgcatgtctgtaatgctactaatacttctcacgtaattgtccacgtcgctcgttaagtctaaatcgagatgcctctcgaaatagattttgcgtttattaagatactccctctgtttcacaatgtatgtcattctacatcaatatgaatgtgggaaatactagaatgatttacattgtgaaacggatgaagtagtagcgagagatgcatcaagcatcaatcatggaaggttgagtagctacgatcaggtgtttgtaggaaatactaatatcgtctcaattggctagccacagaacatagccctgcggcatgtagtggcagatggcgtcgccacggcttgccttgaggagctcgaagtaggcactgtcccaggtggtggtgttgacgtggcacacgtcgacggcagtggcgccgcccaggcccacgccggcgacggcgtggaggtcgaccctcagcgccaccgcgtcggctggccggtggcagtagtacacctcgtatggatatggcatagggtggcacgccaccacggcgtcgccgccgatccgggcgacgccgtcggccgctaccacgtacctgcggggctccctcccgtgcacgagcgtggtgaccgcgcgcggcgcgctggtgcccagcgccgaggcggcgaagtcgagcaccgcctcgcgggaggtggcgtggctcctcgccgccggcggccgtcagttcgccgcaggtgcggagggtgtcggcgacctgcgccgccttgtcggatccagggaggatgccgaacatggcgaggatggcgtccatggcgcggaggttggacggcacggcgtcggccttgtccttgtagatgatgaaccttggcgccgctgcagccacgccgtggtcgtcgtgcgccagcgtcagcttcgtgccttccggcaagacacagcatcccggccgcctttgtgtttttggcattctctaacttgaggatgccagccaaggctaatttcagctggctgcatatatatgcaaggggcggtcaagttacagaatgccaaaaaacacaaaaacgacaatgcaactcagccattgatttgtgtgatccttcaatttgcagtgatgatccaaaactaattctaatctgcttagtaactaattaatactagtctgtatgactgtatatgctgcccttttatagcataggagccatgaaaagcatgtgtcatctcggcaaagagaggtgcaaagtttgtgagtttcctactctctctgcatatgcatatgcactaatccctttgtttttgccctgataacctatacatctcattattgttcctttttttttcaggggaaagggataattactcattagcctcctcacagataaactgcgagataaaagtacacttattgtccggccaaaactgtgtgatcttgtcacaacggcccttatttgctaaatagtgactaatattattttgacttctaagacacttactgaagctaatatccctatttcccaccaagagagaatctatctccctgattaaaaacgccagctccgatttagcacctgttgcatcgcggaaaagatggatcatcgccaagcagtctgtctcaatcactattggcagcagggtccattgtagggcgagggcaagactatccctgcaggcaaggagttccgtttccaaagcactgctacagcgatcaacatgtccacaagcagcaaaaataacctctcctgtgcagttgcgcaacacagcgcctataccacccttgccgtcactctcctggaatgagccatcaacattcagcttcatgcttcctaggagcggcttcgaccatttgtcaggaacaggttcttgactccgtttgatgttgtgcgacttctttagaaccacatccacaacatgtttccccttctcaggacttgcttgggggtgttgcttgatctcagcaagggagaggacatagctttcaatgaaacgtttggacactagtattcctggggctggtttgccatgcactatttcattccgtgtgtgccagattcgccacagtaccattaaaagcataacctgttcctccggctgcgactgctccaataggtccaagatcactttcggatctccattgcgaatgttgctgagagggttaagcttcatatcaacagtcatcgcttcccagaattgccgggcatgtgggcagcgaaacaaagcgtgaacaacatattctgactccaccccacaaatggtgcagatgtctgaaacttcaagcttcctcttcttcttattttccaatgttggaaggctgttagtaatagctcgccaggcaaaaatcttcaccttttggggcgcattgcatttccaaagggcattccaggctctgctatttccattcccggacgaactcgagccttcatcaacctgtgccagagctattgccagatgataagcacttctgacagaaaatctccccagtctatccggatgccaagcaatgaagtcatcctccagccttgaagataaacgaatgtttaggatggcctctgcgtccatgggcaggaaatgctgcgagattttgtcagtatcccaggactcggactgatcaatcaggtctgaaacccatctcagtctgcaatttcttttagctgagatgggtcttcttgaaaagctccgcggaatccagggatccctccacaatctgactgatttaccgttgccaatgcgccatatgatgcccttcttcagtaattctaaaccatattcgatcgctctccagcctggagaggcattacctccaaaacttgtatcaatgagagaaccgttcgggtagtatttggccttcaaaattctagcacagagactgtctggtctgtccaacaatctccaggcttgtctagctagaagtgcctgattaaacagcctgaaatccctaaaccccatacctcccttcaacttccgagcaatcaaacagtcccaggatttccagtgcgttctcctcttccctttctctgctccccaccagaaattacgaaccagttttgtcaattcctcgtagaccgactccgggagcttgaagagtcccataacataaacaggcatggcctgtaggaccgctttaatcaaaatctccttccccccagttgacagaagtttctccccccacagcataattctcttccataatctctcctggaggctttggaattttcctttggtcattctaccctcaggcatcggaaagcccaaatatttatcttcaaaggagttacttatctgcagggtctgctttatctgattttggacagcagtaggagagctttgcccgaacatgatggagcatttgcaaggatttatcaattgcccagtgcaggaagcataagtttcgagaacttctttcatcactaccgcctgatcatttgccgctttaaagaacaacagcgtgtcatccgcaaacagtaaatgcgacacagcaggagcacgccggcatatctgaattgggttcatagctccctgatccactttctcttctagtaacaaggacagtccatcagccacaaaaaggaataggaagggcgaaagaggatcaccctgacgcagacctcgtgatggagcaaaggtgttcaacagggttccattaagtttaactgcatatctcaccgaggttatacatgccataatccatttaacccaacagtgagcgaaacccagtttaaccattgcttactccaaaaatttccagtctacacggtcatacgctttggacaagtccaacttgtatgcgcagtaagcattctcaggatttttattcctctgtatatggtggaagcattcgaatgctatcagggcattatctgttatcaatctaccagggacaaaggcactctggttctgtgacaccagatcatccaggattggtcttagtctgttcaccaaacacttagacactattttatagaccacattgcacaaactgataggtctgaaatcctttagttcctatggttgctcagttttcagtatcagaacaatggcagtctcattgacccccgaaggcatggtacccgaagagaaaaattcttgtacagctcgcacaatgtcgtcctttagtatagcccaattcctctgatagaaccgaccggggaatccatctggcccgggagcttttaacggaccaatttggaacagggcatttgcaatttcctcttcactaaaggttttgcatagtttctcattcatcgcatctgtgactttcggcttcatcaggctagtgactcacgaatgatcaatactggggtcggcagtgaacagcctttggaaatactcagttgccatacgttccaactcttttgtcgtactgtgaacagtaccgtcactatcccgtagctttgtaatcttattcttcttagctctccacactgctttgctgtgaaagaaacgtgtatttctatcaccttctttcagccaagcaattcgagatcgttgcagccatatcatctcctcacggtacagaagttcattcatttgatcggacacccgtcttatttccctattgtcggcattacttagaagaagttcagatagtttctttctatttttctcaatctcccggctgacattcctgaactttttcttactccatgtgcgaagatcagacatcatcctaaacagagcttgattaatgtcgcgcagatcctgcttaactccggaaacgccccaagattctgctataacttcagagattgcagggtctctttcccagtaaatttcataatggacacacttcacaggattcctgtgaaggtcttcagaagaaaatttgacaaggatggggcaatggtctgatctaggagaggacagatgaaacacctgtgctgtagagaacagtcccctccacccatcatctgcaagggcgtagtctaagcgcactttaacattgctgcggccctctcttctattattataagtggatgggcccccccgaaacccccaaatcatggagaacactttcttggacaccttccttaagggttggatttggcagctaatttggtggtttcaaaaagaagggctaaacctgccaaagagtttcattaaaatcacccacccctacccacgggggatccgaaccttgtttacctgaattaaccaacgcccacctccgaggtctattttcccctctaggttccccgtccacaaaagtagcatgccagacaggaccattcacagataaacgaacatacgcgtcaatatatctctcattcatacttataatttccacatgacagactcatgccagaataaagccagacccccactcatcccatcactgttaaccccagcaaaacccttcaaacccaatctattccgcagcctacgaaccttctcaatcttttgcctagtctcacttaaaaacacaatatgggaacctgcctccttcactaaggcacaaaggtcacgaactgtcgccgcgttccctataccgcgacagttccaagccaagcaactcattgctcctgacgggacccaatcacaggtcccgtcagtttaccagcggccccatggctggttgcctccatatcgtctgtgtcctcaccctctgcagccttcttgagtctcttcactgctctagctgccttgccgatatccccatgcatggaattgctgccacctgtgtattgttggtattccaacaatgcttgctgaaccctcccttttatctggagtcctgactggtctggcatcctcttcctattggcatcgctgatctcctcggatgacacttccccaaacgaggcttgctgttgaaggttcctcatggctggtatcatctcagaagcagaaatttcatcaccatcagtcttcttgggtgcttccttctcctattgttgctgggctagcttcccagcagggacaaccatcgatgtttcctgagttttgtcccccgtaacatccatcttcccagcctgttgagctaacatctcatcaattgcagtgtccccttccctttccttaaactcaaacccatcatgggcatcaactctgggcggtattgcttcctgcatctgaccatcttgtttgtgtctggaggacgatgaactagcacttcctgcccctctgaagaacaagttacgtgcaacacttgatgtttgggcagctttcactttactgatcttcttctcaaaaggtttaagggggggagcatcgtagctcagctgagaattggaaaggttgatcctcattggcagatcttctattgcaatctctgtcggaatgaccaataaaaccacagataaagcaaaagtgcggtacccgctcataacgtaaatcgaacctgcgaaggacctccttgccttggacagtcatccttatagctatctgtgatttcagaggacgcttgacagggagatcaacacgaataatgcggaagaagtcatgtttgttgcgtccatcatccctcacgtctacctcacgaactttgccgagtttgctcccaaacatcccacctcttacctttgtcatcaacaccagagggaggtcatatatgcgcacccagatcggaacaacatccaaaggaacattcgatgggcacgtaatgccatcaaaactcgctaccaggagtgcatctcctctgtgaatccaaggaccccctttaatgacaaaatcagtctccctctaccgagaaggttatgatgaacatgttgtcacgtagtgatttgtagctcatatctgctctcaacctccaagctctgcgcatgtcgtcaaacagggccacttggttcggagttctcagagaatagaacctcgccaagatcgtccacaggccagcagtctgcagttcatcatcctcaatattcaccgcaaccacatcctcctcatcctccaccagatctccttcagtgaacactgcaggacactgtgttgcatcaacttggttgttctctgcagatcccctcctcgcagccgttgtgtgttcctggccctgatcagatgtgcccgctgctccctcgatcatcttcagaggaatcctgtcgagaatcaccgcgtccgtctcattaccgctcatcagcttcgggtgggaaatcgtcccaatgacgatccctttatcacccccaccgacattggccgccatgagacttccgctagatccaacaaacaaagagacggggttgacaacgcctagccctatcgccggaaaaactttgaaccgcaccttcggccaccactgtgacttgtatttatactgcaatgccacagaattaggtctccaatacaactcgaacttcggataccaaaacagattcaatctcctcccccttctagaatttcgcaagggccacagatcccctggaacaatacggaaagcagagaacgaacctttcccatagatcaatccgcctaaagggaaagccttcaacttatctcctatacgagtatgatcaggccaccctaccagatcacgtttcaacacagggaggaaatcccccccagaacaacccacggcgggtaaaacccccggagacatcaggagcagatcagaggagatctccatccagacccatctcgccacgcgcgagagctctgccgccgcccggtcgcccgggtggcgcataaaccctaaccctaacatctcattattgttccttaacattactaacgctgatatatactgtaaaaaaacttcagcatgtacaaattgatgaaaaatgttcattcattttgaaaataatttacatgagctcttcctactattcttctgctatatattggctatttagttcaaccgcttctggatagataaacctgtgactcgggggtggagctagtgttatagcaatggtgtcacatgacaccaatggtctttgctataattttgacaatctaacgcttttagaaaacatatttgaaaagagaactatatcaaaaacttatttcaaaaataagccgtcacctcagtccaatggctctgtgccagcaatcatggcgctaaccctatatatctgttaagtgagagtatatgttcctatcgtacataaaccatcttgtaccgaagtggtgttggtcatccgtttttttaaaaccacaagtagacacgtggtttgatcacccggttcccatgttttttttgtaaatttttgcgctatttcccgtgagcgatgatcataaaggcaaaaaatacgtcgagggggagattcgaacctgggacttcgtgacatctcactaagcaagtgaaccactacaacacatgcaatgaaatgctcaaatttagcacacgctgtgtgcgcggatggcggagtttcggaaggttgccgatggcggtgcagatctggccgtggctgctgtgcacgaggaaggagggaggagtcggcggcgttaggatggaggtcgccatggtcatggcacttcgacggttggccatggcgggggcaactcacggtgtcactgccggtgtggcggtgtcccctgttcggatcgtggccgatgcatatggtgcaagagatgctgtcgcgacatgacgaggcgacatccctcacagttggcagcatgtagggaattttctgggcgttggtgttggctcatgctccactggtggataggcctccccctgctatctacagtaaaaaaaactttcactaattgaataatcaaaatttcaatatttggtccaagatatagcgaaatacccatgtatcaacttatggcatatccactcgtggatctatgaggctatggaatggtgtatataagggatcctttgtgcgataacgcatgaagcgaacgcaacctagttcaatctatatgtgattattgaattatttccattgttttgtctgtcttatttcggttttatcgtttaaattggcagagttcttatcaatcatgaaaattatctttatctgttgaacgcacaaatatttttgctagtccttaaaaaggtacaagggtatcatattttctattgcctttgtacttccagatactaagtatctcaaaaaaaatatatcttgatgtaccaaaatttgtttttagtgtattccaagtttccgcatcctaaagcaaaaccatacattatacatggaactccagaaccaccactaaagtatataaaaaaagtcgcatatatatatatatatatatatatatatatatatatatatatatatatatatatatatatatgtgcaacctctttaaaccaccatgtatagagcaaaactgaaatttactaggggtcattgtacaaaagcactaacaggtgtcattgtggaacaaataataataacatgaaagaacattgcaagaggattcaccattattatgatatttccttcctcacagggaatatgggaggccatatcatcataaagggcatgattgaaaacaagatttcatccttttctgtcacctcgtaaaccttgtgaagttgcctactcttaacatccaagtagagtgcacattcatctgttttcaagaacaaaaactcagcatcgtcccctacataatccatgtaaacaacacgactatccccgcccacacaatttatgtgcaaattagcgcacatcgaccgcaaacaaatggtatcaaccagagtccatccagtgctgccatgcttaagtagccaaatacgaagctgaggctccttcagatcggcgatataaaccccagaatcatcgctcgctcgtccgaacaaaacgtcgtggcttcgatcattataccacatcatcacaggtgggaactccaccccatctggaagctggatggtgtacaagctcgaggacttcaagtccaacacaagaacgctgctcgaagtggctgccaagtaggccttgtctcggaccacgacgaacccagctgattccggtggcaagccaggtagctgtgccgtcgccttggtatggacatgccatccgccgtcccggaatgcgtagaaccacgcggaagtagctccccttggggtgaacatcaccgataaccggtatagctggctgccgccatcctctccgaagtggaacccccacacattctcgtcgtcgaagccgagatcaggctcgacgtcatcgtcatcgtcatgtgttgaagagaacgggatggcgagtaggcctctctcaggatgctgcagcggtctgtgcaccgcgtatttgagctcgcgccgatcatgcctctccttgaagaggaggatgctaccgttcctgcactggtagatactggtcgtgtaaccctcgtaagcgaggctgaagttgccaccgcgaaggacgacggggtcgagctccggtggccgtgcaggcggcggcatcgggacgaagagcgggtgagcccgcggtatcttgaggctcgtgacgtagaagcccaggaggcggggcgggtggagctcgcggaatcgccggaggaaggaggggtcggaggcgacgcggagccagcgtctgcaggcgagcgcggcgcggacgagggtggtggggaaggcgaggcggagcaggatctcgccgacgaggtcatcgttctcgagtacggcggacacggcgggtgacgccgccggtggcggtggcgacagccgatcgccgtccacctcgatggcttgattcgtctgcgtcatggccacgtcgaattgaattgaattggcgatggtggggatgatggagagataaaacagcacgatgtgatcgatcgatggagggataagttaattaatccgagattgtacaactatatatatatccatatgggactccatagtgcccgggctccaagatataaaacacataaattctctcaaatttttaaaaatttacaaattgtaagtagatatctaggtatatgaatttgattcatacaaatacctaacaacaaaacaactcaaactcaactttatttcacaattcattattacatacctaacgaattatatgtttggatgttatataactagaatcaaaatctaacaaaaaaaattcagtttgaaagaagttaattgatcatatctaaacatttaaaaaaaattcatactcattcaaattgggtagatactcaatttgaattttgaaacccatactccatgtagcaccagttaatttacctatatatatatatatatata

SEQ ID NO: 9739 - DNA, 8040 bp, Oryza sativa
tatatatatatatatatatatatatatatatatatatatatatatacataaaacccaatgtgaatttgagtccttttctttcttgaaacgaaagtttgagaatcgtacgtgttaatcatacagatcaccgcagattaaagtaaaagcgcgagcgaggtggcaatgcaacagatcgatcgtagagatcaccgctataattctaaaccccaagtcccaatcgatttcttcttttatttttgcgaggaaaagtccaatccttttaaatcgtgtttcccttgttgtgtgtatttttccatttcttttcttttcttgaaagttgaaacaactctatttctttttccactgttttagttggttttcacccgggtttacattaccgctagtaaccacggtaaccggtcttgccgcggggtacgatatagaaaaactgcggtaacctccttaaattcaaataaatttaaaaaataatttaaattttcgataaattttgcacggtttttcgcggttaccgcggttaccgtgcttaccgccggggcgcggtaaccccgagcccgacggtttgggaaaccctggttttcacagttcactctaccatggacgtccgactgtgttactttatcttaactaattaaaagattcgtaattttcctttcttcacctaattttcgtccgtatgcacgaccgcgtcgctcccatcccatacgcgcaaatgcgcaaatctgcaattttccgttggtcaccccaacttttcatccgccatgtccgatgtagcgacagcctctgtccgttacagcttacaaagcacaaaaggatcaatcaaaatcccaatcggacaatcattagttattccaaacataagatcgacgctacaaaaattataaaggtggaagcacaaacacacaaacaaatcccaaccccccgcccccacccccacacacacacagaaaaaacaatttttgccttaacttgcagcagctcgtaatgtggcaaaatccagttgcggccgaatcaaatctagctgccgaggcaaagacatcactgatgtatcctctttctagccatctcgccattgatggaggaacaaaagcaatggtgctcaagtgaaagtgggaggaaaggaagaaaaaaaaaatcaatggatctaacccccgcgcctcctcctctgtggagacatcatgccatcctcgccgtcctccttgccaccgtggtcctcgatgatcgagtaaatcttgaggcggtggtgagatggtggtagtatctagcggcggcggcgacaagatggtggtggtgtctagcagcgggggaaacggtgtggggctcccctactctcaactcatcttctttccagtcgtcgccgccatcgtcatcgtccaccgcccgctcccgcgcccatgttagccatgacgtcgtccgttcaccgtcagccgccttgtccgctgtgttgtcgtcgtcgttcaccattagccagttcgtctgcccacgctcgcctgtgccatcgtcggtccgccgcctgcgctcgcgtgcgtccaccacctgcgctccgggcccaaccacggtgctcctccccgagcacactcgccaagctgtggcggaggaggacgacgatgccggcgggtggatgtacgacaaagcggctgacatgggcgcgtgcgggcggttgttgatgacgatggcagcgacagaccgacgacggcgcggctaacgcgggcgccggcgcaggcagtggcggactgacaacggcggtgccgggcggacggccgacgacgacgttactgactccaagagacggagtggcacgaaatgaaaaaaattcgtgctctaatggtatattctgaaagtagaccgaattgagtggcatatcctgaaagcagtgtgtattcgatagcatattctgaaaattcttgcagtagagggagggggagaggtggagacggaggtgcaagaggataaggagaactggagaagtgcgatatatttttttcctcatctcgtgctccactcagctccacatggccacgccacctgacgtcggttcggtgccgtttttctataaaaaccgtaaaaaccagatcttatatcccatatatctatataacggttaaaaaaaatctaaaaattcgtaatttccattcgtcacctctctttttcgtccgtaagtccaagagtccctacctagtcctcccccattcaagcaaaactgaacaaaaattgggagggcggataaaagttcaatacgaaagacagatgcatattcgatctggactaaaaaacagatgaaattaaccccataattacaaaaagatttcatggatctaacctggtggcggccctcactggtgaggctcttgggtgtcggggtgttgagggagctaggtaatcgataaagacaccgggaggtgattcccagcaacggcggctctcactggcggcgatgtcgaggaagcaggcggcggtggcaactttgtgaggcggccgccaaaactcagtcgcctccgcgacctcaagcctccccggctggcagatccgccacccacaaatttggtcgctgcccacgcgccttggccattgcagctgccatggggccatcgccgagagacaacgggatccaggcgccggtggcggatccacgcgagtatgaatgacgccttggagccggtggtcgatatggtctgcgacaactcgggtggaggagggagagacgcagagaaagactggatcgccgccgtccactttctcgtgtcgccggagattggatcggggagagtaggggagaaaggcgattagggttagggttttcggaccctcccctccaaccggcgatttcattggcacgggaccaatccgagccgtccatcagatcggacgggtcagatcggccccgcgtcggccgccaccgctatcgggccatgcggtccttgggccatggaagagaactgggtcgtgcgcccttcgccgcgctcagttcgccctgcgtcaggccatcgccagtaggatggcccgcttgctgtgcaattggctcgtgtgcttgcgctgaacgggccggtccaattttttgggctggttatgaaagtaatagaccaaaataagattttatttaattctgtcgatttaatttatttagtcttttatagaaattttctttggtattatttggagccattttaaaattgctgaaaaattatgaacgattacttgatcactcttattgtcatactagaccgcttaaaagatggctcagttaaactttatccaacacgacattacccggtgcaacgcatgggcattttggtagtatatactgaactagcaatgcaaatggcccatagtaacaacagggttaagaaattagatgcagctgtacctaagcagaaattgatgttgcaaactacttcctccgtttcacgttataaaactttctagtattgcccatattcatatagatgttaatgaatctagacatatatattcattcttgcatccaaagggactaactaaacttttattgagaaactaggaagatactccctccgaccggatgggatttcatagtacagcgaatctggacaggaagcatgttcggattcgttatactataaagtgtcccattcgatactaggttgttatatcatatgacggagggaatagtaatttccatcactttgcacccatttaccaaacatgctacactaggacttaaaagtcaaattctagtcttactattaattaatttcccatcaaaactttctatcctcttcatcacaaaacatgctagacttaaaaatcaaattctaatcttaccattaattaatttcccatcaaaactatcagcagccgcactactatttcccttatataaactcgcagtattctctaaacttgccaaacaggcccacggctgtaaatttggatttcaatatatggcaggtgcgattatatttcattaattaaggaatcatactcttgtgttgctgtaggtggcaaataaaaggggcattaattctccacataagaagggcacgaattagatggtttccttctatatatatgattattacctctattggattagcctaaacaaatctgtactagtactgtaataaaaaaaatccccacataaatacaggagtgcagtacatatgaaccccttctgctatgaaaccctgtggaagacggctggccttggcacagcgcatagcagccggcgttgagaaggggagcgaccgatcgtactgatcgatttgttaggcttttaggcataacgaagaagctagcaggtaagtatatgcctgcagacttgtcatctctattttgattcttcacattggtcctcttgttcttttccttgtattcatccatgtacacccgattcgagaatctgttttcatttttcaaaacaaatagtccatattactttactcaacttttaattaaattttactagcgctatacccttactttgccaagggattagaaggaaaaattacgagggttgagttttaaccatctggttttactggtgggatgagttttgggtggaaaacatgtgttttttttttgtcgaggtgcgtttctttacaacgaattacgatgtagtaggaggagggcgacttacactttttagagcaggtataataaggttgagtcagcaggctatacgttgttacacatcagcgaaatcctatgtggttgagggagaaaagaagaaagagaaaaaacggacgctagatctgttgccgggcgatagtgtgagaaacgaggctcttaccgctcgcttgtagctgatacgggtgatacctgacatatttggtgggcctgacatatctccactatccaatgtgcatgtatttatgtttttctccctatctaacacgctagagcacaggcaacacaaatagctacagggatggtggttagttttgatcatgccaattaatttggttgtgcatgcatgaattaaatgttttgtttatctccatttagctagcgaagcagctagctcatcgcgtgagctttctctcttgacggctatatcagacatggcgactgcctgcgcgactcacgcagccgctgccccccacccctagcacgagagcaagtgaacattagttgaagagatttagctgttgccactgagatggaggaaaatagatgataaggggaagaaagaaaccgttactaacatgcggggattatgataatgctataagcgttacatacgtgaaatccacactaatttgaacttaactaatatttttattgttttctttaaaataagaggattgctacagtccagcaggttgtaccgggcggtaaaacaaatctaaccgttgaatcgggatgggtaggatcgggagagaagatgagcgtcgggagagaaatttaaccggcgttcgagtcgtcgttcccggcggcggcggcggcgtcgaagtcgtcgttcccgacgggatagtccaggagacggcggtggttgatcctggcgatggcggagttgatgtccaggtggcggcggcgttgatggcatcgatccaggcggtggcgacccagatcgaagtcgcggtgtcagaggatgaagacggcggtggcagggcagaagcacggcagcggcgggggtgaggaagcacggcggcagcggggtggaagcacaacggtggcggggggtgtgaggcacggaagagggagacggcggcggggcggggcggcacggcccgatccatttgatctaggcttcccattgcgaagttacatttttgcccttccatctgagttttcaggtcggtattgtacaaggatagaattggtaccgagccgttggatctggccaggaatttggtaccacccggtaccggtaccgagcgctggacggtaaaaagactcttaaaataaactccaaatttactcaattttaaaataacctttaggcatgacattgataatgctacggttgtagagcatgtgaagaaaaccgatcttcagactgcaaataagtttctataagagctttttattgttcataattattataggatatttttttaaaaaaaatgttgataaactcgccacccaacatacggagtacaaacaagatgtgtttcataagattttgagaaaaccacataccgcacgtgtagcataggtaatttccgtctccctttatcacgtgagtgagtcgcgtcttctttccaactatcgatacgtcttctcaaaaaaaaaagaaaaaaaaagagggacatcactgagaaaaactacgccgacaccagaaaggctgtggcggcggcggctcatggctcctcttcggtcggtttggcaccgtcgcgctagcccctactggtaggctcgatacccttaccgcggcatttatgtgataggttctccgtgatcgccgccgacgccgacgccgacgctcgccggtgggctcgagatcgccaacttctcttctccctctctgccacggaatagccaagaatgaacagaatctgtccaactatagccagtctctgattaatttacagaaatttcgcatcgtttttgatttgtggctgacaccatcctattccccatgcgtgcagtattttgtttcatatatatattttttctttttgaggataggcaaggagtaatgcctaacatatattctcattttcagtctgtttgcactaattttgctatttttatatttagtccatgcttcaatgctgagaatggtgagatcggatacttttttaaaaaaatctccattgctaaattaaaaagttcggtacatcttttttttttacttcgaggaagtttagcacatattaaattacatacgtattacatatgcaatttatgtaatctaggtctcgattttgttttcttggagatctgtgatgtcatctttaccatgggtgacaatggaactccgtggtatcgtgcggattcatccggatgtttttcatgcatgttacatatggctttagcactcacagttatgtttgtttcctttaaattagttattctttctgtaatcctattaacgtccatggacagactgaaattatctttttgactttaacacttttatatttttcttcgtcataaataatcagttgtaactttctaaagtttgttgttctatgatcaggagttcatggatcagccacttttggaccgtgcagcttcttcctcgtctaaggccacaagcagtagatcagctttcacagatgctggattctttagtattatcactttttcttggatggggccgttacttgatcttggaaggaggaaagcactagatcttgatgatgtgccaactttggatgataatgacagtgttcaaggcatcctccctaactttgaggcgaagctcgtctcagtttctggttcagggaagtacaccgatgttacaacaattaacttggtcaaagctcttgttcttacaacctggaaattaatcctcttcactgcagtttgtgccttactccgtactgtctcttcatatgttggtccatacctgattgagtactttgttgactacctgaatcgaagtccacagtccgctaaagaaggctacattttggtgttgagttttgttgttgcgcagttcatcgaaggcctctcatcaaggcatttgctcttcagatcgcaacaacttggtgtgcgggtacgctcagctcttgtcgccgtcatttaccaaaagggcctctccctctcaaatcagtccagagaaagcagttcaagtggagagatcatcaatgccgtgagccttgacgccgagcgtgtcgcggatttcaattggtccatacatgagctttggctgtttcctgtgcagattattctagcaatgctgatcctatactccactcttggtttggcagcatttgcagcccttgctgccactgttttgacaatgttagcaaatctacctatagggaggatccagcaaaattaccaagagaaaatgatggatgccaaggatgctagaatgagggctatgtctgagatgctgcggaacatgcgcattctcaagcttcaaggatgggaaatggtcttgtcgaagat

SEQ ID NO: 9740 - DNA, 2339 bp, Oryza sativa
ggacaaaagcaaaggatgcaaattgcacgtgctttgtatcaagatgcagatatctttctgtttgatgatcccttcagtgcggttgatgctcatactgggttgcacttgttcaaggtatttttcagaacaaatctttaaatcctttttctatatgtgtgtaatcatcattgaatgcttaaactaataacttattgttggtacttgagacttctaatactacaaaatatatttttacatcatatgatttcaacgacattttctcccagtcaatttagggttttttttaaccttcagttgtcagtgctagtgctgtttgaatagaacatgttggttttgttggatttttcatttcccaacttccaaaatcagtaatagcagtttatctcactgcatagtttattgtgtggacataaacctaatgtcttaatcagatcttttgtatgtttcagctaaacagtttttaggtagcttgttcttgaacaatatttagggttcaagagtatatctactgtatgaaagttattcatcacgaccttgtatttttcaggagtgcttgcttggactcttagcttcaaaaactgtagtgtatgttacccaccatgtcgaatttttgccatcagccaatgctatcatggtgagcttccaacaactatcaaatctacttatttattctactcgcaacaatcgttttaccatgtcaattcatttccctgttctaggtcatgaaagatggacaaattatacaagttgggaattacgctaaaatacttaattctggagaagagttcacaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttctgtctattggaaatatattacaatggtatatggtggagcacttgtgccgcttattttgctcgctcagataatttttcaagttcttcaaattggaagcaatttttggatggcttgggctgctccaatatccaaagatgtgaatcctccggtcaatagcttgaaaatggtacttgtatatgttgtgttagcttttgtgagctcgttattcatcttcataagatcccatcttcttgtcatggctggatgcaagactgcaatgatgctatttgataagatgcatcgatgcatattccgagcttcaatgtctttctttgactccactcctagcggtcgaatcttgaacagagtaagtaatttaccttcaccatctttattttaatgagaaaattgaagttatctccttggaataccattagaatttttattcatattcaattaatcatgaaagttgaaacaaaattgtaggcttctagtgatcaaagcacagtggataccagcatttttgacctgatgggatatgttctatttcctgttatcgaacttcttggaacaattattttaatgtcacgggtagcatggccagtcttcgtaatttttgtcccaattattgcagcatctctgtggtatcaggtattctttttattatatattttatgttggatgccattttttggttccagtttataatttttaagtatgtggaaggaaaaatacattaattcatgacattattgacaatttttcacagattcaattgaaaattgaaaatcagtgtttttttcttttcacagatttaatttgaaatttaaaggcatggcaaagcaattaaatataatacataataaaaacatgaggtacatatatgatgtgattcttttcttggcaaaaatgttcccaataaaatttctaggttgatgctactgtatataggagaacttgtgcatttccgatgttcttctgaacaatcaaacttttagtcttaaaatatgctattaaccaataataattgtaatcatatttcaaaattataactatgtcctatggcattattggtttcaatacgactcatgttttgtttttatttttaatcaccataattccttcccttcagcaatattacatagatggtgctagggagttgcagaggttgactggagtttgcagagctccgctgatgcaacattttgctgaatcagtagctggatcaaatattattagatgctttggcaaggaaagacagtttatcaattatgtcagtcatttcatggataatttatctagaccaagtttatataattctgcttcaatggaatggttgtgctttcgcttggacat

SEQ ID NO: 9741 - DNA, 660 bp, Oryza sativa
ttgatgaaacaggttattttgaatggactgtgtgaagagcaccatatggaaaaaccgaggacggttttcagtgaagaaggggagaatgatgtgaacatggctactatggatacaaccattgctcacatcatggatcaacaagaagacatcaagatcaagtcctccataagctggaattcgattcggccacctgctacattgctgacttcaaacggccgccaaattttcatacgagctccgttttgggtctatgagtacttgatggaaagctctccaagtcctcttttcaacggatccagtcttgttcccagattccatctcagtcgacggcaatcgcagaaacaaggtgctgcgtcacctgtaatgggcctataggcttgtaacttcgcctgggaccccggcccaagtggggcccatgtggggtgcgccccaacctggtggagaacgaccctacggcaccattggtcatcctcccacatccttaaatagctaggtaccccttcagggtttctcgggttttgatgatagagatagctacttgctaccggctcgcagcgcgcgtgttggctaaaccgcccgtctgcctgtaatcggaaccccaccatattgtgttttgatagtgaaactttcatctttatctagcaatttcagtgcttgttc

SEQ ID NO: 9742 - DNA, 2324 bp, Oryza sativa
aaatgtagtctgacaacctgcgaatgatcaggctctgtggagcaagcccaaaagaggcttagcccagccagcccaaattgcatcagcctatcacttttataactattaagcagcttatttttgtgaaaacatgttcccatcctatgcaaagacaattgggctggtctaacccaattaagaaacactggtcaggctagtcaagagagcttaaataactttttcttttcttctgtttatatgtgatcatttactgcaggaatgagctatttcctgattagtaggctatcttcttgtttactttactatttctatctactcacagcaattaataacagcacataaagtatgctaaaaaccttaaagtttcagcttcatcataagttgatattagtaaatgctaacaataactaattaatacggttatccactcgcagcaaactgcaacaaaagaaaccccccaatttctcttattcagaaaaaaaaaaacaattttgttgcctggtggtcatcattgtatatatctaaacttcactacctaaaaaagactatggaaagtaaatgaattaccaatgaataaaaggtaattgacaacgatcatatcaccaacaaggattatatgaatggttaatagaatccaggagtgctgagatttttctcaaactgtataatggaaatataaatcagtacacttcaaatggtaagatgaactggtcaacgaccagtaagcacgcctaaaaataaacatgtacacaaattagcacttcacacaaatataacacgtcagtttttgtcataataaatgacacagatatgatagtaatttctattcatagtagtacaatgaatatgagagtaagaacacttgaacattaatgatgtagacagaaggaaacatggcaagatctcaagtagcaaataaatgctaactcatgtgcttaaaagagtaaactttatccacatctgtgagcttaactacttaagtcatacagtttgggatattgatccaactctaacagcaatgtctttcaactgggaagaaagagctattctacaaaattgggaaagggaagactgctatttatatcgaaccgtgtgtaagaatgaatgataccgaacaataatacaacaaggcggcagctatgccaaaatccgtgtgcctataccctgcatcaaggagatgatgggtctttaaaatggtgcatgtatgcaaaactgagacagagctcctgatcacgcttatcaccccagccaccccatcctttgaagccagcctgatacccctcctgcctcttgatgatatgtactggccagttagctttgatgttagggaccttatcgatggcatctaattgtactgtcgcgtcgccattatccacacagacattgctcaagccttggccttggtgcaggccacacttgccgaaatgtgcagcgctcctcctaggtcccctcaggctgtaaacaggagatccgaacgacggatacacggttgcccacatcgttatatcccaattgtactcgtcgaatgtgcagaactgcttagctttggcatgaatcttcctccaaactgtcctgttgaaggcatagccaatgttacccatcttctcggcaaccaagctctcccaaccttcccctttcgccttgacatccgatggcgccaagtttatagcatagcactggggacacttgctaggcttcaagtcgacaagcagctgcgcattgcggtacgcattggggaagatgtaatgatcctcctcgatgaagaggatgtggccatcgaagtccctggtctcatccagcccatcccacacggtgttcatcatccaccaccagtggtgcttgagcgagacgattctcggggagcgatggttgccgtactggtccgggtcgccctggcagtgcttctcggccgccttgtccttgccctggcagtcaccggaggagacgccggggaaggcctccgggaagaggtgcggcgagtagggcgcgaagatctgcttgacctggcagaaggtgatggtctgcacgatcttgtccatctccgggaagtagccgtcgtggctgacgatgagcagcgcctccccgatgccgtgggcgcgggagaggctgtcgacgacgaggcggaggtagcgggggcggttgtggacgtagaggacgatgttgaggtggccgtcggggaggcgggggaagcggtcggcgttgcggggcgggagcgcgttccgctgggagagggagagggagagcgcgctctggcgcgggagccgcggggtgaagtccgggtcgagcaggatcttgcgctgcgcgatggtgtggttgttgccgcc

SEQ ID NO: 9743 - DNA, 6021 bp, Oryza sativa
cggtcagcgcaaggaccgcgagcacgacgacggcgaggatcggcgcggcgcggaaccgaaggcgcgcgcggtggtgcgaggacgcggtggccatggcggcagcggcggcggcggcggcggcggcggcggatctcgagccgtgcggttgttggcttggctgctgcttggctactacttttcgcttcttcttttccttggttttgccttcttgcctttgccgtgtttttaccgtctcctcgttggggtccaaattcaaaccttcttttcttacctcaacttcaaattcagactgctctaagttcaaacttattttgaaattgaggtgtactactaatcagttgctttctttcatgccgtgcaggccggggggggggggggggggtgtaattgggaaaaccggaggggctgaaagtgacgcgatgacaatttccacccactaaactatttaccaaattggcctgtttagcagccgggtatagcagcagcagcagtctttcgttgactaggttgccgttccaatccagatcagtcttgactaatcctcattgacatgattggttagtgaacttctctctactggtaatccacccgtgctaacgctacggctatatttgtcaacaatcaatcagtcaaaagaggcatatgctggcaacataggtatttaaatatataaattttgaatcgccaaccaaagattcatgtttttttatgtacatttggcttgaataatgatttcatattattcatattctcgtcagaatttcacttaacaaatttgcttatctctgtcaacgcctataccttaatatactatcataagatccaaggcatcctacataaccatcaacccattttccttacaggagctggactcttcacaagtccgcaatccatcaccacatttttcttggaggagctggactcctcacaagtccgcaattcatcacccgtgcagtgcaaatgtgccacatgctagtactggtgagccaatggaaatgaaatgctgagagaagccatatgaaacatagctcttaccaataggaagaaaattcttcagttgtatatgtagtaataacttactcctcactccgtctcaaaatataggtacctctaagattcaaatttgtctcaaaatacaactacttgtacctattttctcatatcaacgaataacaaccatctcacgccccaaccttaatctcttttttagaaaatagcataggtacttgtaatttgaggcagatggagtacatatgttctatttagttgaaacatacggaggatctgagaaagggtgacaaattacgtaggaatgttgaattaagatgtgctagcagcaagcttaagttaacaatagaaacatgtatccttttcaatccaaaagtttgtaagactgtagcactaaaagtccactaacctttaaatcagtggaacatttaaattttggacataacctttaaaatcactggaaaatttaaattatgaacatatgaagttaaaaacaaacatattggttacaggttcactggactcatggtacaagtcaaataagatatgtttaccataattcacaactgtagaattctcagctgctcaagatataagcaagctcaaccacaacccatattgattctgtgtaaaaaaaaggtacatgtgccaaccacatacttcagatttgttgaactgcacagcttatacttttcttattccattttgaatgccttgcttcaattgtgtggcactgaggtgaaacaaattctcctatggtttttttttccacagttgattataagctgtaacacttattggtgaccatataattatttgtgggcaaaacatccttactggaaaataaactatgatgacagaacccaaaatcaactaaaaaaacccaacaaagcatgctcacatatttatctattaaccaaaagaaaaatcaatttacctggtaaatgctccaaagggtgcagaagagaaagaaaatctggaatcaaaataaaaaaattatctactgctgctactaacacgtgaaattaattcagtcaaacgcgaaaggttagctagatattaagtggtaatggaattttatactataaagttaaacaatgattgtttgacagcacattgcttgtaagcacctttggtatcatcattttttctatctctgcggcttgtgctacggtattctagcaaagtttctctaaatcaagagcttcagtctggtaaaaccatatacatgaatcgattcagaaaataaaaatttagtactaaaattatgaaatgctgacaataggatttcattttttttttgacctgatagcttgataaaacaatctctgttgcttcaatatccgactgaggtgaaaccaatatcatagtgtattaatatatcatacagtatgatatagtgcttcccgattagattttgctcacatcaccctggtgttttccctcgctcttctccttctccttgggagtgtttctcctttcaatccctctctgtcaaaacacacacatactgacattacatccaagctaatacatcaggtatgactgtatgaccaagtttaaatttcagtgcacacgcattagcataatttggatatactaccaaactaatttacatgatttcgagtaggaatttaaaaaaaatcagttataggcaagaaatcaaccgaaaggataaactgcaaaaccgtgaatgcaaaagagggaccctaccccattgtcattgcccatgtagtgtgctttttcctccagaagcagccctctcaatcttatagaaaagcaaggataaattttcagaactattcaaacactttcatacatttaaattccagaggttgtgagttcgaacaccttacaggcagcagccttttcaatcttcccgttgttgcatctattaaaaaatagaaagcaaacacaattagctggagtgactgatagtgggaaaccaagaacaagagacatggtgctagtagtatgaaggcaaaaggtataagaggcacagcatcaaaactcttactgtaatttagactgaagagcttgacctactttgtcagagatatcattgcaatagttaatggagaatattgccagtaatcaacagcttatcgtaaaatttaagtcttgtacggaaacagccatctacattctctcgagcattattataatttttaacatcttttgagcagaagattcatcaaaaattagaattcagaacaattgttgagcattgcatttgttactggttttacaataccttgataaaaccccacaatactttcattgtacaaacatgcagtcctcatgtgcaggagaggaactgaagtgatttctgctgtaagataaataatgcaagtatcacaaaaacagctaattaggcagtgtgcatccaaaactgcaatgacatagatgaatgagtgatgctagagctcacggtgccaaaaaagtgtggagtcggcaaactgataaaagtccccaatatcttgaaaacttccttgcaactttgttaaacttaaaactgagtggcgatggattcatgtcggtcagccggtcaccaacaatggtgcaacatctaatttggaggactgaatactgttgttctctagcctccgcagcactgtagcattcaaaaattggatttagttcaaatatgccaacaacctgattacctgaataatgttgctttctagcctcttgtagcattaaaagaaattggatttagtagaaatataccccttcactctagggtagtgcagaatattccattgattattgatctgtactggagaccaggcgtttagtacatttagtaaattcggacaaaagttagatgaacaacttatgtttcaggggaaaataacacgctaacatctcataattcaggtttagaaaataaaatacacccatattaaagtacagttacaatatatttgcttaggctaggaatttagtcacaacacctttcagaatcatcgtcccaaggccgatcgcgatcatcagaatattcagaatcacgatgctatcttcttttgcttctatcacggtgatccctgtggcgatcatggtccctatcattatcaccattttttaaaaaaccatgagaacatcattctgcaacacagaaggtaatgggccgtaattttgtaaacgtgcgaggaaagggaccaataaatataatgagaataagtgaatagacattttggccccaaggtttgcacataaggaagttgcagcatttttccaaaaaaaatatttcaagcaatgtaaatctagaggatatttttgccagcctaacgatgaggccctcagctaacatatccccagtgcagggttgtcattttaaacatatcagaatatgctactgctcaatgagcaagttgattgtaaagtgtgacctattggaaaacaaaacaactttacaatgagcaagtagattgtaaagtgtgacctattgagaaattattggctgaggaggatgaaaacaattactttaactcgtctgaattgctagaattgacaattaaacccattcttaatccctttgggcatttcatcaaacatatgtcatgcacgtccaaatttgcaaaatcgacagaagcaagatcagaaaccacctttccacccatatgtggcagcaatgatcttcacgttacccatctcgtatagggaggatctgcacaaataaagcagtaaaatcaggagccaaacccaccattaaaacccaaagacatataatcagtagatttacctcttttgtggaggaatgattctcagtatctcacctgttgttgactggttggtagcccgatccgacagccaaggactgaagaagtagaagctggtggatgcggtggaatgaagaggcagaaagaggtagcagccaggcagcaccgcggtagtaatcactgaaccctccctcgagctcttcactgctcgccgttctgcttctccgtagcacggttcggggtggacacggaaataagcaccagtcaatcgtgacaccactcgaaccggaaccctagccacccaatccccgcaccgcgacactcgaatcggagcccaaacgacgccgtacagaacttcaccttagaggggagaaacttcgagggaccctcaccttcgatgatcatcgccatctccacgagcaagtggcggcggcaggcggcatgacgatccgacgacgacggaggggcagcacgtgagggatgcgacgacagcggaggggcggcgcgggagaggagagaaatcgagcagcggtggacgggggatcaaccgcgcgcgggtggggcgtcggcgtcgccgggtgagtgcgagagagagaggagggaagagccgagcgagacgcgggagggtgaatgcggcgtgatttccggcgtgaggaggatgggtgcgaggaggggaggggatgagagggagacgtggggtaatctgaggtgttggattggatgattttgggccgttggatgtgtgatatgatgagtgatgaatgagtgaaaccatttgttaaactataggatagaataataataacttaactaatcacggtcacggcatataccgttggaataactgcaatcggagaagttggttgggtcggttttgtgatgggccgagcacgagttgccaatgggctttgtgccactactacttccgtgccgtgaccgcccgggcccagcacccacacaccgtgtcgccgtcgcacgcgcagccaaagccaaagcccagcgcgatcgcacgctgcgtgtgcgtgtggcgagcgagtgcgatgtgatgttctcccgaatttttttcatttttgaatttttttcttttaatatttacagaaataatccatcggcgcaaaaaaattacaaaaagaaaccctgccgccctctactagagcggcaagctgacgtggcaaacaggggagggacggacggtgacggcagacaggaaaggagggtttttttttttgcacgaaaacccttgccgccagggcctccatgcaaaaaaaccagcccgagccgggtacttttt

SEQ ID NO: 9744 - DNA, 5637 bp, Oryza sativa
ccagccaaatgctttttagggctgcaaagggcggcaagaggctaaatgcaattttcgcagacggcggcagatggtgccgtcgagccgccgtctgccatgttagcttgtcgccatccactagggcggcagggtctatttttataattttttgcgccgatagattatttctgtaaatattaaaagaaaaaaattaaaaatgaaaaaaattcatgttctccccctcgcgactgcgatgccggacctgcatatggccggtgtcatcggctcatcgctcccatcagagtttgttgccgccttgaaatctgcagtaaaagctccccaccccccaccccccatccatccaattgatagatgcacctatatagtccgtatttcattcgtcccatataaaacgaacatataacttaatgtgatatattctaacacaataaatctaaacggatatatatctaaattgataacaatataatgtgtcatatctattattatattagatttttatgaaacggatgaattatttgtgagtagtggtactaagggcaagtactataaacattttattactaattgcaagataccatgtagactcgtataatgatgtggaggagagaaaagaagataagagagaggagcagccacccatcatgtaagggacaacctctacacaaaaatcaagaaatatgagagaaagagagaagtgtattgggtgtagtgtaagtagatgcaatctattcagagtatgtattacctctaaattaatatgtaaatgatttaaacaaaattagatgtgatcaaacttgtctaaggaacttcagatcacgcgcaattcagatcacgcgcaaatcaggttacaacaatcctatgacgcacgaactaacgcatacaatgattggtgaagggcagctggaccgtctacaggatagtttcagacttgtttcctccctaacagtgtgaccacacttgtgacttattttattattatcgttatgagattatcgtggggacttttcctaagtcgtaaacagcgccatgtttatgaaaactttcttcaccgatatttttcaaactcttttagatttacttatcaactttctaatattaatgcattcgtgtatgtcctcgaataattattactgtcgacgtttgatgtcgtcattctggtatttgcatagtatggggatcatcaatgctaggatatacgcgagactgaggtaaaagagatggagacatggatttttatacaggttcgggcccctgagttatcagataataaccctacatcctgttggccgaagccggtattgctcttattcaccataatcacaccagtacaatatgtggatagcctatctaactgttgtcgacatgtcggtctgaaggtctgactcgtagtcgacaacagggtagccttcctcctcgaatccgtgcccggcgagatcagagatagcgctttcgtatctcctgacggtatccggagacaccgtaggggaatagccatgcctatccctgaagtcgatatccggcggtgtgtcttggcgtatgtaggcttgtatgttgtggcttctggtggacgtgtgttgattgtcatgagtgtcttccatggtcctttcatggtggttgtcgatgaggtggtcgtcccgatcgtggtgatcgtgttgatcgtctcatggtgagtctgtgtgtccctgtcctcctaggggggcttgtatttatacccataggtgtccccttgtccaagtagaactagggaaaccaatatggatacaatccgagtagtccttgtcgtttccatgtagaactctggctgtcttttcttatccggaactccctcctatatccgtaggttgtttccgtataggacatggtatgtggtgggtcctgccgagatttagtcaactactattaggtatgtggtatccataaccatgacaattacaaactcaatttcaactatgtttcatccattaaaactttagaatgcaggctttacgtttagattgtgggttatactccatccgtttcaaaatgtttgacaccgctgactttttagcacatgtttgattgttcgtcttattaaaaaaattgtgaaatatgtaaaactatatgtatagatgaaagtatatttaacaatatatcaaatgatatgaaaagaataaataattacttaaattttttgaataaaacgaatggtcaaacacgtacttaaaaagtcaacgatatcaaacattttaaaacggagggagtacttcactaccgtcagaagtgatggatgctgtagaacttgacagagcgttgaaggggattatggtttttcaagtccatcggtcatagaacttgtgacaggagagtaaaaatgacttgagtttattttactccctattgttacagaaaaacgttgttttaaatatgtgtagctatcgttagctaactttgatcgtagtttatggtgtaggatataactaggttcgatataaaactacatagccaattgtcttgttataaaagtttatatgccactccctccattttatattataagtcatttaccttttttcctgatcaaaattatttaggtttaaccaaattgatagaaaaattagcaaatatttataacatcaaattagtttcatttaatttaacattgagtatattttaataatatgtttgttttgtattgtaaatgtttctatacttttctgcaaacttagtttgactacgtacaaaatcgaacgacttataacatgaaatgggggaatattacatttatgtaactgttctttattcatgcaaaagaattgaattgctaaagtcatgtcttattgcctttggaaatgtttaaacgatgttaatttttctaactgaaaggagtccaatgaaataccagtgtcctcctcgtttaccagctataaaagacagtaaccatgtgcgtgtcctcgtgcgtcgattcaaaatacgggcatacgggcaaaccattgaccttgaccgtgcaccatatactaacatccaatgacgacagtgacatttaagatgtgagaagtaaaaacattttaaatttcaaacgaactcccggttgcaggagaagtataggatgcctaactcccatggaaaaaaatcaacacaaactaaaaaatcttgatagtacctgcataatgtaaatccaagagtttctagccatgtttaatttttgcctcatcttatctacttaattatagatataattaaacaatttaaaatatatataataataaataacttggtctaacaaatgtagtcgaagaaagtttattaaggagatatagaatcttaagcatcgaacaaataacatatttcaataacccgatgaatattaacctttatcttttagaagtaccacagtacgtgtcggagatatgggcccgagggtatgcgaagtgtggagaatctaccttcctatcctgccgtgtgtccctacagcttggtcctgcccccgcagtccgcgaactgctggagcggccggggagggggggtcgcggcctcggggtgccacgtcatgcccctcgggcccttgcatcgctttgccccgaggccctcgcccagccgccatttggcgggggcagcgagcgaggagggggcccaggctgagcctcctttaatacgcgcaacgccccaactgccccctgtctcatttaatacagtgaggcagacatgcggagtgctaaactgacacgccataatcaagaatgaccggtctgtaaccggcctgacgctggtcacatctgactggaccgacaaccgtgctcccacgtcgcgtctgcttccggtggagtggaggtaggtatgacacgtcccatcagagggtcattcggacggcggcaccacaagtcttcacccattaatgagggaatgacagggctgtcccccgtgtcaggcgagggacggcgctaggccccactcaaggacaagctgtggcttagcttccaggcgaaggcacgggtcgagttccggtcaagatagggtgggtccccacccgaaagaagaataggtaaaggcggtgcatgtggtatccccttgagatataaaaggaggaccttgcccaccgagaagagggagggggactttggaggcttgaactctaggaaaagaagagtgagagtgctgtccagagttgaggaacccttgtaatactcaactataatctcaaacacagtagtagggtattacgcttctcagcggcccgaatctgtataatttaattacgtgcaagctagctagtaaccccagggacggattcgtgatttctagaggcgagcttcttctcccggccgaactcacgaaaggggggggggggtctcacgacctcccgctattgagggtcttccctcgacagtacgaatttccaacaagtttgaaaaaaaaagagcatagttcaactggattcaaatgaggaaattactgtacaaacgacctaaccatctgactcacccacggatgaatctaatcaacggttgcaaatgaacatgctttattttgattggtctatgatcacatatctttagttatatatgagttatacaagtaaatcgtatctgtagcaacaatattcaaacaaaataactagttttagaaaaaagaaatggtttcaaacatgttccgagtacacaacaatacttctccaatctcataatatagtaatctaatactaaatgagtggcacctggtactacgtaatggtattaggttttaagggcctcttcggttcacatgatttccaaatcacagaaaagaaaaaatacataaataatataggaacatacgcacaatataaaagattggaacacatgaatttttcctccaacgagctgaataaaagagaatgaagcagatttttcattcatatggaatcagtgcatttcgaaggagttttggaggattggcttagtatttctatgaaaaactttcctctgaattctatgaatcaagtacataaatagtgtttgtttcaaaagaatcgagaaatccttcgaacctagtaataatgcctactctttccgtctaaaaaaacgaatctaaaactgcatgtgacatattctaatacaataaatctaaacataggtatgtccagatttatagtattaggatgtgttctgataattttttatgggataaagggagtaaggttttagagtaagaaattggccgagttcagttccaaacattttttttcaaacttccaacttttctatcacatcaaaacttttctgcacacataaactttcaattttttcgtcacatcgttccaattttaaccaaacatccaattttagcgtgaacaacacacccatgatttcaaacatgggccgagtttagttctaaaatttttcatcaaactttcaacttttacatcacatcaaaactttcctacacacacaaacttctaactttttcgtcgcatcgttccaatttcaatcaaactttcaattttggcgtgaaaacacacccatgttccactgggcgcacgttttcgccgaaacgccgagtcgccgccgacacggcaaattagccacgcatccattcgttcgttcatcgcaaaaccaaggggggatgatcatctccagccacgtataaacccaaccaaacaccctcccccctctcgcccac

SEQ ID NO: 9745 - DNA, 3459 bp, Oryza sativa
agaaccagcctcccctcccccaaccctaaagcctccccgtttcattcgcccccccaccggatccagatcaaaaccacacgccgatccagatcccgccgggcgcccagccatggcgcgcctcctccccttcctcgtcgcggcggcggcggcgttggtggcggtgtccctctccgcgccaggcgccgacgggttctacctcccggggagctacccgcacaagtacaaccccggcgagccgctgagcgtgaaggtgaactccctcacctccatcgacaccgagatcccctacagctactacagcctcccgttctgcacccctcccgacggcgtcaaggacagcgccgagaacctcggcgagctcctcatgggcgaccgcatcgagaactccccctaccgcttccggatgcacgccaacgactccgacctcttcctctgccgctccccgccgctcgccgccgacgccttcaacctccttaagaagcggatcgacgagatgtaccaggttaacctcatcctcgacaacctccccgccatccgctacaccaagaaggacgactacttcctccgatggaccggctaccccgtcggcatccgcgtcggcgtcgactactacgtcttcaaccacctccagttcaccgtcctcgtgcacaagtacgaggaggccaatgtcgcccgtgtcatgggcaccggcgacgccaccgacggcttcccttccaccggcaaggacggcagcggcggcgccgccgggtcatccggctggatggttgtcggcttcgaggtcgtgccttgtagcatcaagcacaaccccgacgacgtcaagtcgctcaagatgtatggcaagtacccgaggagcatcaagtgcgacccgaccaccgtgtccatgagcatcaaggagaacgagcccatcgtgtacacctacgaggtgtcgttcgtcgagagcgatatcaagtggccctcgaggtgggacgcatacctcaagatggagggtgccaaggtgcactggttctcgatcctcaactcgctcatggtgattgctttccttgctggtatcgtgtttgtcatattactgaggaccgtgaggcgtgatctgacgaggtatgaggagcttgacagtgaagcgcaggcgcagatgaacgaggagctgtctgggtggaagcttgttgtcagtgatgttttccgcgcgccaagcaacccaatgttgctctgcgttatggtcggggatggtgttcagatccttgggatggcagtggtgaccattctgtttgcggcgcttgggttcatgtcaccagcttcccgcggtactctgatcacgggcatgctgttcttctatctggttcttggaattttggcaggatatgtgggtgttcgtgtgtggaagacaatcaagtgcggtgatcatacagggtggatggctgtttcatggagggtagcttgcttcttccccggcattgcattcctgatccttaccactctgaacttcctgttgtggggaagccaaagcacaggagccatccccttctcgttgtttgtcatattgattctgctctggttctgtatctctgtgccgcttacacttgtaggtggactcctcggtgccaaggcaccgcacattgagtaccccgtgcgcactaaccagatccctcgtgaaatcccacctcagaagtacccatcctggttgctggttctcggcgctggcacactgccctttggtaccctgttcatcgagctcttcttcatcatgtctagcatatggatggggcgtgtgtactatgtctttggattcctcttcatcgtcctgttgctccttgttattgtctgcgctgaggtttcccttgttctgacctacatgcatctctgtgtcgaggattggaaatggtggtggaaatcattcttctcatctggatctgtggcgatctacattttcttgtactcgatcaactatcttgtttttgacctaaagagcttgagtggacctgtgtcggcgaccctctatctcggctactcactcttcatggttattgctattatgctggctactggaacagtgggattcatttcatcattctgcttcgtccactatcttttctcatccgtgaaagcagattaagctcatcccgatgcagagtgtattactcaaatgagaggtgagaatagtggacatcaaaaagtttgtagtcacaaaatcttagctcatgtcatcttttggtatacaaagactgaataactattgtaagctttactaggatttatcaatgggttttatggagagatgtgctagcagcttgcacgatgtaatagaatgaattggtttattcacattttgagtcattttagttgctctttctgctgccatttagctgttaagatgtaagcttagtactgctgtctgttgcaatcgtgtttggtatcattttcctaaaatgttagatcaattttttgacttatcagaattgtgatggtttgatgcagttgctacacaatatagtgattatacttatttttctttgcaccagaactccaactcctaccttggttcatataagaaactctccttattttgtatggagtaataattaatagtcttcatgttttgcatctgacagctatactttggatgtcttttaacattgctaagtagcttaaatacgacccttatgctataaattactagatgattgatctatgatatatgacatctcaacataatatttcattgattgtgtggctttctttttccagttgttttttacaatcattgctgggtggttgcatctgactcattccagcgtgctattccatatgtataatgtgtagttgaacaactaatctcaaagccttggtgattcacttactaaaaagaactataaaaggtagcctcggcttcaaacagctgagtgagcttactgtttcttcaacttgaaagaatgtgtctgataatcacggtaatctattgctgttaatcctggtaaccttgggttatctcttgccgttgccggttcatggttgcagagatctagtttgtactacttgtttgctggctgttgctgtttattgtatttgtaaattgtaatggtttgttctttgcttgctttcagttttctcgtcatatttctactgggacagtttgtttcctctatatggttattgttaaatcacaggtggtccaaatttgatgatttgcattcgagattatgtaacggcatactccaagactgacgcatttctggcgtccttggtgtcctgccctgtcatttggttgttggcttatccatgcgatccaaaactccaggactgcaattgctgatactgcgacgaggtgccctcgtctcatgatttttactgagtatcgcttgcttataacaaagcttggaatgatctgctccgtgcttgacctgttgaaattcaaaaactgcactacttgcaatgatcgcagtatttttactacagtactagtgatca

SEQ ID NO: 9746 - DNA, 667 bp, Oryza sativa
tgcacagcgtaccaaagctaataagcaaggccctgccaacagattgcagctcatcatcgactatctcattgaccctatgcaatcaagttttatcaaaaacaggtcaatctcagaaaatttcattctagcatcaaagatggttcaatctgcgctcaagagaaaggagccaatgatagtgctgaagctcaatttccacaaggcgttcgacacagtaagctgggatgccctgttcaaaacattggaagcaagaggatttcctgaattatggataagatggatgaaatgtctcctttgcacagggaaggcccaggtaatcatcaacggtgaaaaaggataatcaatccaatatataagagaggggtccgacaaggtgacccttttatcaccatatctattcattctaatagcagatgtactacaaaagttgatccagcaagcatacaataccggggtgctatcacatcctctagacatagaaggagcaccaccaacactgcagtacgccgatgatacactaatcctgatcagagaagctagccaagcctcggcactcaaggaaattttagattcattcgctgaattctcggagctcaaaatcaacttccacaagagcaccctagtaccaatacacctgaatgcagcagcagaagaattggtaacccagatc

SEQ ID NO: 9747 - DNA, 2831 bp, Oryza sativa
  unsure (1)..(2831): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctacttgtgtggtggaagttgaatgctcatagatacccggtggtatctatgatggctaagaactttttgactataccagccagctcagtgtcttcagaatctacttttagtgctgggggaagagttctaagtgattatcgtagttctctacgcccaacaatggtgtgaggcgttgatatgtgcttctagctggattagaggcgctccaatgattacggtactcactattatgccatgcataatttatgcattttctcttcttaacacattagtagttgaattaacttctgatttttctgaatttcaggcgacagaagaagaagaggatgttgagagtattacatttcctcaaagtgtagtgcaaagcaactagtaagtaaatggagtacttcactattatttttaggttatactttaattactcattttttcctatttctgtactatctcgcttgtgattacatgatgatttatcatttatgtaggcaaatggatggctcatggctggaagtggaacatgttgctgtggtgtgtgcagaaagtctaggagttgaagatgtggagatttccgtttactattttgcgaaataataattagatgttctgtaattatcttgtgaatttgagaatggagacttttgacttttggaatgtggtctaagttatgtactctctataactctattactctatacttctattttggtgtggtcatgactattaagattatgtgtgtcatgttgggacatgtcctgaatgaatgaagtatggagattgtgaattgtggtcttgtgatcttgtgaaatgtataatatgtcgttgctgtcttgctgatcgtgcatgttgatgttggcttgctagttgctacttggtaccgaactactgattatttcatgcctacatgacctgtataagtttgatcataatgcgtacttgctgtaaacttgctgaaaattgattgctctattgttaaagtatttacttgttgctgtacatcacaagctggctcgagccggcttgagctttgaaacgaaccaagccgagctgcactttttgctcgttctattaatcaagccaagccgagcccgtagttgagcaagctttcacgaagctcggctcggctcgtttccacccctattataatcgtagtacggtttttattttttttaagcagcagatgcaggagacgtcgcgctgcggtgcgtggcggcgtgggggcaactggccggtgggcgggcaggacaggacagctagcgagcgcacagaacggtgctctgcgtgggcgtgtgtgtgtgttttttttttgggtatctgcgtcttctgcgatggcatcgtgtcgtctagacttgggacacggctcgtgcgcatcgttggcctggcttctgaagtggctgcgccaccatttctccgttacttgatttgtttttattttagtatttagataatgaacccgttcactaattatagtggtgatcaactactaataaaccgcctttgctggagatatatatatactatatacggacgggtgtatctccaatcatatgacattttgtcattatatctgtcgtagttctgcttgatacttcatgtacagtatcaactacctgtagtagtatataacaacgagctggatcgagattcttatagcttgattgaatcaattatgaattttgtgccgatcggctcatgttttgttatttatcaactgaatctcacaaatcattacacctataagaaataaccgtgcaagctataagaatcgtattaagtattttggaaaattaacactaacaggccggctctatcgtttttatgtgcacggaaatgaattattattattattattattattattattattattattattattattattattattattattattattattatcatcatcatcatcttctgactttaatagcagtaaatatattatcatgtaagtaaaaagccgattgagatgataaaggggttaatgagaaaagaaaaaaaaagatgaagaagccatttcttctctatacacgaaacaattaataatgaaaataagtgaacaggtggataaacagagagaagtaagatgattgaatgagaattgatttaaaaaaacatgtcaattatgtatatactctctccgtctcattttaaacacagctataagtttccgtgtccaaatttaattgttcgtcttatttaacttttttataaaaaaatgttcatgttttatcatctaataacaataaaaaaatactaattataaaaaataaataaaatagataataaaaattagacacaaaaacttatggctgcgagttaaaatgggacggatgtactagtttttaaacataacttctacatgatatgctaaggattgaaactgtttatactagttttttcagtaggttaaaaattaatgatcttactagtatgtcctatatatgtttttagaaggcaatgccggtctgggcttataatacattctaatacaataaatataaatataagaatatgatatatagagattcgttgtatttaggtcgaaggaaatacttactcactccgttccattattgtacaacaatctttcaa

SEQ ID NO: 9748 - DNA, 5827 bp, Oryza sativa
gatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgctcgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaggcaccacaagaccaagaccaaccagccaagacttattcctacacttacaatcctttaccacaagttcttccaatgatccggccctgccaaggtactccagccactccacacttcctactttcatgcaatcaacaaggtggaaagtacaaagactcttgcaaccaactgccaccgagagaagccctcttgaacttattgctggtgcaaagttcagcctgaaagaccttagtttcttgcaataagccagatagccaataccagaatcatcgatataggagcagaagtttaatgtgagatcggtcagtgaagagcagtgagacgaaagcacaaggagcccttggttgtccaactgcttcccgtggatagatatccaaccagagtaatcaatcactactttccacaaattagggaaccgggagcatagtgatgccaaagcttcagttgccgggtgaagaccacagccaacatggatagcatccctttgctccgcgtcgatagtgtagagctgcttcgacacaagggaaagagagttacgatcacttgtcttggcaatcctcttgatgatctctgcgagcagtggctctgacaggttgtccattgggcaatacggttgccttacttaagcaatatcaatgttcagctggcactacggactggcctaaaagtaataagaatgaaacatatgagatgtgatagtcagatggaattaatgatattaatttagaggtaatactttcgataagatggcaggagtgtttccaattcaactaagaggtagatttagattagcaaataactttaaatgagggaacctccctatgcatttataaatgactaagcaaataaagaatatgcaattagtctaacaacctgatcaactgaattactgaagcagataataaaaagggaagtttctaacaagcaaatgagcagtgcaagtccagaaatactagcattcatctgctgaaactgaactaacatatttggaagcactttactagtaacatgaatgaaaatcacgcgtataacaaggtgcagacgtgcagtgactcattattattttctacaattcactaccttcacaataaacagtacctaggacagacagcgccaactttatctctagtagtctagttggctaagaaacataagaattgcaaactattccgaacccaattaagaaaaacctcaaactattctcgcccttattatctcaataaaaaaaatctcaatcagaacaggggaagggactgaaaacacaactaaaattagagaccggatcatagataccttagagaaatcaaggacctcaagattgggggtttcagagaaggaaaatccaagaaaaagaaagaggcgtcgtt

SEQ ID NO: 9749 - DNA, 14518 bp, Oryza sativa
taataagaattaagacttcttcatggataaatgtgaggattatttacataagaactgtcctgcccacctccagatacacttccttttgtgtgtgcatacttcgttttttctagtacatacaatcaggatccagattttactaaaaaataaattaatatatgtaagactagcaaaaatttgatgcgaaccactctgctcaattaccttgagttctggagcctctactacttgcgctattgcatcacatggaagttctttttgcaatgacttcatcttgccaccacaaatctagcacaaaatcataaccacattgtgaaattttttttgaaacagaaaaacagaaagaaatagtaaaaccctaccatatcttttccagcatttggttcctgcagctttggaacattagaactaggagccgaaggaacagtagcatcctcatgcaatttatcacagatctctgcgacctcaaaagatccagggttcaatctggcagaccttctccgtcgagtttttctgaccacatgtgcccaagagttttgaacaagcttaaatcagataatgatgcaacaatgaacgcattctgttataagcattaagcattgattaccttggatcatcatcatgcgatgacccattatattccacatgaggtctgcagctatgttgcactgtgttggtatccattgtaacttcacatgattctgacttccgcctatttgtgcacctgtttgcaaacatgctgaataagtagtgatgcatgaaataggctactataacccggtcaaccagtcacccactcaaacatcagtaaagagatgaaaatacctcttgtttgttttatcctgtggaggctcatgacagctagtataagatggcacagctgctgagaagaaattggcaacaaatgaagattagaattttactagtgtcctaacttatggcagaggaaaaaacataaaacttcaattgcttcatataaagggggtaaattataaccataaagtaggatagatgaaacgattgccaggtatagtatctagttcaagaaagaaatagtgagaagagtgagcattacattgaatttcaaccaaatgttctctaatagaacctgcagccatttgatgagccttagttggtgcgcatttggaagacctggtttttttctcctgattatgttgcacgaacagaacgatttcagaattcagaactagaaataatgcagctaaacatggtgaatcatttgcttaagaatttgactgcataccaatatctttgctctattttgttgattgttagaagtcttactcatcttctgcaatagtagacgatgagaaaagcatgttatatgtaacaaacagaggttcatacagtcaagctttagaattacctcgagttcagaaccctttactttgagcacggctattgtgcatgcaagttcatgttgcaataacttgatctgcatgtcatatccacagattaatccccaaatcagaaatcatactgcatttgaaaattcaaacaacaaagaaccagaggcagcttactctatcttttccttgatttatttcctgcaaggaagaagaaaacatagacatatcaaacagtctgtaactaccacaaaacaatcagcaatgaagtaagacaaacacttctcatttgccattatgcatagctataactcaaactatgtgctcaacctacaggcctggtgaaccagcattgcacaagtataaacaaacattgacacaagaatggtgaggtagggagctaatggataagtagacaaaccgcaaacatctgcgaattagcctgcacgagttgcaagttcttctgctgcatggcttgcagtgcgaggcggattttctgcaactctactctgctgacttcaatgactttgctgcaaataagaaagcaaaaaataatttaaaaaaaactgtgctacttgagaaaccgcaggttttatcctccgacaacaaaatggatggtagaggcaatgcatactttcgctcagcaagcagatgacgcaacttggcgttctcctgaaagcaagggaggaattaaatggtttaatcggatggaaatcggaattactagcattcaacttggcgctgctagggttgtctgcttgtttgagttagaaccgaaatcccccgaagaaaaaaaaaatagagctagaactgaaatcaccttgaggacgtcagcgatggcgtggacggatccagtagggttgggcctcccggtgttggtgatgtcggcgagcacgacgggtttccccggcgaccgaaggctgccacccttaccggccgggatcacaccgccaccgcgcgccgctgcccctggtttaggaggaggtgcggaagctgagcccgagagaaccccaccatggaatgccacgggtagctcgaaatctaggggatacgatttttacctgcagcggccgccatggctggcccagcggccgcggggcctgtggttgcgcacgccaccgccggaggtgaagccggcgaggaccctcggagccgcagcgcgcgcgcggggagagagaggcggcgctccggtagccgcgcggagaggaatccgatgaggtttcggagaggagaggagaggggaagcgacgcgccggagttggaggcggaggggaattcgaaattttgggggaggagtggagatgaaatctgaaatggttggaattgatggcgacttgacttttttttttttttgaacttgatggcgacttgacttgtcaacgcgagttccttctctcttttttttttcttttctccaccatttgttgggccgtgggctatgagcccgttatgggatccgttctagcccatgggctttttagagtagagccttcgcttatgagttgagagttgagacacgagttcgtttgccgggatggggcttcaactactcttctcttttcagttttcttctttgcatttgcaaaaattgcatcaggttcagaaatgattctatttaacacccaaatttgtcacatagtatgaaatatagcgaagtttgtcagattataaaaaaacatgggcctattgtatagggtcggtccaatcggtggtatgaggccaatctgaccgtcggtataggggtggtcggatgtgccattcagaccgggtggagaaagccttgtggaggctatggccagttcagtttaaatcaatcaacaaccaacaacgcaattatccaatcgaatcgttctttcaatttcacatgtaccttcgtcctaggtttaatcctaatttatccattttgtcggtttgctctataagccatccttcatcgtgggagtgcaaattcttgtatttttttccccaaaccttttgttcctcccataagatgggtgtttatcctaatctatctaaatcggccctgttaaccatatttgatctctaaactcatcttgatcacgagcttcttaaggtcaaggtggttggcgacttaagtcaacaccacgaggctttagatgatttgtcgtggtgactgaaaaaagcgtcaacagattccactttacactaatataaaacaaaataagttttcttacgaacaatgtcgtgcatctatatgcaacagccggtttatccattattaaagagaaaatctacgctaagtgattaactatacgaatttccctcaacgagcattagttgtatgaattgccgccatgcacaagcgtttttcctctttgctatcgccatcagttgaccattagttaacctcgtgtcctttatttccatgaaaatgtacattttaccaaatacatatgagatactcttatgtactccttgtattggtatcgcacttctaagggtaatggacattttgacacattaacataggccaactaacgattaactgacggtgatggcaaaaaatgaagtaaacacttattggcatttcgattaatatgataatccttagaatccctaacttgtcaacagccaaaaagaaacaacatcagttgccgttgaaacacgaatggcccaggaggccatgaaaggacaacgccaagttgtgttgtcatccatcgatctgcaactgcaagtctgcaacaaccaacaagcagcattccgtaatccgtactcccgtattcataatttttcttcccccctgatattaagtatccatgtatgctcagattcagaagcttccaattgccatgtccagatcagccaacccaactgacaaggcatgtacatgctttctgaagaaacgctcgaacaaatacgcagttttctgtgcgtctgtcgtgagacagcctcgctactttccagggggcaccacctgatgccaaacacaagacctgacagcattgttactcgtgattagtagcagttgtaagtacaggattagtacctaatccggtggcttgatcaaacaggaggccgacttttgtgcaggcatccttccccaaagggtgacaagaaccctgtaaactatgtcttgggtttgcatggtgcatgagctaacgacaatgattttttctgttaaaaaatgggttaacgacaatgatccagacattagaggtagtttttttatttgacgaagataacccactcctgaatcctgatagacatgagcacagcaaacactgggggttgttctaaaagcaagatggcaagatgcatatatatgacctgtcataggtcaaatgcttcattcagagttcagacacactcaacctgcatagctcatcctactctcttaactctcaatctctcccagcttcttcaaaatttcctgcgagacaagatgaggatgtccaagttgtcaatggctactgctgtgatcttgctcctggtagtgatggccatggaggttgagggcattcgattggatgcagaaactcgcgcagcaaccagcaaccaaatggtcaatgtaagtgattctgattcactgaatttgttcatcatggaattgtcttctgttcctttttcttttctttttgtatgtgtgtgctgacatatttgttttgttctgaaaaacagaaatcgacagagaatgtgccaaaggattccggtgactcactaggcgaggcgaagagaagcattgctgggaatgaagttagggctgtagcacacaagttacctgagttccatgaagactactatggtcccagtgaccatacacctagacaccactgaagagaaaacaatctttttttttcttcttctcaatctttttgttcagaatagattagatattagctagtcagcggctgcaggttgtagtagatactgaatttcatctgagcttagttagtaagcacatgatggtagcaacatgtgaatctttaacctatctcttttttcccctccttttcacctcattagtgaaaaggagcggttttcatgtactgacttgttgacaatacttgaaagcaacaatctcaagacgttgtccatatctttttgtgattgtgtttgttcccatgatcagcgcagagcttaatgtgacgattacaaatccacaaggatgtcaataccatgatgtcgctgatataactggaattgacttcgtcagtatgattttcggcaaccgttgtgcaatgacaagaatcactgaatcaagcatactgacaagatgagagaagaacacacaattaagagtgcaagtgcttttatttctacatgacagcataagcgctttattattggcaatgtaaaagcagcaaaaggaaccatcaagtgagtagcctcacttaaaggctttgtttcacttaattatggtgaaaaatgcctgcaccgtaagggagtcatcgttaaagggcatatttgcaaacgaaaagtaatttgtgaataaaatttttatatacgtgctcttagcgatctaaaagtaaaggttaaaaaataaacttcgataaaaaaacctcaaaatcagtttcaaatttaaggttgaaaatttaaattttaactgataagtataatcataaacgaaaaagatgaggaactaagttgattagtttgcttaagaagtgtcgtttggtcggcattaagtaaaacaaattactccagatagctgcactacggcatttgataggcattaggcagtagtatgacagtacagtggtactaactccaacattccaagcgtacattgaggaaaggaaagcaaaacacgagtggtcggcattgccggatatgctgcagtgttcttcgccattgctgtagtctactttacatgtccacgcaggatggcacgccgattagagtattccatcaactgttccgttctccacatgcttaataatgatggcttgatgattgagaagctgattagccagccgcctccaaaaaaacacaaaagccacagataatgatgcagagaaagttgtccgtgacgttagcgagacaagaaacgggagaaaagaaagtgcaaaagtacgagattgtggcccaagagggaggtggccgaagcccacgtagccaatgtggcctagtaacacatggtgggccggcccacgagaaaaatcgcggttgcggatggggatttttctcgtggcctccgcgcgcccaacggaggctttgcgtggccaacgtagaagtagaggatgtgaactggaggccacgggcactagcagagatggcaatggtgaattcatcgtcgggggtcacattcacatccacattcccattcctgtagtgataaaattttaccgttttcgtccctgtcaactacgacggggctacattttctcttgccctgtttcccacgtggtgaatttatccccgcggttaccccatccggtggtagttagcactcagtagccgtcaggggaatcggtggcgtcgaacggcgcgagggagggcgctaacggtggacggtggacggacggcgcgacgatggcggcaggcaccaggcggcgcgacgacggctacaggctccgcacccgcgttgacggctggggcgggacagcgtctgcatgagaggaggcggcagcacgcgtgcctgatggctggtgcgatgtaggcgtgcagcggtgagactaagtttagatatgaaagatgtggaggttgattggttgactagggttaggtgttatatatacatgttaattgggtttcaatattatgagccaaaacatctaacaaagtctagaattagtcctctctacagtgaaggcgagtcaccgcggggggcgaggacggtgaatggtttcacccagggttcacaaagctgacgaaagctggtcggtttttgcggcttttcgacgtttcgacatagctccgaattaattttcgattggaatttcgaagttcaaaagtaaatcttgtcgagattcagtcggaatttaacgaaaattggtcgatttattgaaaaccgtgatatcgatggagctcgaaatttagtggtcaaccggtaatgaaaaccccggttccaccgtcccgcccccgtcatccccgatggtgataagtttgggaccatttgattcccgtggagaatagttattaaccatctccatcccctaatatgtgaattcaccgtggataatcggtgattgggtccctattaccatctctagtcaccagccactattcgctttctgctactgctgctgctagcctttccaacgtgcacattttcttaccacctcgattcatttgtctttgtgaagtaaatgcagcggctagtactgcactgcagtaccacacacctggcctagcttggctacttggatctgagatctgactggagccaagtagccaacacaacacgagcgtgcagtgagaggcgacatttgctgggacatccatggtccatattattggactaattagctagctgacccagcaaaaggggaacaatcgagcttatacaagcgttaagtgacaaaatttgggcgagagaacgccaaatcatatatggtcccgttttctgattttctccatgcgatgcatgctgtcacaggctcagattcagagtttcagacagcaaaacctgggtttgaatcaatagaagtacacaacaattcagagcatgaactttacaatcactttctcttttttcccctctcattaattacttttatgtaaaatacatcacagtcacatactccaggggttcagggctttaagaaagttcaggttggacagcagaatgcggcaacagcaagcaatgtacctgctgcacgtggattagttttcagcaaagacggtatcaagttgaacacaaagcaatgacggtcttagctggaaagaaatcctactaatgaaagtataaactacaaagctggagttggagttggaggagatagaccaccaccatgtgggcaacatacattcatgcgaatacagctgcagaggaatgttcggatgctaatccatgtggcgccaatgcacgcatgtgatgcttaattctcgcttaatcaatctactgcttctaaactaaagtttcgatgtttcttaattatctccagatcaacataggagtaatcaaactatgtgttactggtagtaccacactagatcacctggtaatggcgagtcaagctagctcccaaaatgacctggaggagaatattatctactatctctctctctatatatattatcttttgaaagatccactatatatatagtcttcttgtattttcgactatgcaatttacgagacaccaattggatttgttctgtgatctttacgccgccgtctctggatcacatttcatcaaagagtagttataagaagaaacttggattataaaatgggggacaaattaattaaggtcatctttagctcagcaaaaatctcaaataaatacgagccagtgatccgtgacagcaatgcttggcttgttcttgaggaaaaaaaatcatgagatgttcgtggcgaactagtcgttgtctcgttgatagcatgatccatcgagagggacacgcgtctcgcaatcgccgggccagcgaggcccccagctcgatccgatgccctggaattataatcttttcttgggtttgattccacatgctcgtcctaattattcttcttaagtacattctttccttgtcattaaggccaggagtggtagtgcatcgacatcaaatcccactccaaattgcttttgctaaaaacaaattaaagcccaaagagcattttattactgttcctcttcctgaattgtccttgtaggctcggcttatcatacgcacggctttcattttttcccattgatcgttggattttagatcctgcgatacaatggttttcttcaaaatctggtcgaatgtttttactgttttaattttgaattcctgaaaaccatttaaaatttcaatcaaaatctgttttcgctatacctagaaattccacagttttcgccatacctgttaccatgttaacatatcttaccttcaaaggccctggggtgtatgcagtagtagaaagtagaaaccgctaattatatcgacaagttaaaacgaattgaaagattaaatttttggcgaaaaaaatgtttggttttaatcggttttgctcggtaaccgtggtcaggggtacggtggtaactgcagagaagcagtgagcagtgccacgtgggcagcccaacacataagcgggtctctagatctctttcacaaacccaaatcccctcctttaattaatcccgtcccctcagagacgaaagcagaatcgcgttaacccccgacccgagtgtatttagcgcaatcgcaaaaggcaaaagcgaggaagaacagacaggggaacgcggaaaaagggaaaaaagaatccgtctttgcatcccacatccctgtctttctcctctcctacccttcttcttcttccacttgaagctttttctctcttggtcttatcctcctccttgttgttgcgggaagaggcaggaaggaggaggttttgtggtgcgatcttgttggggtttcaggtcagaagggagaaggggagaggtcagccatggcattgcctgtttccctcctccgcatcgcggcggttctgctcgccatcttgccattctgcgccacgcatccaagccccgggttccatgctcctcgcgagtttcacaaggcactcgtcccaggttctttcatttcccccctctgttacatgcaggaaaaatggttggtttttttatttgtttgattcagtaggattttgtggtgccctttaacctctctgaaagtctgaatcacataatggagtcgagttcttgatgtggaaatgctccccaatcccaaaatttttagtgggctgtgtggtcctcaggttattggtcatctgttccttgtctctttcttcacaatttttctttgagaaaacattgatgtgttaatgttctattttttgggggtctgggttttatgtttgctgagaaacctgtgcctgtctcagtttcttatcagcaaaaaaggggaattcctacatttggtgaaagttactgtcttgcgtttctctacgaatattgtttgttttaagtagatggtttagcatcttgtctaagcaattcatgacggaattatgtttttcaatccgctcgtatgacagtgcatcgatttttttttcactggttttctttagcaagacatatcaagcattcccctttttcagttgctgggtgccaacagtgctattcccaatatatttcaagtatcacaagtgggatttgttttaaatgcctttccctgtcaagtatgtggtgcctctcgttatcccttgctccatccacaaatgatattttcagtaggttgctccttttgattcggtaggtacccgaatggtagttttgtccataattttgatttggttgccgacagttttctagttttgattagtgagtgtcaaatatcttctgtaattatctttatcttaaattgcaaatataactctactttctgttcgatgatcgtttttatcaatgtcaaataactgtaactgtaactgaaaaaagcagatagatatggatttgtggcaagaagatcaattgctgaagctcctgttgacgtaaatgtcactacaaacagttcctttgtcttggcgcaagagcgaacatatagaaaagaccccttgaatggattcaggaaatatactggcggttggaatattagcgaagtgcactatatggctgtaagaatgtttacaacctgaaattgcacctcattcatctacttgcataacaacatgtacttttttctgtttgcagtcagttggatacacagcttttccactgttcatcattgccttggtgtggtttgtgctgttttttctggttatgcttggaatttgctgcaagcattgctgttgtccacatcgcagttacacatactctcgggtagcatatgccctatctctgatacttctaatattgttcacttgtgctgcaatgtaagtactcttatatttcaaagctaatccattttcatgattccttacatttaatatatttttagctgcgtttactaacctagttccattcaatgcttacagtgttggatgtgtcatgctgtatgatggtcaaggaaagttccataaaagcacaacgactaccttgaattttgtcgttagccaggccaattttactgtcgaaaaccttaataacttatccgatagtttatctgctgcaaaaaaggttgacatagggcgatcctttttgcctaacgatgtgcaaaatcagatcaatgaaattcaaggaaagttgaactcatcagctactgagcttgctactagaactactgacaattccgagaagatacaaaaattgctaatcaagtgtaagtatcatttattctctcaccactgcaattcctctcaatgatttggttgtgcatatgatcgtgattgcaaaacattatgtcaagcggattgctttgattatcattgcggcagtaatgcttcttctggcatttattggcttctgtaagtctttataatatttttacattgtttagagaacgattttgtccatgcacctttttttttttttttttttttttgctaaaacacaagttgtttttatgctgacatgatgccacttgtctttaccagtactatctatttttggcctggaattcattgtctctatgtaagttaacacctctgtatgtgctaatattttttacttctcctttctttgcgctcatattataacatactatgaatcatttctgtacattttatgcagtttggtgattatcgggtggatactagtcaccgggacgtttatcctgtgtggcgtcttccttcttctgcataagtatgtattccacttgttcatcgtacttttgtatgtgccaaacatatagctagagttagtatgtgtgcagaccttttattcatggtgctcctcttaagtgtttaatgctggctgccgagttgcaaccaaatccaaccaaccacttagccattatttttataatcaaatggtaaaaatcagattatattggtaaatctagtaacttagtttagcacagttgttgaaagttatggatgtacacacccccatcacccaaagttcgactcatcttcaactcaaattagttgtctttcttgaaaaaagataacctaaatccgagagactggtagcggccacttggctttcgaccatggttggagcatgttgcaatattcataatgtagtgcctgcatcaaggcttcgacaatttattgtgccatcatatagtatattcttgcttcattgcaatttcctattcagtgttgtcctgcttcctgttcatggctacattggtttcttactgttctgtactcaaattctacttcctacttatctatgctatcatcactgctaaatgtagatagtagatgccagtcatatgtcaattttgctgcattcctgaggtctcaaaggatcgtagtttgaaaacagaattgcaccatctagcagtagctgctatatcaactcctagttttgatgtcatatcgtgttccgcttcatgtcaatttatgcacagcacggtttttctacaatatttatattctgaaactctgtcaatattgtatgattctgttttgttagcgaaagttgcacatggttagccctctactactttcaaaaaactaggggtataattatgttttaacatgaaactcttagtaataaagctggaaagaaggaccagatcttttggaatagctccgctccctgtagattatatgagtgattgatagtagataggtagcacatgtaaatggcagtcgtggtccagtcactgatactcctattatgtacctatgattatctgaatccatatccaattttaatattattttatctcttttgtcttgtgacagtgtcgtcgcagatacttgtgtctcgatggaggagtgggttgctcatccaacagagcacacagctctggatgacattattccctgtgttgaacctgccaccgcgaatgaatccctgtatagaagtaggcaagtcacttaccaactggtgaatctggtaaaccaagtaatcaccaacgtgtccaatggaaacttccctccgcaaactcctttcttctacttcaatcagtcggggccactgatgcctacactctgcaacccgttcacagccgatctgaataaccgtacttgcaccagaggagaggttaccttggacaatgcaacccgggtaagtttctacaaccaggtgtttcgtagcctcaaattcggtgaactgttgacagcattccatctgtctatattaattatcaaatgcaggtttggaagaattttgagtgccagactaccactgtctcaggaactgagatatgcactaccgtgggccgtgttaccccaacgattctcggtcagatggcagcgggcgtgaatgtgagccaggggctgtatcagtatgggcccttcctgatccagctggaggactgcactttcgtccgcgacaccttcaccaacatcaaccagaaccactgccctggcctggagaggtacagcaaatgggtttacgtcggcctggtgatggtttcgtcggccgttatgctctccctcgtcttctgggtgatctacgccagggagcggcgccaccgtgcgtacagcaaacagcacaactacgctgacaagccgcatccgactggcccggacgcttgatgcatatggccgatgctgtgctgcagaagaatctccatgtccatactcttcgtgcctgtcatcatcatgtagatcaccgtgccttctgattgttcgttggttacaccgatcctgtcctcttctttttttttcttttttttttgttgtagcattgatgtgaattattattgtagcttgatctttttcatcttgtttgctcttcttggtgaactgaaactttgttaagaggtgctgtttgtgaacttgagatagatttctgactttgtgccattagagtttcagtttgtgtacctgctgctgttgatgtacagtcatcatggtccagaagaattgttgcattgtcattactcatcactgtatcagtttgccttacctggatagtttgcatatgtaagattttaagtgttgttgctgtgttgagccagtgtcaatcacttggtacgtagat

SEQ ID NO: 9750 - DNA, 1011 bp, Oryza sativa
tagaaggggtgaggctcggaatctagatcgtctagcccaccaccttgtgtagctagccgaaagatccctgagagtttctctaactcgcaagctaatcaagggccaacctgagggagatttagattctgataaacaactagtgggatggaattcagctaaagagaatctgaaaaagtaaaaaaaaaagaactaacttttagcttttttttctatttttttttaaattctgtaactatagcttttatttggacaaaatgctaaactgtgaagactgaagagtaactttcaaattgtaggagaacctgcatcggccataacctcccccaaagcctaagaacgcgtgattaattagccagtaaactggggcacatgcagcatggagatcagcattgtactgctcttgcagctgactgaatccttttggtaattaattggtgctaccatacacattggccgtcagctttgacgcctggtgattcttcagcttaaattgcccttcgcccagggttgcaatgcacatgtcagcgtcgtcgtgactgggcgctgccgcggatgattaaactaatccgagtcagatccatggatgaccatcctcagacccaggcagctgcaaccttccctcttcacttcttctgctttgccatggtcaatgacgacctgaccttgacctagttgttgttacttctagtagtaccaaatgcaagcctttagccttcatcttcccacaggagagttgataacaaagtcgttaaaagttggttaaattttgccctcctgtatctgcaagacggcaactgtaacttcagttaatttgtttagttgatgaccatgtgggctagtgaaactaactgcattgattttttttttcgttagaacatggattaaaagagggatgaccacaatcacaaaaattctcgaccaaccgagcgtcgttttatataaaatttgatatatttttttctattttctttcagcgtcgtatcgctgtcgacactgaatatacttaaattg

SEQ ID NO: 9751 - DNA, 10953 bp, Oryza sativa
atggtgcatcacatactcataaatataatagtctcatccaataaatttttacattccaacaatatacttcattaatttattatgtttcttcatagcaaagggcaaaatggactttttcaaaagaatttaacggtcaactaacggtcaactagcggaaagggcatagaagggatccaaactaaaattcagggatatgtaagggattgagcaaaattcagaggtatagaagggattaagtaaactttcatgggtacataggggattttctccaaattaaaaggaaattcacaaaaccagtctagaaaaacgaaaaaacaaaaacaaaacaaaagaagatcatatcaaaatgaacgcaaggatgggtgaaagcgatgaggaggaggggggcgcaattagaaagagacgggcacgttggagtgatcccaacagccagaacgcggtgcatcagcgatggagccatcgcccatgtacggcaacgctttctttccacggactccacacacactgacacacactcaccccatgaaagaggataaaaaagcaacgtctcacctcacccttcctctctactactgacaacaaaacccacacagcttgccttggacaccaaattggatctcgacgtataatgaacacagatagtactaccccggtctttaaaagatcacagttttataatgtttatgttcaattttgaccatttatcttatttaaaaaattttcatcattaatatttttattattattagataataaaatataaataatactttatatataattattttttaaaatttttttataaatttaatacgaacggtttaacgttgaatacgaaactcacacctacatttaaaatgggacggatgtagcacccagcatcagtcacactacacagtggggccctatatcctactggcaaatgccagggaccgctaccatgccggattccacgcgcggcaacacaaaactggatcaattctatgggctcgatccatcgatagatcgatcgtttggttggttggttggcgtgtcacgtcaggtaggccatttgcccacttcccgcctttaacgcgagtagctagctcattctggccgacccgacccatgcatctatccacatgtacccaacatgcaaatggatgaaagaaaaagaagaagaagaagaagaagattcaatcggtgggctctgcacactggaatgaatcgagccgttgggtacagcaaactccggccgaatcttacacgtggtctcccacacatacactcatcgcaactgaatatgcaaacgtgttactactgtttctgtttctgtttctgtgcaaatcaaattcaaatctctacaaattcgacccaacaaaagtatgctgccaaactattgttctcttgaaatgcagcctgagaaatactaccttcgtcccaatataaatacaattgtggtttccgtgtccaatatttgaccgtccatcttatttaaaaaattattaatattttccttattattagatgataaaaatgaatagtatttcatatgtgattttttaatttttatacggagttgctagaaatatggcgcaatatgctatagtcgattttttttccgccacttacacagtagttacacctcatttacaccccacttacatatgtaattagtatgtaattttcaaatttacatatgtaattttagtacttacatatgtaattttgagatttacattgtaaatacactaaaattacatatgtaatttaggaacttacaatgtaaatacatgccgactattttttgatgaaaaatatggcgccataaatatagctacaccctttttataaactttttaaacgggacggacgcttaaacattagatacggaaatacacgattatgggacgaatgcaatgaaacaagaagtttggaatcctaccttgaatgtgggaccggttggagaaagcctttcggtgtgctgcatgtggggcccaacgcacacagctttattaactacagttagttaacctgacctaaccaccattccttgacacctgcccggaccagttctccgggcccacccccaaccggcagtaaattacggaactgccccaaccagtccctataaataaccgccaaaaccatttccgctcagtttgccaaaaccaccaacccggaagcacaaaaaccgccctctcctcctctcgtcgccactgctccccaatccacccgactccggcgatctcccatggcggcagcggcgacggccacgaggcggccgagcgggcacgtcctctccgccgcgcactaccgctccgcctccccgacgcgcgtcaagctcgccggcggcggagcacgcgcgtccgtcagcgtctcgtccgtgagccgccgctcctgcatgtgctcgccgaccaaccacccggggtcgttccggtgcagcctccacaaggagcagaagcggagcgttcaccacaaggcggcggcggcgccatcctccccgccgtcgccgaccagcccgccggcctcgggcggcgccgtcaggcttggcggcgcgaggcggatgggcggcagcgcgctggtgcggatcggcgccgtggagagcggccagtgggcgcggagggctctcgccgccaccatccgcccctcccccgccgcgcagcaggcgcagcaccggagacgcgtcgccgggctccgcccccgccccagccgcctctccgccgtctccatggccggcgaccgcgccggcgacaaccaccaccaccaccgataaaccccaattcgccgacatctcaaccaattgagacacatactagtagcatagtagtagtacataggaattattacatatagaaatttttttttctgtagtgtatagtgatgtgagaagtgagattaagctgaacatggagttttggatccgtgtgctgcttgtacattcattctgaaatctgcccatggttttggattaaatccattaatccttatgcctttcatgataagaagagaagaaaaaattggagatagtacgtgtctccggattacgcacacatatgatccacttttctgtttgtttgtttgtgtgtatcctcatctattttggataagctcagcagggatgacgtctcgccgtctcctgctccatcacgcggcccccgtgtgtgacaccttcggtcactcagaccaaacccgtcgaggttttttgttgtttagctgggtttgtgccctttgaattcagagcttttcccatgggagtttaatctttaggtgtttaatcttaggttatgtttagttcacgtcaattaaaattgaaacgatgtgacagagttaaaaatttatgtgtgtagagaaaaaattgaaagtttggagaaatagtttgaaactaaactcggccttaatcaccgtagaaactgacggaagcttgcacacaaagatgttgagacgcaacggtgggcgccgcacacaggcacacagttagcggccgccggctttttttaaaaaaaaagtgttttctttctttcgttttgttagttgagggagaacaatacttaaatcaattctgtttgatttctgctgtaataaaatacccccagcgttgcttgtcaatagttttgctgctcctagtttatagagcaggggggagcaccactccctgacacaagttgcaaatcatttcaacaagagaagtatataaaaataaaataaaatttctcgtgaagataccatgcatgtattcaatggaaaaccgaactttagtccaccattttttcaattgattctaataaaaaaggattaaaagagtaccaaaaaaattgcagaaaggctagtgccgtggtgtacattagacagtggagtagtagtgtagtactactgtattactactacgcaacaaacccgttgaatatccagctagcggttgaaaaaaaaaatgtcaagacgtctgcatcaaggagggggccatggcaagtcaacagttgactagccggaataacttgattacaacctccacgaccaagtaaaatcacccattatcctggttagttagttaatttggacctgatcatcatcttgcagacgcataaatggacctagcattagaaggacacacacagcttacccagataccagggcagatctaccacagcgtagtatacagtaattaatccgggcttgaattattttgagttaactcgatcgagatcttgacacggtcttgacagtacgaaaccggagcaagtttttgctgcgattggttctccgagttttacgggaggaaacggacttgattagtccaggtaggacgagattatcgtcgcgaatgcgattgatcgatcgaggcaggcagcaacagaaactgggaaagatcgcccaaaaaagtgtagttaaattgcctgggccggaggcaaccagacagtgatccgagtcagtgtaaattctgttgtaattattatttttttttaatgcaaatccacagtacaactccatgtgtgcttgattagttaagcagcatgatgagaacgactttgattaattaatcgtgtctgattggtgtcatcagacagttttttctttagataattgctctgcataaagttggatgaagagattcgatgcgtttttagttttacggttttaaaatattgggctcggattagatcttgttggaagatcattattgggatggaatcatggaataatggagttttagtgtgtgtccatgttcatggatctgcacgttgtgtgttgtttgtttctgcctgctgcacaagggcaaccggggggcaacaaattaattcctaatcgtgtgctgcattgacggctagctgattaattcttcaaaccatgtttgaaaaaacggggattccgtttgaattagcgtgtttcatgacaaaatttcttgggcaacgtgacagtttctccgttggtacacctgggaggggtacgtggattggactccgtacttagttttaagtgtttgcaacacaaagtccatttccctcaggctcaggtcactgacttgcaaacagtatacttagattaattagaacaagtaaggcttagctagcccagaaagcagggcaatcaatgaacctaatttgctactacagtattatttaaggtctggtctgaattctaatctctctagacgatatatggaacatgtaaaacattgccctagtcccctagcatagaacatgaaataaaatgtatatatgtgaacgattccggagaagaagtgaacagtgctgcaaattaatggcgatcggtaagtactggtcagagttgttgctgtcaggacagcaattaacagtagcatattctgaagcacaaaacgaatgcaactaccatctcttcaagtttaactagctgaaaaggattgagcaaacgacataccaaaccaaaccggccagcatctttgccagcttaacaaccacggcccaacaattagctagctggcttaatccatcactatctgatatgtcgtcgaatccgaaccgtccattctgaatccaacgggccacgatgtggttctcggttctctagttcagctcactcatacaccatgtttgaagggttttgttttggccgctgcggcttttgtcaaaatcttcgactcacgaacagtcaacatttctactcaaattttgataatctacagctacagaaattcaataaaactcttatacatccctttaaatgggaaattattataaactctcgagaggatctctactcgttgtttacatgttactcaaattgttacgatttttttaaaaaaaaatcagcaagatagattaatctacaaacatttaaggtaaaatttaacttctacgtattgcaatgaaaaaacaaaattttctagttatagttttttttacaacttgtaaaagttagtgtagtggtatattacatgttaatatacatctttttaattttttcataatcatttgaatatcatttaaacaacaaatgaatattccctcgagagtttaaaatctacgctccttaaaattctcactagctagctgtttatcttttaatctcgacctcctcgagacaaggccactagcagagagagccgctgcactctagcgtgcattagagtgaaacctttggcgcaagtgctagagggatgacgtatgaaaatgtttggaatccgcaaaccgcgttcagatctcgacgacgacgacgaacaaactgcgttgtcgtgtagttgctcacactttccagcaggcgttgcggatgatgagagagagagagatgctgaaatgcgtatcgatcatatcatctcgtgcatcatctagtgaggcttgagctgtgttccatgccgtgcttgcacgtaagcataaacgggcagatcgatcgatccccgtatcgatcatatctcgcgtccgtttctttctcatgatcgatcatctcgacgcttcgaatcttggatgatcgccaagcgtcttcagatcctctcaaactcagaactttttagttcccaactttttttaaaaaaaactttcaactttaaactttcctacacacaaacttcaacgtttcggtcaatttctttaaacttttaattttaacgtggaactaaacacaccctcaaacgttaattcagagatgagataatctcatctcatgaatcattaagagccatcgttttgttattcatgcggcttatctgaataaaacttttatatatgtgttcttaacgatctaaaagtaaagattgaaaaataaaatttgatgaaaaaactcaaaatcaactttaaatttaagattgaaaattcaaattttggctgataagtataagcatgagcgaaaagatgatgcattttgtcttctttgatttattcatgatttcttttcattttctaatgaggatgaaaaacttgtctggttcatttctttattgcggagaagtggcccgagtagtaattgcaaagtaactcaaaacattttcaagctgaaactaacccaatttcattctctaaaactgagtaatggggattccttataataaaaaaaaagtagcagcagcagcgaaaaggcaggggaaacttagccgcgtaggtgaagtcaagagacgataatcaattaaagatgggggcaaaatcatctcgaaacttcacggaaaagaacagtaaattactcacagccacagacgctgacacgcacacataaagagcatttgctttcaggccaagcttcacggccgacctgtgaacatgcgcctctccacggagctaaacccatcatttttttcccacttttttaaacaaagattttcttttttgaaaagaagaggaagagatcattaaccaaccaactgaaaaaaaaaatcaagcatgcatgcttgatctgcatcagtaaaattcgcataactgaacaaaggattttgattgaatttaattgaactgatccattcattcctctgaggaaaaaaacacacaaaggagtacagatactagtagagtagtagaaaagcaaagagcacatcacacatggcttcctagccaagccctggatgattctgattctgattaccctagctctagtgtcactcgatgcgtacgcgcgaaatagtggcgtactatcactcgatccgaagaggtcgtcggtgatcgtcaggaggcgcactggcgaagcctggaagggcgaggctggaagtcgccgcggcggcggcggcggccgccgttgctgcagctgatcatccgaagcaggtgcgcgcggaccgaccgcccccccttcgccctggcgccggccgacgcgacgccgcctgacgacggcgacgacgacggcggcggtggtggcggggaagaagaagaggagaggtggcgggcgcgtgggatcgggcggtggcggatgcagcggaaggagcccgggtggttggtcggcgagcagaggcacgcgagcttgggcctcgagctcatggacgcctcgctgttgatagcagcagccatgtctgtggcggggagcgcggcggcggcggcgatggctgggctggcttcccggcgtcgcctcgggtccggtggttttatacgcgcgaaaggggttgggttctctctcgaggcttcccttcgcatgggggagcacgtggtgcgagggaaggcgtgagaggtgtaaattaatcactagtggcacgttgacggaccatcgtttcgtttattcgcgaaccgtaaatgaaaagtaagagtgaataaaaacttttatatgtgtttctagtgatctagaagcaaagactaaaaaataaattttaataaaaaaaatcaaaatcagctctaaatttaaggttgaaaattttaaatttttacggataagtattagcataagcggaaagatgaggccttctcctgcgcctaaattctcctccaaagttaaccaaactctacggtagagtttgagtttggttgctgggatgggatggaatggaacaggatgaacccatttttagaggtgtttggttgaggggtgagtgggatggattggtcctggagaggaatattcttcttagatccgggaccaactgatccgggaaaatatgacggaccaacttgggatgagcaaacggcgtcacaacggcttctcgcgtgctcgccgccctgctcgccgcttattgtccgcgtgctcggcgtgatggtggaagacagctcgtgtgacagcaacggcgacgggctcagcttgggcgacggcgacgatggcgggctccagtggtggggagggcgagggaagcggcggcgggatcggcgacggcagcgggtggcggggtgctcggcgacggcggatccagcaatggatcaggtgcacggcatgagcgtcgtcacttcttctccgcgtgctcgtcctcccgctgctctctcgcaagcagccagcctgctcgctggccgtgctagctctcccggccaccggtcactgccgattggtccgattagagcaggcgatggtggcgctcgacgaggactcgcgctacctcaccaaactctcttgacggtaactgcaaacggcggccattccatcccttcctcgccccttctactaaacaaaaaaaactgggttcattccatcctttaaatcaaacatacgaatggaatcatctcatcccaaaatctggaatggtatcatcccatcccacctagtcccagaatcaaacacacgctacaagattaggctttggtttcaggtttagggtgtgtttgttcacgctaaaattaaaagtttaattgaaattgaaatgatgagacggaaaagttggaagtttgtgtgtgtaggaaagttttgatgtgatagaaaagttgaaagtttgaaaaaaaagctggtaactaaaccaggccttagttagggtcgtgtaagctacggtttagccgttcactttgtttgatacagttacggatggagtaatattttctttaagctggatgtttttagttttacaaatctaatatggatctgaatatatgatcatataataatattttgataaactattctgtttcacttataaataatttagcatacaaatttcaaatccagtataaataagaaatgtgaagttgtactaaacaggacctgtcttcaataaacgtatgataaaaaagattacggataaaacatttatatttataatcttttaacggtttgaaactttaaaagcaaatgttgaaaagatagacttttatgaacccctaaaatcaactttaaaattaggcttcaaaaattaaattctgtcaacgactgattaaaccaacgcaggcttgacttcttttctgaagacgcaggaatgtcgattggttttcagagtttcttcatctttctcttaaagttcaagaagcttgccagagctaacagctcactttcagcttgtaaaattcagcctctgtttcggtattcctccctccgtttcagaatataagcaattgtagcatttctcacatttatattgatgttaatgaatctagacatatatatctatctagattcattagcataaatatgaatgtaggaaatactagaatgacttacattgtgaaacggaggaaataattccttatgcgtatatcacaaaatgtaacagtgtgtttaatctgaatctgaatctgatcttattgcacatttgttttgtctgttaacgatcagttgcatcggccgtgagtcagaaaggctaccttttgtgtaggagttggaggctctgtgcctaacgttttgtcattatttttcagagagcaagtgctccatctcttggaatcttttcctgaataatacaaggatatgcatcccgtcattttttttcctgaaaaatacaaagatatgcatctcgtccttgtcatcacacactcacagaattagggaagaaagtccattatagtgttcgaattttgcagtaacttctaacatcttgttcaattgttccagcttaacagtgggatgctaaggtcctgttactcgtactttataagtacgcttctggactactaaacgatgtgttttgtaaaagctttctatgcaaaagtttcttacaaaatcaaataagtctattctttcagatttaaaataattaatacttgactaatgtacactaatgatttatctcgtttcgtttcgtatgccgccaaaaacccagtcaaacaactagttcgcacttagctgactcagcgatttgactaaatctgaacaatattctgctccactagctaactgaaacttcgcaatcttaacgtcacaagacactcccatcagttccatgattatggcatgtggttcaattacctgttggtgtagtttaatattggtacaaagacttggaacagttccttgtcaaatttctcttaagccaggtaggataggattagcgatcactactctgctagctttctatgacttagtttaacgtagcagtaattattggcctacaagtgaacacagtgttcttgaagcatacaaattgtctgtagttgtgtcatactactacatatttttctt

SEQ ID NO: 9752 - DNA, 681 bp, Oryza sativa
cctcggccaaacttaaggaggtcatactggctgattcccttactgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcatctcaacaaactgctgtcctaactgtcctagagcatccaaactgaaagtagagatgctgtcctagaaagctgaaaagcaggaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagca

SEQ ID NO: 9753 - DNA, 7700 bp, Oryza sativa
atatagccaggtttctctctttctgactgatggcatcatctctctgggaattttttgaagattcatacttcaaataagcaagctcatttagaaggacagaaacttcgattcttgcagattctaggacaagcaatacaaatctgcacaaatcacaaattgttatgcgtataagaatgtatatcaaacaggatacaggtgataatgtcaaactcacttatcaacaggcatcatattctggtcatcagggactttgtattcttctgacagccaattctcaccaagtatagacatcatgcactccgccaaaagaagagcttgcaacttttcagaagatactgatcagtgcaaataaatcagtgtcatgaaccatatcaaaagggaaagtaaatactaacactggtaaagtgccgttcttatatcctctgaaaggaatcctttcagagtatgatcaataactccatcgaattaccatatactacagtactgttgctcaaagaaatctacataaactttcttgcaagtttagaaaaatatcgagctaaatacaagaaacgaaatgatactctcctataataaaggtagcaactgaaactaaagaaacaattttaagaaaagagaaaggcctaaaattatctgaagttatagactagtactgcaaatagggacagaatagctagtgtaaagtggcacattaagcactttcagccttgctgaatgcagcagattcttaaattgatagtgtagaccaacgaattacaacttcacagtacacaggaaacaaatattgttaaaaacatgaagcagacataccaacacggttttggagaacggccgttatcccaactcgaatttgacatttccaaatcatggaaggtactgatctcaaagcgtcatgaagcggcttgttggacaacaaaaataaaggaaggagttaaacaaaagccactagaaaggaatcattaaacatcattcagaagggaacacaatcccacactttagatgaaacagaaagggaggaggtaattcttacagattccttttgggatagaagggcggtaagcatatgcagcgcttcaaatttaactgtagtatgaagaacagcaaaaagcctagcaagtgaggtcacctgaattgaaatgaaattgcaggccaagccatcacgttaggactgctaaacatgtgaagcataggaagattcacgcaaaagattccagtatgtaattcataccatgcttgtcatgccttgcagtttctccacggtcatgttgtctattctgattttatgaacaagtagctgcattagatgaatggcaagctctaagcaccttgaacctatgaacagatacaatcaaataactgtataaaattcaattcaactcagtaaaatacaatatcattcaaaactactactacctaaaagcacacaccaattaacttcaggactaaaagatagttttttgcctgtccatggactaactcatgtaaccacggtgtgagtaccaaatgtgaactaggttacatattcaataataattcttaaaaggtaaaagtacccagcagccatccaagtgcgcatttgaaatgtgagtgctggaacttgaatctattcccatttctcaaaggaaactggcaagttaaaactaataccatctgggaagtttgagatttggaggaagagcatatccatcactccaggttcacaaaacgtatgcgccccaccatctgaagctattgcaataagagacaggagctcaaaacattcttcagtaattgccagatcagacctgcacacgagttgggtagagtcataagcaaatgagttatgcagagcaagcatcccaactgaaatacagaatcggaggactactcaagcaagcatactcagttaggtagcattgttcacttgcacaattgcaaaatgttgcaacgtctgctgcttcaactacactggttttacctagcctgagtatcaatcagaacgtggtagatagcgaatttacttacgatttggagacgatctcggcgatgaggggcacagtggagacgaccccctcgtcggcggcaacctctgggaatcgagcaagcccggaaagcaccgtcaccgagagacgcaggtacgcctccctgtcctcctccttgccgccctccactttccccagccctgcatccaacaacgcgaacaaaaacccagtgacgaagaggaaccatgcctacactggagacaagcgctcccacgaggcgcggcaattctaccggtgttgaggaggcggcggaggaaccggggcccgacggcgcggtacacctcgacgacggaggcggcgtcgccggcgcggcagaggttggcggcgacgaggaggcccgccagcttctgctcgtcgcgctccccgcggaggaggcggaggcattcctcgaacgccggggcggtggtcggcgtctccgcggcggcggcggcaggagccggggtggaatcctgcagggattgaatgcagaggcgaggtgagaaggcgaggaaacgggagggttagggtttggaggaggaggcgcaggtgagcaccatggatgtgaggcggcgaacggagcagcgattgcgagcgggtgaggagagcggctccgccgccgccgccgcgtcgggactcgcagcgagcactggtcttgaatggaaacctcccaagagttcgaatgaaaggcggcgtggaggtggaggaggaggtggtggtttggcgagggtattcttgtcattgtgcagtatttgactcgttgacttccggcccagctactaaaatgggcctcacgtacacactctttcggcctaaatactttcggaaaaagtacaccgaaggtccctcaacttgtcatcaagttacaaaatcatcccccaaccgcaaaaccagatatccggcatcccttaactagtcaaaaccggtcacaatagatcattcggtggttttgaccccggttttatcatacatggtggcttagccatctctctctacctcttctcttcctcgattcctcctctctctctttgtgtctgtaggctagtcagtagggtgaggcgggagaggaggaggcggcgccacggcggcggcggcggcggctgcagtggggaagcacgacggtagcccggcggagttccgcggcagccaaagatgggcccagggaggtgtcgatgctaccaattttggtcgttaacaggaggtgacaggtggcagcgaggcgggaacagcgcgagcgttgatggggaggtgtgggcgtgcgtgggcgtcaatggggtgaggcgggagaggaggagggcggtgacggcggccgtagtggggaagcacggcgatagcccggcggagttccgcggcggcaaagatgggcccggggagacggcaggcggcagcgaggcaggaacggcgcggacccgtttgacatccaagttccaaccacttcatccccgttccggcccaactaatataagccgcatgtacttaggtactaacatgggccgcacgtacttggattcccgttcgggcccaaccaacgggcgctgtacgcgcgtcctctgtgagagaacagcagctgccgccgtcatgctgccgctgcggcgctgtcctcgccgacgcgccagcgaattcatcctcttgctcgccgtcgccggtaacaaaaggatctgattaatttgtgccatatataatcgaagattacaagaccatatataacactacagtagtactattatatagcagtactaacaaatcaacaatgctgactttcaggactgattttgtctgcttagtattaattaatcatcactaatcttccactttaataatgtgtaaactatcagttactagtatactcttctcttatttgctttattacaagctgcagcgatcgctttaatttccagtgatccgtcagcatcaggaaggaaggagctggcacgagtcgccacatgccattctgaagtgaatttgctgaaccggtaagccaagcccaagccaagctaagaaaagattaggcagccgttgcttgctagttaccccgcacgcaacgttgcataacgtagaaaaattaacattatacaaagtatagtatgtacctaccctgcattaggtactaagaaaaaaaaccatgaaaaattcaggggcagaacgaatcattattttgctccttgattcacgggacgcaagatgtgcttcattcttcttctctatcactggaattcccgtgctaatttatgtacaaatcaagttaatcaacgctaatttaacatgaaaaagaaatcctttttggcaggagatacaaagaaatcttgtggtactggacaattatttgttccagcagtttgttcccacttcaacataaaactttgccggaattttcgcctgcatagaacattacgcactgttcgaaagccggactgatgagttcatgtctggctgtctgaatttgatgaacgctaccggacattcggcatgaaaatagttccaacacgttgatggatcaagcgtaccggttcatgtatacccaaaaaccttgaaacatttttaatataattttcgttattaagtaaccaatgagaccaggttggttatccgtcaattttaatttcttcagagctgttccgccgttgtcgctgtcttttcactaagaaaattctggcaaactggacgttttggacatattaaaagtgttccataggtatgttttggtacttggtacatactttctagacaaaaaataaagggagggaatagttttcagttagttgcgatgtatcttttatggttgataccttatttatgtgtttttggatgccctgtttctgctcatctctgaaaacgacctgaaagcctcatttttctgagtttttgagggttaattgcataaagcaagaactgtggctttattaagaacccatttgcatgaaactggcacactgaatgttccattgtcaggagggcataatcattgtcatcactgaatattccattaacctttttttttgtcatcactgaatatgcagagcagaacataaatactgttctcatgcaagcaactgatcaccaattacctaattaacaactacaaaactacaataggctcaatgtttcagtgctataatatccaatgccaggttgtatgtgtcttgaggtataccttttctgttattctgttgtttgtctgaaactctgaatcatcctagttcagtagtacttcctgcctgaactaaagaaatcaaatggagtaattcattatagaactttatatcatgagaagcagccaagccgtgccaaaagagaaggtgtgcatgctctggcgttgttgcaccaaatgatgagtgattaagtactgttgttagtgttgtgtgtgtaggggcaaaaccagctgggccatgggatgtcgccaagattcgtgcgtgagatgcagaaaggagtcatgaacaaaatgatgccgggctttttcacagtactgacagagcccgccgaccaatggaatccttggcaaagggcagagctgaaaactctttgcacttttgcaggcatgtgttcaaagtctgaagttttacagaaattttcagattaaacagatgcatcttgataggaatatgtggaagtttcttcaaaatcagatgtcatcctgctaacttgtttccaatgctttggagtttggataggggaagaggcaggtagcaatctccattgtactgaaaaattcggataaattttgatgccagcctatatgtgctacaaaaataatcaaagctacgttttgatgctccatgatacatacatgttgcttgcacgcataaaaatgatgtgctatgcacctgttattgggtggaggctgcatgggcgtacatgctacggttgcaaaggcccatattttcagacaaattccagtaaaaaaaaatcctttctcatggcctaacttttacgatttctcttggacacatgaattttgtaggaaaacctgttccattcccacaaatatcagtaacatttttatggtgccaaaaagggaccaaactcttcatgcctctgttagaaaaaaaaacattacagttagcattcctaacctgggtcaaaagagagaaaaaaaagaaaaaaaaaacaggttgagtacacgatatctaactacggttgtgtcacatttttgccataactcgatcatttgttattgactcaactaacctaagtactacaaaaagtcaatgatttgagatgataattaaaaccatcaaaatcttctcatccaaaaaatgcaattaatcatctaatccacaactagtagtagtagcaggctggaatttacagcaattaaaagcgaatttatgaaggcgtgcaaaaatataaagcgacacaaaccccacatccacggcactttccgagctagttcctcgctacttcttcttctctctctcgttctccgacaagaggagaaaggaaaaaaaaagggagagagagaaaaaaaaacccagaaaagcgcgagccagatgggcgccgggagcagccgcgccgatgcgccgccgcggcggcgggcggcggcgcgcggcctcgggctcgggctcgcggggtgcttcggcggcggatcctctggggcggccaccggaggcggcggcggcggcggcgcgaccgccgcgtcctcctcgcgagctcacgaggtatcggctgagttgggataccggagggtgtcgccgttcgggcacgcgtggattagcctctgcggaggggggggggggggggagtggatggatttgtggttccggaacctatagggtgtgggattcgggggtggtggtgatttcatggcatatattttggtttggaaaaatcacggtgactgtgaatcggaaagtagataagcttttagaggttttagttcccattttttttgaactgctttgcttgttcaatgatgataggtatgggtttgactgaaaataattgtggtccttgctttgcatatatggggcatgcaaacatgaatatttgagtctgaacttgatagtctacttgcctagtgaatgctttgcaattttgcagcaaatgcaaatgaatggaggttcaacgggtcactcactgaatttatcgttctgcacttaaaagggctgcttctgagtggcaagttgaaaaaaaaaactttactaattttacaaacgttgaacactctctatgcttaattgccagtggattcataatttcagtcaattagatagttgcattcttgtccttcttttgtttgctggttgttttctgattccaaaaaggtactacctacaggtggaatcttggcaagcagctcgagcggttgctgagatggactttcgggcttctgtcgctgctaaggatatccgcatatcaagtgagtcagatccaagagtgcatccatcttcaagcacaataagtcatcatctcaggttcaatcacttaaacagtcacgaaaacaaggaagatgccctgggaacagaaatcgctgaaacaagtgttcgtcagagttcatcaggaaaggaagtcatgcctaggggaaatttcagtaatgaagttgcttatgctgagataacgtctagagaaggaatcagtcatattggacgagatattttagaacctgcagcaaacaatgctgagactgacacagtttgcattccagaagttggtggccccgtttctgaatctggtttctcctcctcacagagggcatctgaaaggatc

SEQ ID NO: 9754 - DNA, 1560 bp, Oryza sativa
agcagagaatatgtccccatatttagtgggacactaggtgagaattggtgaaaagacattacatgatgacatgatgagcattttttcaaacgatggtccagcgcgtgttagagattcaagcagcaatgaaatgaggaggagccatagaagggttttgtgggacacattttccagacgtagttcaagaggatatttagattctgataccgatgatctgggattttacagcagatggctagaccttggtgatgaactttttgcggatgagattgaggaggccggttctttcatcggagacgccatggttcaatcagagtaagccagtattcaagatctcgggtaattgtcatgcctattgtgtttgtgccacaattacacatttggaataatgttgttggtgctatcataaccaaaaggtggtcatgaaatgtaaacgtagggttacactggtttgaattgtcacctaatataatattagtagtacacaaatctgcaacaataataacttcctctcttatctgatcagtatatttataattatgtgaagtaaaatactttttctctgtctgcatatcccgtctcatgcaatttcacactgtccgatgtggtcttactcctggttcattgatgtgctgaaattgctgttacggtctagtgtcagcattatctgccgcttgatctctcatgcaaacatatcattaacttggtaatgttttctgttacagattagggagcatcggcgtgctgtttttgatagcggtactgaccaaagtaccgttgcttgtcctttggggatccaccaaattggcagatgcacctgtgattccttcttgattgctgaagaatctagtgcccgtgcaagtatatcaagaattgtcatgttaaccgaggcattatttgaggtttgttcgttccctatctttctaaaatgtagctccttttgtatcagtattctgatgatactgtttcttctgcatggcttacctattgtttgcgtgtgtgttcttttttatgtttctttctttttttttgtgtgtgtataggcttggccagcccaaatcattgaagtattgagaagttttttttgttctgtatattcaggtcttattcgttaaataataattcccagcattcgaactatgcacacttaataagatagtgatacaactgaaactatctatgtgacgaagtcccttagctgccattatacttttgcggatgattgacctccagttccatccttcaagttcaacctagcaatgctgtagtcacttatactcaaatttgaaagcattaagttaggctgcatgaactccaagtatgttcatgatttaaatttgatgttgaatacattggtcatatcaacatgtttaaatttgtatcacctggcaacaacacaatacagtttgtcatagatgtagtatcaggacaacaatattttgaaggcagtgtttcatggctatattgtgaagccaagactgagcgagaaaagcaagaatcaaactctggatttccaggcttgttatggaacatatggggaaattagttaaactaggaaag

SEQ ID NO: 9755 - DNA, 741 bp, Oryza sativa
cttgcccggttgtggttgtcatgctggctgccactgacagcgcgggcccacgtgtcagggaagcagggataaggcgcgcacgtatggggcgggaagggacacgcgtgcgacgcagggccaaccgatcgtgtcgagtccgcgtggtggacacgtcacttagtacgtactagtactatactgtatacttacatcggctgtcgatcgatcggccgcgtactccctccgtccaaaaaaaattaacaacctaggtttccatatctaatgtttgaccgtccgtattatttaaaaaaaaatataaaaaatttaaaaggacaagtcacgtataaaatattaatcatgttttatcatctaacaataataaaaatattaattgtaaaaaatttttatataagatgaaaaatcaaacgttgaacgtagaaattcaaggtttgtctttcttttttttacagaggaaggaagtacgtattcgcgtgagtagaaaataataaaatttactaataaaatagtcgcgcttgacacgacacggcaaccgaaaatccgaaatatcccgacacgttttgctcgctagattctgcatgcaggcatgcgtacgctcacgtactcctatcctagtacctactgtgctgcaaatatactgtatacgtacacagatcactccatatgtcccttttaaaaaaaaaacttggaatgaatctgcagtctaaacacacgtgtgttcagatttatccctataaattaatt

SEQ ID NO: 9756 - DNA, 1662 bp, Oryza sativa
  unsure (1)..(1662): unsure at all n locations
aatgctatttctttcttctgtcattaagcccatcaccccaattatttctagcctttggatgatatagatctatggtgcaaattgtctcttctttcttctctcataacaccaggcaatctcaattatttttaggctcaaaattcataagtatcaatttgttttagtttaataatcatattgcatcttatttgtacatattatgcaacttaatttcccgcagcaatgcggtgtggtattcatctagtaattataacaaatattttaaataaaacaaattggcactgcatgcaggtgctgtatgtcagaccatccgtgagagcaccatcatgaaagcaattacaggattaaatgagacagttggcttagttttagactttctgcaggacgcaaaggtacatatatgatcagccagttatgaacttatgatagtatcgtaagatctcttacatgatgaagcattgcaggatcatgggcaaaggaaaggcgatgatcttttggcggctgtgagaatagtaggaaggtgcgcttctttgcttattagtaattgttagactgaccatgtggatccatctctgcattctattttcttaaatcttaagaattgctccttagtgttagagatatatggtacttcctccgtttcacaatgtaagtcattntagcatttcccacattcatattagtgttaatgaatctagatagatatatatgtctagattcattaacattaatatgaatgtggggaatgctagaatgacttacattgtgaaacggagggagtagttcatatattgttctgacttctgaggatgaggaagattttggttcagacagtgtagtttttaagaatgtgattgcttagaaaagatgaaatatgataacaatgagaaaaacaccgatggcttgagagaacttaggattcacgaaacacaacaagtttagttttccaatttgttttgtttccaaaggaaaagttgtgcaattcgaatttaaaacaggcacaaccaagataactgatagttttctagctgccgttgatgttgtcaatattattaactcgataaattttgcagctgtatactgtatagagagtagtattactattacctcgacaacgacataaagaaaaataatgttcaatgtaacatatgatggatgtttcaaacttccaagtcactgtaagttctgttgaggtctttattatcaagacctgactttttctgttaattcaacagctcctaagtacctagcactatcaaacgggcatgccaccaagaaaacaaaacaaaatatcatcgaaagtacggaccgagcaacaaaatctgaataaaacatcctaccaaagcaacaaatgtgctaaacaaacacaactaagtactattaccaaatactatatcaaatcagatagcgactactattaccaacaaaaatgaaatgatgattctatcgtggtacgctgaattaacaatgcaatgtcaaaagcagtaaactgaactaagtactcaccatccaacagtgcatccgagacctcctcacgcgtgacattcaacgcgcgcagcaggatggcgatgttctgcgccttcttggggtcgagcaccctctcctcctgccggaacgacggcactccggcggctttcctcccgacctctctcggcggcgcgg

SEQ ID NO: 9757 - DNA, 1048 bp, Oryza sativa
atcacccccaactctttctgcattgaacacatgatcgagatgctttgatctcgatttttttctctctctctctctgaaagttgataaggatcctagcctgcaatagcaagccacccactttaaatttctcgatttcagaaatctctctttcatacatgggctccacagcaaaaggcaaatcataaatcacaaattgacagatcaaagttgggctcgatcgagctaaacattccaagtttccaactcgccgtcagaagaaaagattctcgccgccgttccatgaacctgacacagctgagtttgacagatacagttacacatgatcatatcactgcttctcgtggatgcagaggccgggtttcttaatccattatctaaaaaaattaatcatatcactgctaaagccaccagctgcaggttgccaaatggaaatggtttacgggaggagagatggatcgatctaaattaatcatctttatttttggattgacgatgacacattccatacaagccatacaggctatgatgattacggccacgtgaacttcaggctgggagtattggagtagatagatgtatttatctacgcagaaaatgtcggtagattatcatcgcagctctctgaataatctgtgctgaaagctcggttactgaaaattcagagccaagaaactgattggaatctttgcagatctttgcaggattacgcgtaaagcgatatatctggtatcaattaggagtatcatgaaaggtatctatcttcctcttatttggattacacatcgtgtttatgaatgtgtttagatttgtacacagctaggcatgtagatacggtccaattaatctagccagatttacagcttaactgatcatcacttcagttcatacgtggggattaatcttctagaaaagatggcctttggagggatgaacgagccatctatctatcaattttgatggccttctcttttttgctgcgtgtgtgtgtctgtctaagtgtctctattctttaaatttgagacagctcgacgcttcttcgttatctgcg

SEQ ID NO: 9758 - DNA, 9817 bp, Oryza sativa
  unsure (1)..(9817): unsure at all n locations
aaaatcagttttacgtatacatattttttccagcataccgtccctgatgggggtttgccaattttatctgctttgttagtactcaaaccttttcagatctgtagaactgcttgctctgttcatgaacaagatgaagtgacacgaatccaaagtaagtttattattaactttgctctgctattcttctactcctgtgctgctttggtttatgttaggtctcaggatgctgttatgcttagcaccagaaagaaaattccagacaaagtaagggtgcagataagtaaataatggtgctgtattttcaatctttggttttaatgctggattgcttcagttgcataattttaggttgtaggttgtggatagaccaagacagagtatgcaaaagacaggtcactggctcacaatttgcctttacattttttatggccctcattgtttggcttatgcttatgcttataatccaaaatttgaattttagaacttgattttttggttttttcatcatagtttattttacatcatttgcttttgagtcgctaaggacacatatataaaagttttactcacaaatgattttttatttgttaataagtgattcgaataagcttatgaataagcaaaacaatgctagtttttcgtaccatgaggcttattttggtttttgcttgtttgtttttttcatggaacatataattttattagtgctggcgtcctttatttgcattaggctccatcaagtaggaggcacacaagcttggacaacagttgaacaacacattctgcaagcatcttgagtcttgcctgacaagatccctgcatcctatcaagatgaatagtgctcctgattttgcagctgaaacagcttcagttatgtcaccatcacggtagatcaattatgcaagtctgtcaggcccccaacatcaggccaaccgtgtatgcattcattggcagtatgctgaaaggtactgaatatatttctgtgaaatggtagatttcttgtttaaattcttagctgttattagacgtactagatctggagtgatcagtgatgcaacatctcattgccactgggaagcatgaagacaaggaaatgagtcaccaaaagataattcgctgctacagaaaaagcgaattaaaaggtagttgatctgctgcagtacgtgaatccaactgtgtgaatgttcctatccaagatggctttgattatagcgcatttgctttaacatcctagtggtgtactaaagggggaataaacatttccaaggatatatcatcttgccttgtgtaaagatacttggggcaggcttatatgcatgggtgattggattccatgtctagccatacaggcgccctttaggtatctggaacacctaacattaaccatatcctatttagcgtcaatccagttgctccaatattaaatcatcacctaaagaagtctccatctgagttgagacccttgatctcttatttatttatttactccttgcagggccagtttacaatacgtacattttcagaaagcagctccaaacaggatcttgcattggatttagcttcagcaggatgatatactgcaaaaaaaaaaaggaaaaaagaaaaaagggttaaatacctactcttgtttgagaaggattttaatgacagaaggattgcaatgacaagatcaggatcacactgtaaatggtgaaagaagagcaacagcaacagggcttcacatcatattcttattcaccaaatctctctttggattccagtcacatttgcccacccactaagggtgaccggtaaaaaatgaggtgtcctttctccatcttaaattcggtccgtggtatgaacccaagattttcctccccctctatcctggtttctgcgacaactcagaattggattgttcgtcgtgtaagatttttgatcacgtatttttgttttcgcagtgttgttatcatctgtctagtcaatgaatggtgctgggattacgcagctaatacagcaaggcagccagttggtgtgggtgggtgccacaaataatgcagaatggcagccacaaccaggatgctccaaagtggctggtccctgtcttgttcgccatgaacatgaaatgcattggaggaaagctctgttgatagaaacagcacacaaacacataatggaggatcaaaagcgattgagaggtattattttccttctttgcactaagtcaaaccttgttactttcatgcacatttgccagattttgatttgctgcaggcactcagtgtggtcttgtttgtggaaaaagatatgcgagtacgattaatggattcattttttttaatctcttgttctattccaatatgcatggaaagtacatcgagacagctctgttatcgccttaaaaattaatgcacaaataaacattatctttttttaaaaaaatagtaggaataataatgagaaatgtggtgatatttgtcacgtcaggttggtcataacaaaagttaaaattcggtagaaattcctctcacgtggggccacaggaatcacataaaaacatactgatatatcctatatccatcagcctacaggcagctatgtatagaggtagctgagcaattggcatggccatgcgttagagagagagagagagagagagtgcatgagcatgatgagctctccttctccctctccttaatttagacataaacttaattagctatgccgctcctctctctaatctcccctccaaagattatggttggtaggagatggatgagttcctgatcatcttcttgctctaaaatggaaggtttccaatggattccagcttctgaatcttgcagctagctaggtaggtaggtagctggtagcttagctaggcagtcaggcagatggtgtgttgttgcttctgctgtgatcgctcgcatacgtagataaggttagaggttgatcgctcggtagatggtactgatggccgggatgcttcccggagtggagtgcgcgcggcggcgacgtctccggcagggcggcggggaggcgccgtgcgggacgcggcggccgtcattgtgcctgtacgccggcggccacgaccacgccctccttggctcctccgcttgtaaggtagagatttcgagatcatgaactaatgttacatcttttttaaacacaaatacaggacaatcatagatcagatattgaatttgaaatcgcggtatttggaattggaattatgttgcagcagcagaggagcgcgtgcgaggagcagcagcccgggtggtggacgctggacagcaacgtgcgggaggcgaaggagaggctggaccagaagctgcggagccagagggaatccgccgtcgtcgtcgtcaagaggtgctcctctaatactccctccgtttttaaatgtttgacaccgttaactttttagcacatatttaaccgttcgtcttatttaaaaaattttatgaaatatgtaaaactatatacatacataaaaaagaattaataattacttaatttttttaataaaacaaatggtcaaacatgtttaaaaaaatcaatggcgtcaattatttagaaatagagggagtataatctaatctccttgagtttgactgtttactaataattaattttgcatgcatgcaggcataacaaagcgcaggtggcaggaacgagcagtgacggcggcgagcagtcaacggcaactacggcggcgccgcagtgggaggtgtacacgaggaaagaagggcggcggcggatgtggttcaggaggttggggcggaggccgacgccggaggaggaggaggagtgcgcggtgtgtctagaggagctgcgtgccggggaggcggtggcgcacctcccctgcacgcaccgcttccactggggctgcgccgtgccatgggtccagaccgcctcccgctgccccgtctgtcgcgccgccgtctacctcacctcaccggcgccggcggccagcaacaactacaactagctagacggaagcggatcctccaacgtaaactttctcctgacgcggttactgatatgtggacccgtgaacgatgggatctatatgtcagtcacatgttcctttgacttcctaatcccaactagacagcttattaaacggatcgccagttcgccgctgctaactgtcactggtcactactacccgcatcctttaattttgattgattccatcaacttaattatatatcgtcgtttcctctcgcatctcctggtctctctctaccatgcacatgtcgcctgcctatgctacagtattatgtctcgatcaaactctctgtaatagtgtacttcctccgtttaacaatgtaagttgttatagtatttctcacatttatatatttagattcattaatattaatataaatgtgaaaaatgttagaatgacttacgttatgaaacgaaatgagtacgtcgtacgccgtggtgttacgaaaattagacacgcggaattacgaaagttactatggaacgacgactaattttcttcttaatcgtggtaggcatggatgattaatcaactcatatatactagatgacgatacggaaacgtatacgatattagtatatttgttaacgaagttaaatccaagcttatatgtctccgattataaacacttctccacagtccacgtagcgtcttagccgctacaagcctatggtctcgtaaccattctcttgctacgtgtttaccctatattatcgtcgcgatggttacgtcggatgttgcaaaaatctctaaatttgtccatgttcagatgtgtgtctctctcccttatatgcctaaaaaattaaagataagagaaaaaaaagagtaaattgtattggtgatacacaacttattacatgggtgcaatttagtacataaacttgtaaaatgtttatttcagtacacgaacttgtctagttcatgcgaacgaggaccaaaataacttgacaatgttaattttatgaagtgatgttgattaggatgtggcgtgcatatgtgtagtgagtatgcataggacattcaatatttataaatttggtctctactttattcttcaccatggaaatgatgaatttcatatatttctaacctttataccattgctcgtttttttaatctttttctactatcactatattctattctatttttattgaagagatgtatgtctaatagcaaccttctctatgccctaaatcaataagattagcgatgtagtgtcattttcaccttcctctgcacgcatcagacaagtttatgcacttaaacgagcattttacaagttcgtgcactagatcgcacccacctgacaagttcgtgtgccggtgatataaattactaaaaaaaaaagtactccccctgtctcattataagtgcagccatgattttccacactcaactttgaccgtctgtcttagttaaaaaaattttgaaaaaaattaaaaacataagtcacgagtaaagtactattcatgttttatcatcacattaaaaaatatcaattataattttttttaaataagatgaacgattaaagttagatgcgaaaaattatgattacacttgaaatgggacgaagggagtagtatgcagtaggctcgagtaaaagcagaacaatcgcccagtgttcctctgaatcatcaaggaatctgagagctatggtatcatcgcccagaatgttcctcaaagcttcattgtagatctcaatcgccgaaaatttgtaaaggaatttcttcaccattatcggtactgactgacactaatctgaaaatcaaaatgggaaatagttattcatatccccatcaggggcatacattgtcactataagtgtaagagctatcttggacttgtaccaaagcatgagaaaaacaatttatcccttctttctatatattatactcaagacccaaagctggttgagccacgtcacctgttaaatcacagccattcgatgtaatctggacgctcgcaaacgccgccgaaagaagcaatcgcctcccccccatccgagagcnggagtcangcccccagcgcagcaggnggccccccgcccccanggnngnanngccnccntncncngcccccccccccccccccccacccagctgcagtcgccctgcgacgtcgcaccctcacgccccagcagccgcctcccagcctcttcgcctcctcggcgttcgatcctcgagtcccatctattcatcttcagttttttgaaacagtacgtcgcttgctttatactggccttctttcccgtcctatttactacgtatgatgatactgatacacacaacagctgaagaaaagtggtatacagcagctggatcaatctgctcggccagcaagtagcttctcctccatacaagcacatccctagattgatctgctctaggttgtccactgcttgccgatctcacatgttccagcatagcttctttccccattcagctaattttttttataatacatattgtttgatgctaattgtgtagtcacactaatttcttcgtgattcaattatcaatttccaaccgatttcagtatcccaaattattcccttcttttttccctgtataactgtatttgcgctaacagtttaattattcccttcaatttcttcacaggattaactactttgatttcgtcttgggtttattactagattaagtaatccacgaccattttacccaggttgttgaactattatggggaaatttcttcgacggtaatacgtaacaatacaatcctttttcccctaactatacaatttctattattatgctcctttgttttccatatttatttgtcatattgtgattattctggttaccttgcatctatcaagcacctttgtattttaaggttttagtattctattatgttacatggaaagtttagtagtacacttgctgcactgaatccctacagataattcctatcactgaacaatgtttagtgaatcaataattcctatcactgaatgacatttagtgattcaaatgacatttagtgattcaatgattttatatgtatcttgcatacttggggtactaaatgataagatgaaatataactgtagataattcccaacttatcaaaagtttggtgatcctttagtcagccctgtaagcatgtttcagtgaagccatggctcagatggagattctttttatcatgtgcaacacgatgattcttcaggctttggcaattctttcagtaaccatcaatgatgtaagtgccagctacagtttgtacaggtcccagtcttctttgatttgtttaccaaatattacctgacctgagttcacaatttaagtcataatagtatgatctcaaaattctcaaattaacttaaaatatgttactgtttattttacctcaaacttacattgattcatataacatgtttatcttcctcatgtactgagaaagcacaaagaataataaaaaaatggaaaccacaccactattctggaatggtatcatgagaactaatgagaccaacaatatctctacattaataaattatgttaattttcttgagttaattaggttgcccctaataaatcgatacctcaagaagcactaattaggttgcactgcttattcttcagatacagataatggtgagtttttgatcaagtttccaaaaagacgcgaatattagggaagaacctaatatttggaatgggtgaggcttcgaacccaggtcgtctagcccaccaccttgtggagctagctagaagatccttggtcgtttctcatcacactgtttcccccaaactacaaaagcaagctgttcaacaacgatgtgcttctaaaaactaaagttgttgaagtggctgacgccacgccggcactgatgctgagaggtgggaaaggggacttgagtgtggctatggatggtgcaggagagatcacaatcggcagcctctcctccctgatcacgtattgtagtcccggcttcctgccaccacgagatcgtcgaagccgcgccgtcaatagtggaatcagccattaatcggtgctaaaagccaagacacctctgaatttatttaatcatcaattaaaatattattacatgtctcccgtaatattgggaagaacgacagaccaaatcaatcactcgtaagttataaacttcaacaaaaggaaacaacttaaaaattgaaaggaataaataggacaatgtaatgcagggttggccattgggtgagaaccattaataatgtcgtcgctcagtcatggatgaaggaatagatggggaggtactacataatcatgcttgtttcattgtttgaatataagcgacgactttatcaaagaatacctcggcctccatagcatcagcttcgcaacttaatagggtaaacccctagtcgtgtgcttgaggattgggtagtcaagcttccgttgttctctgatatagctatatttggctggtcggcccatgtatctattaagtagtttaatctgaattttatttgctttagatgtattttgctatgtatattcatgcttaagatgaaagtgtgaatctagtgcacatcctgggagctagattcatgtgagtatgagttaaagaatatttgagatgttgtagatctttagccattttgtcaagtctcctgaatgtgtaacacatctggtcgccgccttcgagtggtttgatgggcacatctcgggctaaagttgactggcgggctaaaggtccagcaatgtctccaatattcttctctcgaggcgtcggatatttcattatttttgtttgatgacttgaattattcacttcatctctcaaatataatgggaggtccggagagcctacgacacagaaaaaacataaacaacttataaatggtcccggcttcctgccaccacgacatcgtcgaagccgcctcgtcaatagtggaatcagccattaatcagtgctaaaagcccaaacacctctggatttatttaatcatcaattgaaatattattacatatgtctcccgtaatattgggaagaacgacataccaaatcaatcactcggaagttataaacttcaacaaaaggaaacaacttaaaaggtaaaaggaataaacatgacaatgtaatgcagggctggccgttgggtgagaaccattaataatgtcgtcgctcggtcatgatgaaggaacagatggggaggtactacataatataatcatgcttgtttcgttgtttgaatataagcgacgactttatcaaggaatacctcggcctccttagcatcagcttcgcaactttctgcacacttcttgcttgtggcgggatcctccttatatactgcattacactcattgttgcaaaaatctatgaatctatccgcctttagatccttcactcccttatgggcctcaaatatagacttggtcttgatgaagcagaagtcttcacattgtttctcgtcgatgggggctttctttttctgctcactgcattcctctttgcacccagctctcactgcctcctctagcgtctctggctcctttcccatgaccgccacaagggtggcaaggagcagggccaccgcaatggtcttgttctgggccattagcgctgtttttcttgagtgtaattggtgtggaacaaagatgacttcccttgccctgatgtccctattatatagtgcatggatgagagtaaaggagctatataaatatgtggcggagagagcttcgtgggccaccaatggtgctaattataggcataatttttgacgtaagaaggtagagcaggttctacattataaccatttcattaatataaatcaggggttacatgatttttatcttaac

SEQ ID NO: 9759 - DNA, 594 bp, Oryza sativa
cggagcaccatgattcccgggtattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatcaaacacagcccaaccggcctatatgacccatcagacatcagttgatccacttagccacccctcttccagacggccccctctcgctctccctccatgacccatccctccctggctcggctccctcgcgccgctccccatttccaaaccctaggcggcggcgcggcgaggcggcaactggcggcgagaactggaccgcgctaccacggagggggaggctattgccgcggcgggcagcgggtggcgcccgccactccgccaagctcaggcagtcaggccggttgggtggccggcagccgcgaggggtagaagcggccaacggctcaacgcttagacgggaatacccaactttaaaatcctggctccgccactggtataccccgctagaatattaattattgatggaaggagacc

SEQ ID NO: 9760 - DNA, 458 bp, Oryza sativa
attgtaaaggaataagttcgttttgggtctctctatttgtcgcccagtccgatattcgtcccttagaccgcaaaaccgggtatgacccatccccaacttacgaaaaccgggtagacgaggtccctcggcggttttggctgacgtggcgcctacgtgacttgtttgactagttctccgtctcacgtggcattaacgtggcgcttacgtagcaattatatcttaaaaaaaccgtggacccacctgtcagctacacacaaaagaataatttaaaaatagcaaggcccacgtgggcccacatgtcagtctaactcaccctcctcttctgcttcctctctccccttctcccctcttcatctttcttgcgctggaggatgcggccaacgatgacgacggcggtggagatggagaagagtggtcgccggtaggccagggagctcgcctagccatcagccgccctt

SEQ ID NO: 9761 - DNA, 538 bp, Oryza sativa
ggggggggggggtctagctgctagctatccctggcagtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaaggttttcacaaagcgcgtattactattaccacgtgccgattggatcgagtgaacactagaagtaaaaactgctgtccaagtagggagttaagtaacacatcgcgagatccaatgacccaacaaaaccttgcagaggtttttgcagttgcatgcatgagtggcaattggctcttcggtttggtttgcatttactactatattcgcatcatcaaggattga

SEQ ID NO: 9762 - DNA, 404 bp, Oryza sativa
acatcaaaggttattttaatcggaacgaaactatcaattctatacagtagaatgaggtaaaaaacatcaacatttagctgtacctgtcaagcaagctgaggagaagttcactatcagagcgaccacattgactgtcagctgaaactgcacaaacttctgaatattaatgtacactgaccgaccccatttagcaacagtgactatagtggagaagttgtcgtcaagaataatcacgtcagcactttcttttgccacctgcaaacagatagcacagtgagaaattttgggagtgaaaaagtgcatagaactatgagggcatgaaatggatggtagtacaactcaagacaactaaattagcggctaaattgccacaaaaatacacttctaaaaaaatcgaagtgatg

SEQ ID NO: 9763 - DNA, 878 bp, Oryza sativa
attcctgcagccctccttgtcgaggtccttgaactgcagcgactgccggtagtcgctggtcgccgtgacgaagacgacgagaaggatgctggccacgatgccgagcccgtcgtgcgcgcccttgggccacccctcggtggcgatgccgacgacgagggagaagaaggcgcacgccgcgaggatcatcagcgtcatgtcctggagcgcctcccagacgaacacccagaagctgcgcgactccgtctcggcgaacctgttgatgccgaacagctcctcccggacggcttgccggcgcctcgacttcgggagcccgtcctccggcgaggtgcacagcttcgccgcgatggcctccacgccgccatgggacttgagcttcttgatgtcgtggctctccacgatggagctcagctcctcggcgcagatgccgtagcccgccgccttgacgtcgtcggggaccgtgtactcgctcgccggagcaagtcctgcaggatcgtgccaatgtcatgattgggctccatggaaaagagaaaaaaatgttgatttcattctgggatgtgattgtgaactggtatcagtatcgttcataccttggatgaactgaagtgcagcctttgacactagcacagcaactcgcagcttctcctgaaatcggtacagaaaaatgtgcattgatggtaagcctcgtgaattttacagtggaacaattgcatgaaaattcatgaaaaaaacatgagtttgctggcgtttaatcttccagtgctcaaagaacgtgcagttttagcagcagattgcacacaatgaatagtcgagctggctgaaggtttgtcaacacgcacactgacgcaggacacaggctgagtttctgtgtttagtacatg

SEQ ID NO: 9764 - DNA, 2227 bp, Oryza sativa
cattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgcgcgaggaggccgcacggggtggaagcctgaagcaggctagggcgagttcaggaagaagaggggaccgtgctcaccgcgccgccgatctgctcgccggccgcggacacgatgaggcgaggcggagcaggtgcacgacggcgcggagcggggcggcggcgttggagctctggctcaccgtgctcaaaagtcaagacaggcaggaggtcgattgtggggcggggccgtgcagcgctctgctaccgcctgcctgtgggtcatatgcacaggcccatgaggctggaaagaagaaatttttcatctcggaaaaagttcacctaaggtcccttttcttgacgtcgagttttaaaaccgttcctgaactgaaataccaagatacaatgtatgtcacatttggtcccaaggcagtattactctatgattttggtgacatggcggttgaatcagtgtggggcccacgtgagcgccacatgtcagccatcaattttcttccacctctctcgactctcttctcatatcaacccaaacctctagggcagccgacaacgggtggggagaagggtgccagccggcggggacaagctcgacggcggagactgccggctagtgtggctcccaatagccgggagtgctcgtgtcatgtacctgactgcgcacccaactgcaattgcaatgtattcacctgcacacacaggggctggggcttccgccacgtcatgctgcccaagctcttattccccaaactcagagccatctccactgagctgctcaaaagccgatttgtttaggtgtcctcgagctttgtctctcccccgcggaggcgcacgcacagctccactgcatcatcttcgaggtcaactccatttactccacgctgtggtcgcgtcatcctcaacgcttccgcccttcttcccgccacccgccaccgtcaagcttgtcgccggtcgccagccttctcccacccattgccggccgtcaccgtcaggcttctactggcgtcgccgcccaacggccgctactcttctcccctcctgttgtcggatgccccagaggtttgggttgagatgggaagagagagaagataaatggaataagactcagccgccacatcatcaaaaccgaggagtaatattgccttgggacctaatgtgatctgattttacaagatt

SEQ ID NO: 9765 - DNA, 517 bp, Oryza sativa
tcaggaatcttaatccgattattacgaaagattactcagttcattaattgtacattttttttgtacttactgttgctgccgtggagcgcgccttcttcctcgcgacgttgtccgtgcagctctcatccttgtgatcctcaaccttcctcttgcacgccggtgtcatcttggtggcggcggcggcggcggcggcgctgctcccagcgccgccagcatcgccgccgtgctggtcctcgaactcgaggttcaggtccaccatgaagctcgggtcggccaccagctgctcctccggcacgaagaagtcgccgccggccaccatcgcgccgccgtcgtagcacccgtaatgctgctgctgctgcatgtagcagtatggcgccgagccgtagtactggtcggccgcgtcgtgcgccggccagtacatcgccggcggcgccgccgccgccggctgctgctgctcctggtcattgccgaagtactgcacgccgagcagctgcgccatcgcctccgagtccccatt

SEQ ID NO: 9766 - DNA, 534 bp, Oryza sativa
ttttggagaaatcgtaatttgatatctgtggtacacctattcacaagtccgtaagttaaaaataacagggcctaataagagacgatgcacttaagtacttaacaagttaacatgcataacgttagggtattttgattttctcatcgtgcagcttggcgcacgaagttgagccctgagcctgttagtcgatcggtctacgtccatcggtccatgacagacaacagtgttgtctggttgacggctcatgcacttggacgccaccaccatcatgtgcaccccgatgctcaaaccagtacgccaccaatcaccatcatttgcttgcaagaaaacgacctctatatccagtcaagaacacgtactctttttcattacaagagtcacaaccgattagcaatcgtatagaagttttgttgtcacttggtcgatcgacaggtgtccacaggatgagaacacacatgacatatagtttatgctttccattaattgctaagcgtgtgagttagtggtgcattagtggagttaagtttttttttt

SEQ ID NO: 9767 - DNA, 285 bp, Oryza sativa
ggaaaaaaatgtttacaagaaagtttttcatcgacagcgagctgtcgagaaaggatgtgcagcaaagcacacgccccgacaccacacgccaaccacacagacacaagctacagagaggagagctgaacgccaaaccggccaccgctatgcgagaccggtcgccgccgggtatacaacaacaccatagaaaggatactccgaaaacaatgccttcacgaaggttgcgacgctaaaagacgctgtcgtcgcccgtccaaagaaattggacacggttttcacctagag

SEQ ID NO: 9768 - DNA, 711 bp, Oryza sativa
gggagtggatcaatctggtgcagaaatggagcatgaaacacgtgatgcctgtgagggtattgacgaggtttctgaaagtcaaagcggtaaaagcatgagctattcggcgactggagagggcacagagaatgcaaatacagaggcccgaggggcgtcttcatcgcagggacgcaatgcaagccgtggttcaggtgccgtgccgaagcttacaaagcgtaggagaaaatcatgactcatttgcagcagatcatgcctcgcacatcatgccgttttgttcaactgggcaaggtcacgtttcgatttgttcggcagccaatgagttgcgggcttgcggcgttgtcgtctgtaggccaagtctgaagactgaacaaaatgcaggtcggcattctgcacaccgttttcaggctttttcaggtttctgtccattgtttttctaggacagttatcgtatatcggtgtaaactgattgaagtgaacatttaaacctgacgtgattccttgcatcaggatgtatgtgtaacgcaggcttaccaacaaaagcaatgcacccgatgaaaatactgataaaattgaaatacacccaaaaaaactgacaattgttctctatctgaatatgtttattttttcatcaataagttcgattatacagtaatactatttgtttgtttttttaataaatgatgttgttgacttttaaaagggctgcaggaa

SEQ ID NO: 9769 - DNA, 1532 bp, Oryza sativa
atcatatcattgtttgataaaatttaaatatatagatacatttagtttgttacttaaatactagtattggtaacatataaaattttttggcacaacataattccatcctactaaatttggtaattctgccaacttaattaaaatttgacattcacaaatttttggtaaggttgtttttggcagtaataggaacggagtcaaatttaactcatcagctctcacatgctcatcggctcatcgcttgtgtggctccgaaactcaagaggctgtggctgcatcgcgtgcgagggcgagtgccacgtcgaaacgacgtaggctatgcagcttcctggccatgcctcgggcgagtctgccaccacacgctgccaggagagagattgacctcagctatctcaactaccagcggcttccggtgggtcgccgacctgaccctatcaagttgagcgatcaatttcgtattgaactctcagaaattatcagcaccaactttccgtttatgattagcagccaaaatttaaattttaggttaaaagttgattttaagtttatggttaaagttgattttaaggttttttttatctaaatttattttctatttttagatcgctaaaactaagacgacgtatataaatttttaattacaaattatttagaagttttaattacaaattatttatcgtttgcaaatacgcaatgagaacctatatcgccccaacccatctgaaacgtacccaaaacatcaggtggggataatcacctctactactgggatcgatcatactgagcaaattgttcagcaagaggacttggattaaagcaagatgcacctcaatttgcaagttgaaatattagattagacgccagcaatccgcctacccggttgcgtacacaaactaatttaagcaatttggcgattaccacatcaacaagcaaagtttatcatccgaataagaacaaatacacagcggaacttaagcggaaactgcgggtataacaagtggcagttcttaattaaatcttggtatgcatatgatgattgtgaagcaacctcgttgagaatccaagggtagtctacttattacttgcacaaagtaagaacacaaatccacagctaatcagcatgagaaaaaaaagaagataaccaaacatccactgatgtgttgaatgaaattcaccactgcgaggatctgatacatagttgatttgattacccgataagatctatatatatcttacagacgaacagaaagataacacctaacataacttaattactgataataagaactatatatgtcttgcctttgacactggacataatacctaacacgaatttagtgctactattcttcacctgacattgaactcacgctcaccaaaccacaaatcacaatcactaccgacgaattattcatctaaccaaacctctactattattaccactactgctgtactaacagatcagcaacaccaagccagcctaaatttccaccaaactaaccccaatttttcccaaccaagacaccacctaa

SEQ ID NO: 9770 - DNA, 330 bp, Oryza sativa
cttgtatgtgtaagccttgattgcctccccaatcacatccttgggcaccatacccttggtcttgattgctgttatgacttgcttgtatgaatcaatgtcgagatctgcgagatcctcgacccaccaatcatgcggcacaaactgctgcttcttgactccattccattccaaatcaaggccattctcagttgggagcttcttgcgattgtatgaatatgaccactcaaccttggaggtgtcagtggaggctttcgaagcaatggagtcgatgcagtggctaaccagcttaagatcctctgaccaaggcaagtgagcctttgtagtaccaag

SEQ ID NO: 9771 - DNA, 703 bp, Oryza sativa
ccaatcttcaccacgctatccccccccccaatctccactacgccatccccacctctgatctccagtgtgccatcctcgtccccaacctttgcctcgttgttgccatcccaaccaccgtgaccgcgacacgtgagggtgtagcggatggtggccgtttcgagctcaacctccgcatagctctagcttcgctttggcccaccacctccgagagccagcttcgcgtgcccaggcgagcttgcgttgatccgcctcctttcgagcaaggtccctctctgtcctacttctctagccaaaggtgcacagagagagagagcccattgatttgcacctgaaatggggagtggggaggattggcttgaggaaagatatacaagtgggcccattgattttttttaaaaataattttattgctgacttgattgccacgttaccggctatttatgcaaactcaagtcaaaactactcaatacagtgctcagggggttatttgtccggtatcaatagttaagggtgtaaaatgtctggtattcaagtttaggaggtaatttgatcgaccgctatagtttaggaggataattcatattttttttcttttttttccattacacaaaagacgtgtatgcaccagcaccattataactatacatggtagtaaatgtttccactaacaaacgtttaaaaaaaaaggtgaaggccaaactac

SEQ ID NO: 9772 - DNA, 719 bp, Oryza sativa
tcacatcgaaagctccgccacaatccaggtcctgttcagaacaacaggaggttaaagaattgtgcctccgttcaagttccgtaccatcaaccatcacgtactccgtcgaaatcgtgtcgtgccaggcgaagaagcacaaacgagctactacctccgtccaaaaatgtaatatttctagcacaatactttgtcttaaaataaagctatttttctacctaccttctcctctcaaccaatcacaactattctttttcacctactttctcttttcaaccaatcacacaccttcttcaattattctcacatactttcttaatactcgtggcaatcttaaaaatacttacattttagaacagacgaagtatcaatcgatctgaactttgcttgtcgtcggattatccagggcccgtccttctcatcggcggcgattttgtctactccttgtcgaccggcgagagcatggcgagacgacgtgcccccaaatctgcaatgaccaatgagctttcggtttatctcaccctggcatgcatgatgcatccatacatgcctcggtcttgggctcttggccatttggatcaactcaccaacagccaaatgctgaaactacgacagttcaagtaatagcagatgctagctgctggcctgctgcctagtactccctttatctcataaaaaactaatataatactgatgtgacacattttaagggctgcaggaat

SEQ ID NO: 9773 - DNA, 565 bp, Oryza sativa
atgtttaaattcgtagtcggttgctacattatgggacgaagggagtagcgtgttagacagagcgtgacatgatccaatgtaatactctctccgtcccataaaaatccaacttattatcagatgcgacatataaccaagatatgtcacatctggttctaatttgttttttacaggacaaagagagtaatgtattacagcgctcttctgttccataaaaaagttaacagtaggtattgaatgtgacacatatgcagattcattattatattagcatgtgtcacatttaattttagggttttttttttacttgagggagtatacccacagcttcaccgcgatgtacgccccgccagctcacggcatcgtttcgcgcccaaaggccaaagcgcgcggccgtccaagccgcgggtggcgcacggcacgggtcgtcgtcttctcgtcgctggcgacgcgcgtgcggaggcgagacggcggccgctaggcggctcggcgacggcggataaagaataggggaagagagggcgagggcggcggggcgcatgggtagcaaaactcgaaaaggcgg

SEQ ID NO: 9774 - DNA, 696 bp, Oryza sativa
cagctggaaagacggacaggtaggcccaccccatcaccccccatactgtgccataaacattacgctgcgcgcgtacctaaaaaagcagcagagaggaagaagaaaaaaagagtttgggctgaaaaaggcatcgagagccacgcaccggcagcacgtcgccggccatccgtcctactaccaccagcagcaacagcagcagcagaggcaggctggaccgcggcgagagagctttctattcccctctcgaaatcggcagcgaaagacgacgtcgtcctcgtcccacccgcgcccgcataaacgctacagtggtggtggcaccctgcaccgcccaacgaacgccaaaagcaggctgctcatttcaaaggcggaggaggaggaggagaggagacaggaaagccttccatccaaccatcgctgcccccttgccccttcttggcctcttgcggtgagcctctagcttactcctcctcccaatctctctctctctctctctctctctctctctctctatctctctctctatatctctttcttgttctagcctggtcgactcgtcctacctcactgcagcaacactactggcattgcgagggtggcgtggtgagctttgtgtgggcactcgaggaggcacgctggcccggcttcctgactcctgggtgctgcggccattggaggaggacggagtacaccaccctg

SEQ ID NO: 9775 - DNA, 665 bp, Oryza sativa
cttgtcaactgttctcttttttggggggtttacctggtagtagttttcatcagttcttactcttctctgagtgtactactgttgaacgtctgaatatgtccaagaaatgtgtaatacatcctgtttggtatgatcttgaataacttacaaaatgcagatgttaaataacagagaaatattctcctgtttggtttagtactgtaattatagaaactatatttctcgatcccattatataggcccatttattccaaatagcctagatgctagatgcacaaaatctactgttcatttaggcacaggctgcttgttcttttctcgtttcctgacttatcacttacgagaactgttccatctttgcagcattgtggcaactgaattagtgagcgatgtcactgttcgcatagggactacaaagttttaccttcacaaggtaaaaatgtccttcctttccattcatgcagcttttttttttcagagaaatgccttcataaaacttattgcaatagtaatttcttgtggttcagaagataatggcctcatgtaaggtttgatatttgcttgctggcatattctcttctctaaatgctaaaccacttataactagaccaaatgcttccattttttcttcttttgctgtttatctgtttattgaaaccttaagt

SEQ ID NO: 9776 - DNA, 1164 bp, Oryza sativa
atcccatactgatcgcatttcgtcacatgttcaccttttgcctacgagggttttaggtaggaatgggaacggtaacgtctttttcgaaagcgaatctcggtcaatcaaaaattacatatttacttttttatttttacgaatgatcatatttatcagtttaacgccaatgacaatacattactaaggggaattagaaaaggaaatccaagtttatatatggctagaattgtatcacttatatggaaatgatgcttgatctatcgggcatgactttcaggtgcaaacagctgttatgttaaaattcctatagactctggttgttgtgttcgtccagccgaaatctattagactactactcctagtgctgcctgcctgcctactgaccgtgaaacccacaggctcccgtgggcgaggctgtaaagcgacagcggccaaccaagccaccggggtccggagcacaccatctcacattctcaccctcctcccctctcgcaacgcactttgcacagcgatccgctgatgcgaacgctgtagtagttgtacaccctctggtctggtccctcggcctcggtctctcgctgtggataagaaagaaaaaaagaaagaaagaaagaaataaagaaagctggtgtgaagtggtgctgcctgcagcctgcccctgtaaagggtaaggtggcattaagaatcatcttctttcgaggcacacactgccaggattggaatggatggatcagtatccatctgcaggcttcaggcacagcctgaaatgaacgggattgattggcccatgccaatgccagccacgctagcacgatcccttggccgcagtggcgtttcggcgttgcattcaggggaccaaatcaaccaaccaaccaacgaaacgaagagccgcgggtgcacatgccgcgccgcggacatctcatctcgctcgccagcgttggcacgccgcacgctggccatcgaggcaggcaacggccgcatgcgcggtgcagcgaagagatctagaaacggaaggcgcgcgtggtctcgatcgatcgatcgggccgggcgctaggcgctagcacggcctggaccacgcacggcaccggccggcctccatcctccacacctcacacttgaccggatatgatattgcctgcttccttgccgttttctcctgtacgt

SEQ ID NO: 9777 - DNA, 361 bp, Oryza sativa
tttggttctttgccctttagccctaccacgccagaggaggttctctctttcttcttgctggtattactagtactgggactatcatgatcaagttcatctgtctctagaaagcttttccctgtaatacccttgatagctttcttaatccttttgctacgaatttttgcaaatctctcattgaatgagtaaaacgcctccatgcgtagttgagtctgcatgtgtgtgacacatgaaactgtaaaatttaaataacccaattttgcagactttggattgctgacattccggttaaatcactcttagttaaatgaaatccaagcagaaaagcatgcctattctattttcaaaaggcagcgatttc

SEQ ID NO: 9778 - DNA, 678 bp, Oryza sativa
gactcgacggcaaagctcaagctccccgacaactaagccagcaactgtccctttgggtgcacgatgaggcaagtcataccaccgatgcctgaattgtaggtaactgtccaggaactcatgcagggaagtattctgtgccactgggaaaaggtaacgataagcattaggaaaccattggtaaagttcaaatgcacgcggatttattcataagttaaattctaggagtgaaacaatggataatcacagatctaggcgtgtcctcaactcaagcttttatgttgactcatctactcgctcaattattgttcaggcttagtttgcataagaaaaaatgccaaattcctctgattgtagggtagttattcctgtcaatctgaagttcctgtcaatctgaagggactaggattaattccttcccattaaaactatttcaaaggatcataggtcatgatagtgataagaatatgattgcataggctttgctttgcttatgcaactactagccacttcaactgcaaatgtagtaataaatttaactgcacgcattttatcttgcgcttaaaagtgcaaactgacatttgaacaagcatacactagaattttacacataatccgtagccttagataatcacagagaccgaagcatcagaagatgcattcaacaaacacaattgaagc

SEQ ID NO: 9779 - DNA, 688 bp, Oryza sativa
ccgaccccagcattccgccggcgcctgacgcgccttccgggaacttcttccctccggcgccaccgaccacgacgacgccgacgagccccggaacgactccctccccgaccaccgtcgccgccgacgtctcgaaaactccgtcggggtccggctcgggacaccacggaggcggccctacgaaggcgaccatagtcgctgccggggcgggcgcggctgccgccgtcgcgctgctcggcttcgcctgcgcgttcctgatcaccggccgcgcccgccgccgcggcgactcgcagaagctgctcggccccgaccgtgccggcgcgcatcgcagcgccgccacctccgccgccgacttcctctacgtcggcacggtggagcccaccacccccgcgcgccaccacgggcccaccaccgccgatctcgtggggtccccgtaccgcaagctgcgcagcgagcgggcgcggcgcggggtgagccgcgacgaggacgccgaccacccgagcccggagctccgcccgctcccgccgctgcggcgcgccgcaacgctgggctcctccgacgaggacgggtactacacgccgcggcagctctccgggggctccggtgggggcggcgccgccgaggcctggagctcggcgagcgcgtccagcccgcccaccaccaccacggcctcacgccgcagcctccccag

SEQ ID NO: 9780 - DNA, 672 bp, Oryza sativa
ccgatctactgtccacatacccataaatgtgtcagagcgtcaggtcggttcttggatggcataataaacgcgtggaattagcgagattgcgacgtatatacagtagtcatactagtagcacggccgatccacaggatcgagctgcaggcataggctgccacagtgccacggtatcgtcagtcatgctgcactgttgatagtacaagtagtagtactcctggccaccgacatttctgcactgtccctttctgggactaatgcaaatgggaattgtggaattggcatctactagctggtatttcgtgtaggcagaaataatgcatattgctcctaaccacctctttagtactccggagtacatcggatgaaccaacaaaactaggattcttttgaatcacacgaattttgtaaaaaagaaagacttggaaagaaaatcacatttcaaaatgggttcagtcagtcagatgaccgttttagattgatgccaaaacataccctataaatttatcggtagctcagatcataaatgtgatagtttggtttgatgtcaactactcctatttggtaatgcctatgctttatttgacacaatttttaggtggtgtttgaatctagggacttaactttagtctctatatttagatcctaatttagagtattaaatatagacta

SEQ ID NO: 9781 - DNA, 664 bp, Oryza sativa
ttttttaactgcctccaagaagacagtgcgtgtagtgtagcactgtgaaaacctctgatgaaagtggagtacaagagctgctgtgttttgtgtggtctggatctttgaagtttttgaccaagggggtgtttgggaactagggactaaatttagtccctctcaaaaaaacataagtccctcaaacataagtccctaccacagggagggacttatgtttttttagagggactaaagtttagccccaatttagtccctccaactaaacaccacgcaaagaaacaactccccatgaatgatctgaatctgattcagatggctgtggatgaccaacccttgcactggattcctctagcccctggtgactcgtcgtgggcggtagcaactggcattgcggtcaaaacccaaaagcgctgcacaagcatgacatgagaaagagagagacatggtaaaattttttttttcatgtactgatctgttgtgttgggctgtcttgtgcctggcagcaaggtaaaaaaatgggttcaccgcggttcacaggggcatggctactggtggccgacgctgttggaattttatagtgggcagtaacatgcccagtcactggcttgactggtcagcagcattttgtattggcactgtgaagtggtgcagtagtgatggaagc

SEQ ID NO: 9782 - DNA, 685 bp, Oryza sativa
ggcgctataagaaaaataaaaacccatgtgagatttgtatgtcagtgaaacaatatagtattcttcttatttctctccccatccttcgggtctcgagtctcggcggcgacaaatgtgccggcggcgtgcggggtgaggacatggcggccggtgtgcggcgtgcctaacgacggcggcgaaggaggctcaacagtcggcggagccacgccgcatgcaaaccgagcatcgacgtcgctcgctcttcccgcggcggagtggaaaggaccgcgaccaacagggagaggagcggcttccacggcggattggaaggcctcctagtctcctcctatggcgtgctcggtggcggccgaactaaggagatggcaaagcccatgccacgcacagcggcgaggaggacgtacgtgcccatggcggagacgctgaaccgcatcgtggattggttgccggactatgacgcgaaggggaagaagtggaggcggaggacgagtgtaagttattttagaagacagagatccctataaggattgtgaagcaatggacaatccaatttatcttttactacctccgtttcaggttataagacgttttgactttggttaaaatcaaactgcttcaagtttgactaagtttgtacaaaaataaagcattttcaacccaagacaaatttattaagaaaatgggagcg

SEQ ID NO: 9783 - DNA, 422 bp, Oryza sativa
ataagacggacgattaaagttggacatggaaacttatgattgcacttatgggacggagggagtacaacgggaggagaaagatggttactcgccggagtcgatcctcggggaagcagatgtcgccggcgaactcgtggttgggctgcttttctatcgcctcatgggcccaaaatttgggcctagtgtggcccatacgaacatttccagcccagggtttatgggccggcccaatacgatggctatatatactacctcgagttgctggtccgagcagggagacacggagagcagtgagcagtgtccaagtcccgaccgcgccgcctccattcttccgccgccgccgccgccggagtcgcgatggagtggtcccggagcgccgagagtcggtaagaaggcttcgcgcgcgcgcgcgcgagcgctct

SEQ ID NO: 9784 - DNA, 659 bp, Oryza sativa
tgggctcgcggcggccatctcccgagctcctggcgcgggtggacgcaaaggcggtggccgaccggagcggcgccggcgtcgaggcgcatggcggcggatccggcgtcgccaccaccggatctggcgcgctcgcagctggatccggtcacggaggcgcgggcacggcgtcggcgaggcgtgggcgctggcggccgcgacaggcggtggcatacgcgacggtggcgcaggcacgggcggccgggcggcggcgtcaggcgtgacggcggagcaagcacgggcagcagcggcaggctcggaggcgcagctgctgtggccggtggctcgatgcctggcggcgacggcagcggtgcccccagatccgtgcctctcggctggatctggaggatgggagcagtcggcgacggcgacgacggtgtggcgacggcagcggcggtagttggccgatggcagttggcgacggcggtggcggctgtggtggctgccgtgtcatctggcaacggcggcggaagacatggcgtcgggctgctagctgttcggtggtggagggcgacggcggagcagcgatttgcagaggcggcggttggcgtcggtggcagcggcgacggcggttatgactctggaggcagtggcgacgtcggcggcggggaaggagtcggggg

SEQ ID NO: 9785 - DNA, 682 bp, Oryza sativa
  unsure (1)..(682): unsure at all n locations
tttctccatctttggttccaatttggcaatgcctttgaatcaatgtattgttttagattccagatatggatttatgtgaaggtgcactgttttgttatttttctttgatagctgtgtacattggaataaaccatttgttttcaaatgtatttgttctgacacttaatacattgagctgtatgctccatagaatgaaaatctaaaaagggttgagctactattctaactaatgttgcttatttcactatttttcagaaaactctgcacagtgcatggaaggaaatatcaaaattacgagacaatgtcagttctaaaaggagcaaactccagcttctaaaacaaaagctcaaactgttcgctattcttagaagacaggtaaaagagattatatctattattgttttagctatttatgcagtttgcactaggatttggtagcatttctggcaaagttgattgtatctaagtgcttctatttgacatgttcagatatactatctagacgagtggtctcatattgaaaaacatcattcaagtgctttgtcagcagcaatcgaagcactgaaggctagtactctccgtcttccagttgttggtggtgcgaaggttaggatttttttcataatacaatatagttatctgatatgatttgatatacccctttggatagttntaatgtttc

SEQ ID NO: 9786 - DNA, 688 bp, Oryza sativa
ggcgactgacgcgtacacgccccgccttgtgatcatgagccgccgatgacacgcgccgcccggctgggcgcccaaccaggaaacgacgagagatcaccgagcgcgcggcggcacgtcgttttcggcgcggatacgcggtcgcgggggcggatgctgttgccgttaactgctggggggccgggtgtcccgtactcccgtggcgcggagccgagcgagcgcccgagcgcgcgtacgtcggcatcagattcgtgcatgcgcggcgcttgcctcgctcgcctcacatgtcctttcgcgagtggtagcccgtagctagggagggcgcgatatactcctatcgaacagtagaggccgtaggcatgtcgtcgtgacaaggaggacgtacgatgcggtttgttttcgactactgttcaacggtgcatttctggtgatcgatctagtcacatctatgctcatccacttacagacaggatcgcttttcagggaattatttgagcaagatttctacactactgctttactacttttcggtcatggcctcattggagctccggtgtttctgtgtcaccgaaagatttgtgcatatatattagcttgtacacctagtgccctagttactgcatcagtctgtgggatgcagatcgtctgcagtactgctcattgatatatggatcccacagcctcttaggtc

SEQ ID NO: 9787 - DNA, 632 bp, Oryza sativa
atggctaactcacctccaccaaaacaagcggtatggtactaaaaatattctgctcccccggcggctctggtgtctcttctctgctttgcaccaatctcctgcatgggcctatagaagcagcactgttgggcctttcctgacgctagccacagcccacaacataagtcccattccggcccaactataacaatccacaatatactacaagtctgtatcctaaagtccaaatagtcgtcgcatacccgtacaatgtgaaccatccaaaatggaccaaccacatgtgaagcattcttccggaaggaataagtacatctgagatcccttaacttgtcaacgaatccgattttcgtccctcaaccagaaaaccaaatacaacggatccctcaactgtcaaaaccggtacagattaaatccctcgacggttttgagggcggttttggctgacgtgacgcctacgtgactaacttgactcagtattcatctgacgtggcattgacgtggcgcttacgtgacaattcgatctgaaaaaataataaatctagtgggacccacatgtcagcctcacacagaaaataataaaaaatagtgggccttacgtgtcagtccaactcacccttcctcttcttcctcct

SEQ ID NO: 9788 - DNA, 596 bp, Oryza sativa
atagagcgcgcaatcaagctaattaatcgatcggaaggcactaaattagaattaactactattatactaattttattttttaatatatagcgtcgttgattttttttacaaacatttgatcattcgttttgttcatttcctttacaaatataaaaatatttaaggctctgtcctcggcacacaaaacgaagcagcgttttagtgcgtgattaattaagttttagctattttttaaaaaaatggattaatatgatttttttaagcaactttcgtataaaaactttttgcaaaaaacgcaccgtttagcagtttgaaaagcgtgtgcgtggaaaacaaggagtaggagttggaaacttgtagtaccgaacggagcctaagtcataattaaagaatattcgatgataaatcaagtcacaataaaataaaataaaataataattgcatatttttaaataacacgaattgtcaaacgtatcttaaaaaatcaacaacgtcatatattagaaagtatcaagttcgtactatactatacacaagatcaatcattttcataacaaaacccttgtacatgggtagtcttttccataagggcaact

SEQ ID NO: 9789 - DNA, 4706 bp, Oryza sativa
  unsure (1)..(4706): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaatcaaaagccacctacatttcactagcagctagcaagtgtacacacatctataaattgtagtagtaaccaccttagctgaggtgatggccatggcgatgagaagggtggtgctggtggcggcggtgctgtgcgcggtggtcgccatggtcacagcgcaggaggcatccaacgtgcgcgccacgtatcactactatcgccccgcgcagaacaactgggacttaggagccccagccgtgagcgcgtattgtgctacgtgggacgctaacaagccactgtcgtggcgtcagaagtatggctggactgccttttgcgggcccgttggtcctaggggtcaggctgcatgtggcaagtgccttctggtaataattgcctcatctgatttttaatcaagatttttaactatagagatatggtttgtttatcaagaagccataagtaaagtaacaatagagttggtttacaagtaaaatttcagctgaatggcccttcccaacagagttaaccatctgaacatcatgtcatattgttgcaggtgacgaacacggcgacgggggcgcagatcacggcgaggatcgtggaccagtgcgccaatggcggccttgacctggactgggacaccgtcttcaccaagatcgacaccgacggccagggctaccagaagggccacctcatcgtcaactacaagttcgtcgactgcggcgacaactgattaagctatagctgccttagctaattaattactctccattattacatgctaataaggttgctgctgcatatacattattgtcgacagggcagagtagagtggtaaactctgcctgatgaataaattaagcagctgataaataattgtgatatgttgatcgatctgctcaagatctttgtatacatattcacaggaagtatcaattaatagatttctctcgagtataatggactctgtggatggaggtcaggctgaaaatgatcaaacaattcttaaaaaaatcaatggcgtcatatattaaaaaacagaggtagtatgacactgtaatggtccgtataccttatatcagtatatatgatgtagtgatattatctaaaaggtctataaaaattcctggaaatggataatctgcgactactaggttctaaaattcctcctgaaatgttctacgagttaggtcgaatgcatccatttttctgcctctttttgtccaagtgttcggacttgctgactccagacaaaagaaacgcaccgacccattggttggcagtatgcatgaaaattgtggaatgcagtgccatttctcgcttgaaagaatactgcactttggatgcgtgtggtctagtggttaaggtttgcattgcgtctatttgtccgatctagtatgccatcagtactttaaatataagaaaatctcggttatttaatagagtttaaggttgagatgaagttggtttgatgtactttagagtttattactgatttgaaaatgtaacgtctagccatgcatgcaagtaacactgagtaatagatacagtagttggataaaaaataatccaacaaactcccttatattcgtgaagaaatgaagaagtctaatcctcatatttaaattgtggaaggatggagtcatatatatacttccatatcccgggatccacctatcaatgagataataagtgacaaatgaatttaggttttatttataatgaaaattggttatatttatagcctctgtcactaggcacatcgcaccgggctcatagattttttttaaaaaaaaaactgagcgattgcttcatttgaaatttggaatgagcgagcctcaatccctgacacatcaatcacatgaagtgcatttgcgtaaacggaaagctgttaattttatcgacttcgcgtaaacggaaagctgttataatttgaccgacttcgcgtaaacgttaagctcttatcctgacgtcacactatagttctgactactccctctgtccctccgtcccataatataagagattttgaatttttgtctacactctttgatcactcgtcttattcaaaaaaatttagaattattatttattttttctgtgacttgctttattatctaaaatactttaagcacaacttttcgttttttatatttgcacaaattttttgaataagacgagtgatcaaacagtgcaagcaaaaactcaaaattccttatattataggacggagggagtattagacacgttgtaacaatctgttgcgtggattgttttgcttttacttgacatcaaacttatttatgtgagaagggatttttttttaccaaccaatatatgcatcttttttaaaatggaaactaaacccctcaaacaacctaaaataaaactaaaccatatgaaattcgctcatataaatatttgaactcagaattttaggatgctactcaggtcacgacaaccgctaacaacatatcatttagctaatgacatcaaacttgttgacttaaatatagatggtagacaatataccgtcaacacgtgacttggtggatcttaaaatatgtcggtccataattcaaaagtgcttatagagacagaatatgcatatgtacgttcctatataagtgagtgtgtatgtatatatataagtacctacacctatctttcgtttaaaataaatagataactatttccccttaacttaatcgtcggcgaagagctattttcgctagcgggttttaacccccatctctccttacaattttgcaaacgaagggcgtatgtcaccgccagcagaaaaaaacaatgtgtattaaaaattatttttctagtagcagtagaaagatctgcatgcttctcactccaacagtccaactcgaaagccaatcactgcagcagtcaaccaattcccgagaacttcactggaattaagacatccatgagacgtacatgtccattcgtgatcgtgtcggttcttcctcccgtcaaacacgacttgacctgcaataatttcaactaagctggatagctagtacacatattgcatccaccgtttgctattcatcagccgcgcgcagtccaattttaaagtttcaaatttatcgtagtttattttttaatattaattttatataaaaaagcatatataaaagtttttgtttataaattattttttaagtcgttaataaatactccctccttccctaaatgtttgacacctttgacttttttaaacatgtttgaccgttcgttttattcaaaaacttttgtgatatgtgtaaaactatatgtatacataaaagtatatttaacaataaatcaaatgatagaaaaagaattaataattacttaaattttttgaataagacgaacggtcaaacatttttaaaaaagtcaacggtgtcaaacattttgggatgaaggtagtattatgtcttataatcaactggtagtcgaaacggtaggttgtttcagtttctaactatgaacctctaaacataaacaatacttgtcaaagtgtatggaaataaaattttagtttggaacgaaggtagtagttacttgtatgcataacaatgcttactcatccgtccccatcacgtgaaaaaaaatcttttcttcacataaaaaagaaaaactcatccatccccaatctatatcatatctatcacatacagtcatacagatatgcagcaatgcaagctcagctagtcagctctcacagacaagtcgaaacttctatcacagatttctggtcgatggatcgagttagcctaacttctccgattgtacaagagatatgcatttgttcgcccaaaattgcggctgaatttgtatgcaatcagtgaatatatatccacgcaatttgtcaacttgaacacacaattggttttccttggatacatgtgtggaaatttcaccgaagttgattttcagaagcaagtgaaagagtcagccatgacttagacgcgtttacctccttctggctctatttaagcttgtggaatcgaagcaacctccatttcactagcatctagcaagtgcacaacacatctataaatcgtagtaaccaccttaggtgagatgatggtcatggcgatgatgagaagggtggtgatggtggtggcggtgctgtgtgcggtagcaactatggccatggcacaagaggcgtccaacgtgcgtgccacgtaccactactaccgtccggcggaaaacaattgggatttgggggccccggccgttagcgcgtactgtgccacgtgggatgctgacaagccgcttgaatggcgccagaagtatggatggaccgccttctgtgggcccgttggtcccactggtcaggatgcatgtggcaaatgtctctcggtaagaatgttttttttctttcttgcgttgagaaatgtaatacatattagatatcgagacaagcttataactttgaccattgtttttttttaaagtatat

SEQ ID NO: 9790 - DNA, 9379 bp, Oryza sativa
cactacaaaattagcaccttatgaaagtattttcaaataaaacttatgatgataaaatccaacttgtaaaactagttttacgatataatctacttagtatccccctcttacataacttacaccgattttaactacacgtcgtttcttaaaagatatttgctctggtccaacaaaaagtatttcaagataccagtatctcatggtaccaagatccaacgatcggaaacgatttggtaccatgaggtaccggtacctcgaggtacttttcgttggaccgtagcaaatctcttcttaaaaatctataaaaaaaattaaacgatatcgtattatcaaattaatttgcatgcaagtataattatactactcgcattcataaaaatatataatttaaaagttgtattggttaaaagtaaaatcacattggtcaatgaccaatgatgtcaagtaaaagggaaggctgagggtacaatcgaagggagtaattaaatgatgatatataacaaacttatctgtgacaggagagagtaaacaataaaattacacatgatcccccaagatatatgaccatggagtgtgtgtaatatttgcaggtgacgaacacggcgacaggggatcagatcacggcgaggatcgtggaccagtgcgccaatggggggctggatttagactgggacaccgtcttctccaagatcgacagcgacggtcaaggctaccagaatggccacctcatcgtcgactaccagttcgtcgactgcggcgataactagcagctaattaaccactcttataaacttccctacatatatatacacatttcggacagaggagtaattaatatatctctgcctgatgaatgaataaagtggctggtgaataattgtgatgctaggctgctgtagatcgatccgtttacacatgctcgaagtatcaataaaattgtgtggaaatgtgatggatttctgtggctaaaagcctaaaaagaggtgtcaggtttggcaagtttggcagaacggttcactagtttcgggtcaacgaatctgaggtcccgttcgaatcttatcaagatgaattaaaatcgggcacgcaacacgagcaagttattagcgcgtgattaattaagttataattattacaaacttaaaaattgaatatatttgatattttaaagcaatattcatatagaaagtttttgcacaaaatatgttgttttgtagtttgaaaagcgtgttaacgaaaacggagataaaatatttatctttatgagaaaagaatgggcctcagtgttaatttcgtaattttgtggctccgttccttttttggggcgattgcaaatttaccactactttaaatcgttattgcaaaactgccattagaaaattgtaaaaaatgacaatagaattgttattagtggcatccttgcaatattaaaaaaaggaaaattggaaccatgctattataattttgtaaaatttgagatatgccatcctgactcatatgtcattgactcatgtgagttctacatgtcattaagataccgatggcatatctcaaactttacaaaattataatggcatggttccaatttacccttaaaaaaccggtggcaaatttataaatttcttttttctgctctgtttgtggaagttttacggtctctgttttgatgtgtgactgttttgacttagctccaatttctgctgtagactctattttctgactattttgtctaagtgttcggcttgctgactccagacaaaagaaaggtcaaaaccctgtttagatgggactaaaattttttaggccctattacatcagatgcttggatattaattataaatattaaacatagactattaataaaactcattctataatcctggactaattcgcgagacgaatctattgagcctaattaattcatgattagcctatgtgatgctacagtaaacatacgataattatggattaattatgcttaaaaaatttgtcacgcgaattagctctcatttatgtaattagttttataagtagtctatgtttaatactccaaattcatccgatatgacagggactaaagtttagtccctggatacaaacaccacctaaatcggacgcaccgacccatcatgggtggttacaagattcatggaatgcaaattggagaatgcaatggcataactagcttcaaatactactaaacactactgcaattcttataagattaagaggaaaacgtgcacacacacgtgtcaccgtactcacacactcgtaaatatgttcttaaggcgtttagagggacatagactagaggtaaattctgatcttgatgggataaccaaatagctggtccagctgaaagaccaaatgtgcattccaaccgctataaatcaattgaactaggtgtttttttttgtagaactcggaaaaaaaaacagaaggtgatttcccattagcacagaggttctcatgtctcatccaccaggctatgctacttgttgcaacacataccgctttgaactggccatttaaccggtccaaccggccaaccagtgaactgagtttccatcaccggtccggttataataaataattttggttatacacttatgactctatgatcatattgcacatgtcttttacaattatggatgaatggtcgcgtagtcaaggttttcgtctcccataataaattacttggattgcgtatctcaagagcccacctgacattaagataataagtgatgaacaaaattggtttcttctaataatgaaaaagaatatacatgcctagggatggcaatttgaccagtttgtcagtttacccgtgggtaaaaactctaatagagttgggtctgttatccatttagtacccatgggtttcttattgggtcaaaacctgtacctgacgggtaaatgggcacgggcatgagtagcccgcttcgcccgtttacccatgaaaaccaactaatatgtgggccctcagtcaacttagtataaaatccaccatctagtattctagggttttcttccttcccttctcctttcctccatagccgccactccagggctctctccaggtcgccaggggcaagggcggcgccaggctgacacgagagggggacgtgaatcgccaccacctcccacctccggtcgtcgccggcggccccaccctctagctggcaactttcacagccgccacgggagggttaaccaagcaagctgtgaccgtcgccgcatcctacccaggctgcgtcgagctcccacctctagtcgtcgccggcggccccaccctctagctggcaactttcacagccgccacgggagggtcaaccaagcaagctgcgatcgtcgccgcatcctacccaggctgcgccgagctcccacctccgattgtcgacgtcctctagctgtcggttgcctccttcatccgcttgcttggccgcctcccacctccggtcaccgccgcctcctacctccactgcgctgagctcccccttcggccgttgaactgtgacgggtaaacgacatgcccacgggcacatggcacccgcgggcgacggtcatggacagtatttctttcctgtcatgtagcgggtatacccgcggacatgaattacctcgtgggcaagggcatgagtagtgcccgtcgtgcccagctgccatgacatatttggatttttttttagataatggaatataacatgccatatttggatgggcctcaattcccacccatgcttgtttacaatttacaaaccaacatcttagctccaaataaaattgacactaataacactatcttcgtaacagagagtttagtttcacgggcggagaataataataatactctgtcaactgtaaagaatttatataggagtactctggaggtaaaaggggcaaaaaaaaaagaaaaataatcatgcttgtccgagcaacaactatggtacactatttcggaatgcataaatataccatgggtgactgaaattctaaaattttcaattgaagagcttcaaagatttcaacgaattccgctaagtttgcaaaatcaaatagaatttgaaagtttcggctggtaaaatatcctaccgggaccctccaataaaccctgaaattttgcgagttttgggaatttagttcctgtcaacagctgccagtgccacacccttcccttacctctgaaacataggaaattttgcaggatttccatgagaatttttagtggccaccacatataaagcgaagcaaaagtcacatggagcctgattttttcccccataatccgtcaaaattccaagcactttgtacttttttgctgctggaattccagggcacagcacatcgatctggcccttgggcgattgacaattttgcgccacatagcagcagcagataaggttttggaacggctgctacacgtacgaaccaaaaggatgaccaagaaggagaatttgaagatttttttatagtattaattatgattgttgatcgaattcgtcaatggcaaaatcggcctggctctggctggctggctgctaattcattccagaaggtagccaggaatttggaggtaggactagcatttacatgaattttcttgaactgaagaacaatcatatcttgaggtcaatattgaagcacaagttaattaggacttcaatttaccaacttatgtgcgttctagctctatttaccaactccttgcctgtaaaggtttggagattatttggaataattaataggagtattgcttgtgttgatgtgtgtaattaacagatacttgtaatattaattctggtgtttggaacatgcgcttattgctaatgtgctacttacattcttttttttttcttactacccagtgctaaaagagtattacacgttaggtgtgtaccagtgcttcccaattactaatatacaggggaagagaagaagaaatgaagagtatatatgcttctcacttgcaaccatggaatggaattaagacacaaattcttcatgccggaaaattccacaatgcacggctctcacacccctatatatatggtcccaaagtttggtgcatactcccatctgcaacagagaaagattgtgccacagtacaaactacctcattctccatcaggtgcacaatagaagaaactaaggtaagcactacattggcacccattcacccaagatccctatttctctcttccaaatcttcctctagcatgaagataagattgtacttatgataacgaattatctttttatttatacacatgaatatttagattctcaaagtgatggcggggatcaccggatctcgagcactcatggtggtggcgctcctctgcgctgccgcggccatgactgctgcacaagaagcatccaacgtgcgagccacgtatcattattacaacccacaacagaacaactgggacctgaacaaagtgagcgcatattgtgccacatgggatgccaacaaaccgttgtcttggcgccagaagtatggatggaccgccttctgtggacctgctggtcctaggggccgagactcgtgtggcaagtgtatccaggtattaaaattttcttcacattgacaaccgatttgtacttcaacattaaactgagtcgcttaaggatggtgtgctaaatttgtaggtgaagaaccggggaacaggtgcgacaataattgcgaggattgttgaccaatgcagcaatggtgggttggatctggactacgagaccatcttcaagaagatcgacacagatggtcgtggctaccagatgggtcacctccaggtcgattacaagttcgtcaattgttgatttggtcatgcctctttgcatgatcatatactggaataagaaatatatggtgttatacaataagatggaagaggttggcactctgtaatcatgctgaataatgaataaacgaaattacagttcaacaaagattgtttcatatccttaaatttccatccccctgccctgttatttcatattttcgcactattgcgaaggccaagcgccagcatgtgaaatttcaatttatcgtggaattgatgcaacccacgaacaaacatatacacacactttaatgccccaagtttaagggctcgttcggtttagctaaaattggatgatggattatggattacggaggagatcaggtcctgttctaaacagatgatggactctaggtttatgataattattcaatggcacatacgaatgaattaaatcttgaaaagttgaaatgttgctttaaaaaaggtattatcagaaatgtagatgaagtaggttaattcagaaaaatcatatcgtttacaagcttgggaaggttgtgcgggataatccataattcatcacctatagcaaatgcacattaggtttttcaattaggcttccaaaaaatgcggtctccctaaactttttcaatcatcaattcatcataccttaggtttttttttcaaaatattgattatctttatatcctataatatttaattaaaccctataagagagataattcatcatccaccatttaatctgtttcatcacaagttttaggtccgttccaactaaaccttgtgacctaggaaatcaataagataatcctcacgtttgtgtccaaatagatatgcgtttatgtccaattagacatgcgtcgagttcatgccttcatggtgatttatcgtaagaactagtgatgttgagtgggcacacggacaaatacaaattgaccgactctaatttaactaaaatatatatcatcacattataaactagcaacaataatgtacatttttggatgcgaaataggacccccacgcactcgcatcctagtgaggatgaatcatttcagctttcgaaacataaacaaaaatgatgggcgagtaccatatggtcaggaagcacatgaggtcgtctgtcatacgaccagcaggagatatctgaatatctgaaagtcacggcgacagatcagagagcaatttcatagccgccattgctacccatccagagtccagagacgtacgtaacatatttttggcatataaaagtttcatgcaaagaccatagatatggcacatcttaaacacatacctgcatcgacccccagatatgtgcatatctgacattttctttcttcgtgctaagatggattctctgctgtccaaaaccaacaactcaaattggtttcttcagacagttcattgcatgcgtcggctatgacgaccagggctgtttcatgatttcatccagtgacacgcaaaaatgaggcgctgttgtgctggacatctttgatcggataacctgaattgagtcatgacggttgcttggggtcttggaatttggcttggaaagtcatatgatcatatcagcttggatggttgtggatctgcacttctgcagtacaggggttagagcaagaactgcagaagaaagaaatggctggccatatctgctgctcactctgaaactgcaaatagaaccattgtgtgtatctcctgacaacttctctaatgttttatttgggcctgaaatatctgataagagttcagacattcaacccacatggtaacacaagtcaaaatgataatgaatttaatatccatggaaaaataaaattagtctttggtatgaaaattatcccgtctcaatctggttaacaggcaaaagaggtgaataatttgctgttggaaatgtcagagagctgcttgtcaaaaacttcaatattattagtaaggccatagccggttttatttaaccatgccttttcttccttttgcacattttttttaacaagtggctaacaatgtgcgggtacaactgagtatagaacaagatgcttgctaaatctacaaaaagaatgaataagattagcttactacgtacgtattgcaaaaaccgtgtattcatgggccattgtgtgaatcttctagcttctactgcttctacatgtgaatgttgcactgctgcaagtatgggttgtcatagtcaaggaaattgttccaataatctctgtacttgggaatggagatctccagccagggtttgagttttccgctgtagtggatcacggcggccctctcaattgcatctcttcctatgcttctgtcatgaccaagcccaagaacatgccaccggtggtcaagaggcactgtttgattgtagaagacaatctggcccagtggcaagctccctgctttccatagtctccgccttttgccctgcaaattggcaattgagatgttgagaaacaatgttcacatagaatgctttctgtaaaagcttatggttctcttattaagaaaaaacttctggttactccatatagttacagtaagctagatcttctacacagaaaatgaatgtatattttggttcatacaaccagtttctacagtagagttgattttggaccatcttgaacagaaaataattgtgtgcttttgcatctcaaccagcattttaatagtcaaactgaaaattatatattttcgagaacctgatgccagtacccatgtgctccacaatgtataagctcccatacagtttagcattgccaatggacagtttaaactactggagtgaaaattcatgcttaaaatatcattaaaatatgcaatcaatgaaaacattgggtcagattagtgcgacaggaatgtacacttacagcttgaaaccacttattataagcagtagtcagcccctgcctgcgccattccttaaggtcaaagatgttcatcccaaatgcatgtatgcaagcctttgcatcaaatttgttgatgatacttggatcagagaaattaacaaggttctccaaccgatgataaccatcaccagaagtgcacgtctcaacagcaccatttactttaccattcaaatctatctgccataatccactcaagtctctttggactacaatgtcatggtccaagagtacaagtttgttcagagaagggaatacttctggcaaataaaagcgcaagtggttaagcgcagaagtgtatcttggatctcggatgcccttctgcttaaatctgaaactgaaatcagctggcagccatttcaaattatctaagctcttgatttgaattgtggctggatttggtgggtttgtcagaaaccacatcatcattgcaggaaaattcagtgcatcagtcacaatatgaaacattatccttttgggatcctgccaaacaaaataactaaaatcaaacacaaatttcaaggcatgaataaaacgcaagaaccgttatacaagataattcctagtgcaatccttgttagccatatgattatatgtgctgcatgttcatcgatcataccacaggaataaacgaattcattgaagaaaaaaaatccatcacaagcaagccttgtg

SEQ ID NO: 9791 - DNA, 2857 bp, Oryza sativa
cgtagatcttcgctgtagtttcacggaaggtgctgattagctctgcaagtctcctctgcttgacatcatcggggacatcatccacataattccgatgagcatgagtcttttctctcatgctatatgcaaacatgtaggccatatcatatccaacagcccttacaagggtaagagtctcagcatgttcctcttctgtctctccacaaaaacctaatagacaagagatttttttttgtcaaaatagaagtgaataatcattaacgaagtgcactcagaaaacagatgtgtaattgctaattgtaaaatggcaaattgtagaaacaaaatacaagtcacagcataactacacaagaaaactggtttgacagcaggacttgtcaaagtcatgtaacaaaacaggtgatagtgttgtagtattatagtaaatctgagtacactccaagaaaatgatgtgaaattctgaagcattttcaatttttcagtatgaataattaagggggtggaatggaactagaggatatacatttgaactaccatggaaataagaaaaggagcacatagaaataaatatagaatgtggatctggttaggccaaaaatatagtatggtcaacctagttctaagttgtacctagaagatattctcaagtgcaagtgacacatttgtgagcatgcaacaaattagtcaaacaggatatagtctcaaactctaaacatgcatgccagttttattcagttagtgatacttggtggtacttagctagcacatcattttccaactcaggttattatatccttactattatccacatccaatggagctacgacatatatggtttatcaccctttcttgaagcagccaaacaggaaataaatagccacattgctagtactttgtagaaaatattgcaactttgaaaagcaggaaacagatagaagatagaccataaggtcatacaatgatgatctcggaaaagtgacctaccacttatgaaatcactgcttaacccaacatctggaatgatactacggattttctgcacaagctccaagtatgcctctctagtataaccccgacgcatacgttccagcactgctgagctgcctgattgagctggcatatgaataagtttgcaaacattgtgcctatcccgcattaaatatagaagctcgtctgggtaatcctttggatgcggagaggtaaacctgaaccgcatctcagggtattccaaagataactgatccaggagatcagcaaaacgcaaccccatattcttcaccttgcacatgctagaaaacccttcactgagctcccagtttttaccaggttctaattcctcaacttcagaagtgtcgttataactgtttacgttctgaccaagaagcattacttccttcacgcctgctttccagagctccccaacttctcggacaattgaggacactggacgggacctttccctacctctagtgaaaggaacgatacaaaaggagcacatattgttgcaacccctcataattgatacaaatgcggtcactgaattgtcagagatcctaactggggtgatgtcagcatacgtctcctcgagtgagagaagcgtgttgatacccttctgcccataatcaacttcctgcagcaacctaggcaagtccctatacgcatcaggtccacagacaacatcaaccatcttatcagaatcgagaattttctccttcaatcgctctgccatgcacccaagaacggcaatctttggaggccgcagagatcttgaccgccctgcagcaacattagctttccatgccttttcaggaaccaaaagtagttcagtcgctgccagactttctgctctgcgttgtcacggattgcacatgtgttgataaatattatctctgcactctcagggtcagggacaatttcatcatacccttcatttttcatgatagaaagcacgatctccatgtcgtttacattcatttggcacccatatgtctcatggtaaatgcgacccttgcttgctgtcaccggaccagactctaaactagacaaaccaaaaaaacaaagcatggggtcagcaaagcttgcagtcaaaatcagaaaagagaagtatgaagtaagcatagtaaattggaacaacgaaaatatttgtgtaaagcaaaagaacaagtctttcaatccttcaaggttcagtgtcacaagaaagataactacctactacaatgaattaattgtagttattgccaatgaactaattcaaatcttttttttccaaaacagaggtgaaatatttcagcgcgatcagaaaaattcccaaggtaagaaaatcagaatatatccatacctaggcacccactcaacatggattacctagggtattaactataagacacaacaaaacaattcctaggatttacatttttccacataacacatggctttttactgttctaatttccatgcaatatctttaccgcactaaacgcaaattttagcactgactcaaccatttcaattaggcaccagaagattcacacacaccactgatcattacaccaccaaaaccttggaataattccacctagcaactcgcgccgcttgctaatcttcactgcacccacaatgtgctcaatcgatgtttccacttcgaataataacgatcaccatgttcatcaggccacaattctagtaaaacacctctacttttaacactacagtgcccactgtactacccgagcaaacctacaaccacaacaacagcaggaggaggaggaggaagtgagagggggtgcaaaaaagaaacgggcacattactctgtctgcgcctcggacacggccgtggcggcggatgcggcgagcggac

SEQ ID NO: 9792 - DNA, 2199 bp, Oryza sativa
aaacacacgtgcgctaattagcaatcccgagccctttagaggggctattcagattgtagccaaaataaaccttaccaaattttggcaatatcaaaattttgataagttggcaatattaccaaaatttcgacaaaatttcttactaaagtttgacaaaaaaaaaaaactaaatgtatgcacattttttaataactttgccaaaaaatgatgtgatttgaaatgacatcaatttgaacagccccaaaaggtaatacatggtttctttcatgaattatatccatttctcccaaaacatcaacagctgtacacaaatttcagaagcagtatctaaaccaaaagctctcatattctgaatttttcagaacacatcattcggttcaagaatatagacagaaaacagataatatatgcctaactggaaaagaaataagattttttcagcattgttgatcgtcatgcttggtaaccatgcactatctgaattctgacactcttatcaacaattacatgacttgctcaaggaagtaaggaacttcatcatgccgtgctcttcgttccttcttgcacagatatctgattcatgttaagaaggtgatgaaggccagcgatgacgtgctgcctgctagtcggtacgccagtctttgctaaggctcgtccattcttgtcaagaagcacaaagcacgggacatatctgatgtcgtaatgcagaagctgaaaatgtacgaagaaatgttgctgttagaaactggaaacaactcaacatgtgtatgtgagatatggcaatactatgacaggaatacaggcatacagctcccacgtgtatgcggaaagtgctaacatctttcatatgcttggtcagttaccatgtcttgcgacaaaacgtttgtcaaacaactagagatagattactagtagctagcagatacaatggttcagtaacagggcaagtacaacatgacaccataaccaaccatggttcgttaaggcataaaagaaaatgagaaagcaggcataaaagaagttgttgttggatagccaaacaaatatagaaaaggttaggagagtagaaaaaggaaaccagccaggatacaaaatgtaagtacaaatgcaagatactagataccaatataccatgaaaactatggtctagtaggctagtagcccatcatgtgcccagccatcatgtgttgacaagcagcagcaaggggtagcaaggagatgaatacaacagcttatatgtatagttagttatttactaaggattttacaatttttcagaacttttagctgtccatagtcgtggtacttttgttgtttacgtgaacttcagtgaaaaataacatttttagtatctgagtccaagatattctttgcatatgtgtatacatcaatttttataaaactaaaaattagagcccctacactttcagaagaacctacggccatgtctctttgtatgtacacatacatacaaagagataataacaggaaacctgcaagctgaatcttgttcaacaaccttacatgacagacttaaaccctaaaagtttagcaatccttcaactatttactccatatgaaaaatctgagaaacgcatactacttaacaattttcaaaagaaatccaacacagagcacaactacttgttactatcacagcccaaagttgacgctagcgatttaattgagctccactgtaacacataacaattgtaatgaattttcaccaagacagttaataacaggaaagcaccacatgatggtagaacactttagtccccagatcaagataaacaacaccaagacaagtccacgattgattatgactattgggcataagttacatgtacattatctacagtgaggaggtcctctaaccccccactttttcactgtagacaactcattaatacattaatcaatggcaataaacgacttaaccactgaagacacaaaattggtagtttcctacacaaagattgcacctaaagcagcaatttccaatgcacaattcacacaacttgaattgcacctaaagtagcaatttccaatgcacaattcacacaacttgaagcattatagatagagttaagccaggatgcgaagccatcaacgatcattctaaagcaggattacagcacatgtctcacaaattaatcaacggcccaagtctcaattttaccatagaacctatgaaca

SEQ ID NO: 9793 - DNA, 3550 bp, Oryza sativa
ctcggggagccaccggtcgtcctcggcgtcggcgagcacgaagccggcccgcccgcctgcgccgtcctcgagctcgcgcacgagcccctgcagcgacgagcacaggcggcaccggggcgagtagaactccagcacggtcgcgtccctcccgctcgccagcgctgccgcgagcgcccgctgctccgcctccccgcggtccgcctccgccgccagcccagggcccagccgcctcctcctcctccacctcgtcctcgccccaccgccgcctcctcccccgtccgacgagggggaggggaggtcgccggcgatgaggaggccctgcgccacggtgcggatggacttgagcagccagggcatctcgaggtcgccgcaggggctcgggctagggctagggctcgttgccttggggtcggggccccatggccacttgaagcagacgaagggtgggggcttcgcggcggcgcccatcctctccggcgagggaagcgccggcgaggcggcggcggctgcggattgggcgatgacgtgggttgatgaatggaccgcgcatcacatatcgattcaacggctgagatctaccccactggagtgtactggacgcggcctctacttctgcaaattggaccctcgtttggttgctacagacctacagttagcgagtaaactatactactccctccttccctagatgttgacgccgttgcctcttttaaatatgtttgaccgttcgtcttatttaaaaacttttgtgaatgtgtaaaactatatgtatacataaaagtatatttaacaataaatcaaatgataggaaaaaaattaataattacttaaattttttgaataagaagaacggtcaaatattttttaaaaagtcaacggcgtcaaacattttgggatggagggagtatattcctttccgggcgaccattctacccctgtcatttcttcactctcattgcaccatttcgtccatcttaagatattaataatactccctccgtttcaaaatgtttgacgccgttgactttttaaaacatatttgaccgttcttctttttcaaaaagtttaagtaataattaattcttttcatatcatttgattcattgttaaatatacttccatgtacacatatagttttacatatttcacaaattttttgaataagacgaacggtcaaacatgtactaaaaagtcaagggtgtcaaacattttgaaacggagggagtagtaaccaacgcacatcatatctttttagacggcgtcatacacggtgatcaatcatgccgtggaaaggacaatgttaaattggataatgcttcccctagattgctaaatgggccgcttggcccggcaatgaccgagcctatgtcgagatcagtcgggccggcacgccccgaccaacatgccaggccagggcaggcccgcccacttgctgcaccttcggcctaggcgctcaataaaactcaggccaacccaaaagcacgtaagtctattgtgctcctccttgaaaaagtctattttcctccctaatctctttaggctggctcttatatagctgcattgcatcctcattctttggccgtaccttatatggctagaataagtctacgttggctccctcatcttatcgtgccgacgaagaggcccattcacagctcaaagatcgggctatgctgtgcttggaccgggccaaaactctgtgccatgggccgggccatcgggccttgagccttttggccaactaaaccctataaagtggccgacgcactgcacacgatcgcactctcgcaaagtcgcaacgtcattactcatcatccgttaatctccttccggacgattaggccaatcctaactataaaacccaatggctgacataggagaggacggaaaacgcagccttgtgtctatccacatttcagacaaatttgctccaatcatatgcctttttttcacactttattagcagtcacttttattgctcaaacaaatagtaacaattacaaacaacatcaacatgatcataattacaagtttaattaaacccaatctttccttaatgaatcaacagcaatcattaatcaatcatcttctggagtaatgaaaagtatgaaacaaacacttacaaagttgcatttgcaattcatggatgctctcgatcctacgacgcattgaagcatgggaagcaaccgcacagcttggacagagccgacggcgtcgccggtgccggcgccgtggccggcgggtcagccgccggagcggaagacgaagcagaagccgaagccggctgcagcatcgggacgtgggacccgtccatgccgccgtcgcggcaccggtggcactcctcccggaaccggtcgaacgcgtcgcggcagtactgggcggcgccggcgacggtcatcccgcggacgaacacctcggggtcgtacccttccccgtcgtggtcgccgttcagcgcggcgccgagctgcaccagctcggcctggaactccgacacctcccggtgctcctccgcctccgccgcccgcagccgcggcggctccggcagcgtggcggggcagtcctccctcggcgccgcccgcgtcagcaccgtgtcgaacgtgcccgcccacgcgtcgcgcctcgtcaggaactccttcaacccaaatatcctcttcaccgtcgccgggatcgacgagtgctcgaactgcgacgtcggctccggcgcgccgccgcacgacgccgggtcgtgcaccacggtgcccggctcgatccacggcgagacgagcagcgtcgggacgcggacgccgaggcggtcgaaggcgaacgacacgggggcggcgctgacgatgccgtcgggggaagggacgccggcgaccggggtggggacgtggtcgaagaagccgccgtgctcgtcgtaggtgatgacgaagaggatctcgtgccactgggggctcgagcggagcgcctcgtagacgtccttgacgaggcgctggccatgggcgacgtcgtgggaagggtggtcgtcgttgcccgggaggagcttgaggtcgaagtagcgctgctcgatgacgacgtagtttgggagcttgccggccttgcagtcgcgcttgaaggcggtgtcgtaggggtggaagttgcccacgtacttgagttgcctcatgttcctacatgcatgccaatatatccggtattaattcatacttcctccgtactcgtaaaggaagtcgttttggacagcgacacggtcttcaaaacacaactttaacttcttgtttctataaaaatatttattaaaaagtgatatatgtatacttttatgaaagtattttttcaaggcaaatctatttgtatatattttacattttcaaactcaacaacttgagagttattcatgatttatattcttaaggtttgacttaagcattatcctaaactacttcttttatgagtacggaggctgtagctgattaaccaagtactcccaccatgtaagtcattctagcatttcccatattcatattgatgttgatgaatctagatatatatctatctagattcaatctagatttat

SEQ ID NO: 9794 - DNA, 10134 bp, Oryza sativa
attttgtcttttgtgaggtaaaagtaaatattatgaaatagtccaatatttgttttcaaagtgaatatcatatatttaaataagcaaacagttggtactaacatatctgataaaaaatatatattatgtatggcatattataatatgctttcttttacccaaagcaaagtatagacattttgctagtatcttaaagtatgtgtagagtgttgtttcatgagagctaaccatttatttttcttattctcttatttttacataggtttatagttaggttatagcttactataaattgacaggttgctgttgcaaggaacacatgcaaatcttctattatatactaaaattccattaaacttcctataaacactcttaaaccgtcatgtggcaccctacaaacgctcctaagctgccacgtggcagaaaaacatctaaccatcgattttcatttaaattggtggacccattctttgaaccattagattagtaaaaaaaacaaccaatctacctctaaactgggccccaccctatttgtatggacgttcgtgtaggtacgtactccataccatcttatgttcttctcttttcactctattatctttcttattttccttctattagatggaaagcaaaatttatataaaaacatttaagtaactatagtattctttttagaaacacaaaacaaacgcaggcattcacaacacgcgcacactcatcccttaggacgcacacacgtataccctaccccctatgaacaccatcgaaaacatttaaatcatatatgtattcttatatgcttatgttgttagattatttatatagtatctaaatcatacatgtatttgatccgcttatgttgtaagataatttatcattaataaatttacagttaaaaacccatatttactatagaaatatgtcattattatggataagaaaaacttgaaatcgttacagcgtataattatcttaaagaaaaaaattacctcctaaaattgggcccaccaggcatgtatgtacatacgtatgttactttttctaagaaaaaatatgacatcttttctccctgttacttctcctattttcatgttttattagttagaaaagcaaaaaatattttttataaaatctaaatcatataactaatttttatccgcttatatcttatgactaaatttacagttgaagaacaaatttaactataattcaactttgaaaagaaatgtcattttgggttttattttcggacttttgtgtgtcactcaggcaattataaaaaatatgaaataataataataataataatcatcatcatcattattattattattatatcatcgtacataacttcataattaaattagatctgcaaaaaaaagtaaaatgaatataactatgagcaatgctgacaaacttatactaaaaaataaataactataacatctaaatcacgtgatccgtttattctatattcactgtaatttaactttttatatgccacttcggggttatatttttttttaactttagcatgacattcaaacaattatgaaattatgaaaaaaaaatgatatagattttatcgttctatataactgcacaataattaaattagatctataatgatagaagtaaaatgccaaaaagactaaattgaattatttggagaaagtctaataagttcagaaaaaaattagttcttactttttactacaattgatgtttcaatttcataacaatttttaaatacttagatattaatggccttacatctatactataccataccatagcattatgagtttttccacatattattacatatataagaagccacactaaggttgcagtgtatgctaagtatgtaataacttgcgtcaataagaaccaaccaaaaggatgactaacttgattctacaaataaaacatatttattaataataatagttttttatttgttcaaaaaattctactaaacattcaattaaataagacaaaacaccttacttttaaattataaatgtttcctaaacaaactaaatatagctctgtactgaagaaatcatagataattatttattgcgatgttttaaatatcatatattttaaaagctaacaaatagtttggaaaaattatctaagcaatgcgatgtagaaaatttattgagaaatagtgctttttaaacatggcatgtatcatctggttgatattccgtctatataagtttttcaaacgcaatctactatacatgcccgcacatcgcgcgggctacctttctagttagtaaaattgttgctaccattatagagagaagcatcatgcatggctgctagctagctatatagattgagatctaaccgatcaagtgaccgagatttaaaaattaacaaatctcagtttgcattaattatatatggatcactacttacaaaattaatcagaagataacaaaagaaaattatccagctaaccagaaacgcccaaacctctaacctcaaagatgccgtctgcattatgtagattataaattttagtttatatatatatatacattcatgactgctatacctaagttgagcatctcttacttactcaatactatactatctaaaatttcaatctgattttatatgcgcagttgaaggcatcaaacacttagtgtttactcgcatattcgatcgtctggtaagaaattatctatggcagttgttggaaaatattatatacaatataactaagtcaggtcaactgcacatggttaagatagttaatatattttcatcttaatcttataattgtatcaagacaacatccatccaagaagaggtgatctgtacgctacatgtttaagagaatatccgttcgatatgtcctatttcaaagtcaacactagatcactacgtctctaccaacgcgtgaagcaatcataggctgttaattaggagcccctctatatatgcgataattaagcaaataataaggcaattaatggaagttatatatactatatcctaagtgtcacatttctctctgttttttttttagtaacttcaagcacaacttggacgaacatatatatagtcttaacatctgcataatattattatgcgcaactagttgacatatctgttctgttagcttcaaattcaaacaaacatcagtatatgctttgttcaaacttagccatcctatgtgttccctcgtcaccattggataattcatgtgtcaactataatgatgacttcgacaatgactataatgtactctatctcgtgcaatttgcaaggttaattgattggatgatcatttcgtcgaatataatgacaaatatgaactgagctatcgagaaccaaacacttccaacatttgcatagaacatatcgatcgagagtcgaatgcatggacacattgcttacttagctacacacgtactccctacatttttaatagatggcgttattaacttttggtataacatttgatcattcattatattaaaaaattagtgtaaatataaaaacatataaatcacacttaaagtttctttataataataaactaagtcaaaacaaaataaatgacacttatattaattttcaaatataataaaagatcagatgttatgtcaaaagtaaacggcttctccatctaataaaaatagagttaattagtctatgatattaaactaatccaccactataataaatggagcctaattcaaatagcattgtttgcaattccggttcgaaatatcggaactcccccttccctaatacgaaaccattttgaccattaatatcattttttcagttgtttgtgaattaagcaaaattcattcaaatcagtcaaaaaattattcaaatttcaaaaaagaaaaaaaatcaatctacgcgtgcgatcatgttaagcagcccgtctaggaagacttgtcttcatgtgcggtttggccgcccgcacgcgaagatggtgatcttcgcagaccctttaggcatactggccgcacacgaaaacgtgtttcgaccgtctgtaaaaaccgtttcttcaattctatagtgctagctgccatgctactgacctgtagaagagcacggagggagggaactggtagtagacgccgaaggagtggccggcgtcgtggagggcgtcgaagatggtgcgctgcggcaggccggcgcggagctgcttgccgtcgttgctgacgaggccgtgcgacgtcgccgagtggacgaacatccggttcggctgcgtcgacgtcggcaccgacgcgaaccaccggtcgcacacggcgaactcccgcaccagctcccggtacaccggcaccttctccggccggaacccgttcatcaccgtgctcgacatgccggcgcgctccttctccgcctcctgcgcgaacccgctcatcggcggcgagggcacccccggcttcgtcgccggcgaggtggtcccccacgtgtaggcgtcgccgtacacctgctcgtagatggcctggaacgagtggcccgggtcggggtccacgtacccggagccgtcgccgaagtggatcgccggggaggaggggtcgccggcggtggcgcggttgaactcggcgcccgtcacgccgtcgatctccgggttcaacgacttcatccaccccagcatgtggtcgaaggagcggttctcctggaccagcaccaccaccgtcttgatcttgcccgccatggctggcgtcgaggctgggattggaagagggaagaggaagataaacgatcgaggatggcttattagctagagctcagtggcgagctgatagtagctgcttctatgtgtatttattggcggctctcgtgtggtggagacgtgtgagatgctgctaaatacagtatgtacaagtagtctcattttgttaattaagcaaatccttgcaattgctgaggtgacatgattaattattagtacgtcgtagtaggttgttatgttcattaaaaaaaattactgtattaggttattatgtacagcgtactcttctcatgtttatgtttgaaagtagaggaaagaagaatactccctccgtcccataatataaagaattttgaatttttgtttgtattgtttgaacactcgtcttatttaaaatatttttaaaattattatttatttttttacttactttattatctaaagtattttaagcacaacttttcgttttttacatttacataaattttttgaataagacgagtggtcaaacagtgcaagcaaaaattcaaaatctcttatattatgagacggaggaagtactggaagacacgtaaaataaggtgtgccattaatatatactccctccatatttatttttatgatgctagttagttcaacatcctttatttagagaaggaggtagtaattaattaagtaggtgtattaattatttcaaacttaataaataaataattttttaaaggaatattcctatagaaattgatgaggatctaagaataccttcaccttcaacttcagcaacaactcttatttctttctcttttgtttcaacgtacactctatactatgcctagtttaacaacacaataattcaaatatgcttccacgtattatttagccactcattttaaattatttgttaagttaagtttttaaaacttcaattcatccatatagttctagataatccgtggcaataggccggagtactaatgtacttgtacagggcctaaatagactttttccctaaaaatattataggcccttggtggcccaaagttttgcaggcctcggtaagcccagtactaaactgttcggccttcgctgagtctatgggccgtgtgcttttccgattctaattcagttttcggacgcgcgcggcgtgcgaaacaagaagagaagccgttgcggcggccaaaattccccaattcccaaattctagggttcgcctcttgcaccgccacgcatcaggagcacacgcccacatgaagatgagggcggcggtggccgacggcgacggcgacgacgacggcgccggcgcgcccgtccaagtcagcgtggaccccgccgcctaccgggactggtccgcgctcccggccgacctgctgctcacggtgatggagtcgctcgccatccccgacctcttccgcgccgggaccgcctgcgcctcctggtacgccgcctactccatcgcccgccgcgcccgtatccccatacgggattcggctccgtgcttgctctactccggcgaaggcgacgacgaccccagcaaggccaccctgtacagcccctcgagcggggactgcttccgcgtgcggctcccggacccgccgctccggagccgcaacctcgtcggctcagcgcacggctggctcgtcaccgccgacgagcaatccaacctccacctcgtgaacccgctcaacggcgcgcaggtcgcgctcccgcccgtcacggccctccaccatgtggagagcttcgtggacgaggaagggaacatagtgtatagtgttgatgagtctctggggcccgacgatccagaagccaatctccccgaattcgaggagctcgccgaccgggaagtccccgtggaataccctgcggagaagctgcgcctgttcatgtaccacagggtgattctatcctgcagcccatccgtggggagggaatgtgttgccctgctggtgcacagaccggatgggatgatctccttcgcccgaccgggcgacgagagatggacccatatcaaccggacaacgagcaatggatcgctcaaatgggataccggctataccgatgcgctttacaacaagaatgatggcttgttctacctgttgagctttgacggttctatatgcgcgttggatctaagtgggtcaagtccagttgcgaggaacattgtgaagaaaaatacacagtgggataatcctagcaaatacattgtgctggcaccatggggcgatctcttggaggtgtggaggttgagagactttgatgaacctgatgaaactcctgaatgttcttctgctgagtttgaggatcgatctgataagtggttaacagaagaaattatgctatataaagttgatatcgataagcagaaacttgttaagataagcagcatcggggattatgctctgttccttggtttcaattctgtggtgtgccttccaacagagaattttcctatgttaaaacctgattgtgcttatctttctgatgaattttatgaagaaatatgtgtcaagaggcataactggcgagaaataggcatttgggatttgaaaaattgcaaactgcagagccttggtgatgtggagtctcttcatgcttggcgtaattggccatcgcctatttggataacaccatctcttagttagaaagatgtgggagattttcatgtattaggagctccaatatggatatcattaatcgaaaagagagatttatgatgaactgatgatagcccaatactcaatttggttctgaaatgattcttgctcctgtacaataaaagctgtagtagttattattcttatcttaaagctcagcagtttgctgcacccttgttcattccattgctattcttgtgcacatgccttcaacacctcagcacatgcccccggtaaacctctccttcctcgttttcatgtactttcaccgtcgttggatgttactgctgctttgcttctttttatttcctatcaattactcttttttcttcgttgttggtgttgttccctccctttgcttgtgggccgtcctgtcagttactcaaatcatcacttaagagaatatcccctcatttttgcatgtcacttaaagcttaaacaaaaaaatttaaaaaaactagtacgatagaacaatatatgataggtcacttcataaacatgcaaatttaaattcaacttatacaagtagaaacaaaaataacaaatttcactatgaagtgaatgcgtaattcacggtcacatttgttatttttgtttcaaattgtataagtcaaattttaactcgcatgttttcaaaaagatatatcatatattgatctatcttgatattttttcaaaaaaatttgataactttttgaacgacacgcacaaaatgaggggatgtcccctcgaggaacaaaaatccacttccgagtttgattgacatcattcgttgttttttagactctactaccttccatttttcattgtcccacttgtctgtaaactgttgcctttgtcttccttcttctgcttctgtttatttccttgttgcaattgtttgttgtgtgccgtcgcaagccccctggtagttttccttctctttactcctttcctttctttgcaagctctgtcacttcttctgtcatgcttgctcggttgctccgcatcttcatgatgcattcttaagatctccctcctctcttgctctcatcactctcactggcagtgcttctccatgtttaagttgctatatgtgacacggcactcacagagagtgccctagaagggaagggggaggactcggcatggtggtggcccgtgctgttctaccggacgagagggcagcttgtggccatggcttttgatttgagcccagtgggatagatgaggaggtctccccagtggtggaacatagatcaactgtcatcctgtcatgcccacatcccttctcttaatctctccatagattgctggttcttatagttctttttttgatggtttgatttggattgcttgctctaatgtttgctgatttgctctatagggtgtctttggtggtgttccttaagtaactcgcaatggggatataggatgcctgcacacagagcaagatcctgaggatgaaaaagggacagatagaaaaaactattgtgaaatctaattttggtgtattgtaactgattgtaagtgctatgtaattgagtgtaaatccaatgtaaccgagtgtaactacaagttggatataccagaacacgaatcttgatgcaatatcctaagggtgaaaaagtgaaagatagaaaaccaaaaatccattgcaagtgaactaaaaaatctgttttattcttatgttttttcccgtcggtcctttgggggtcttgcatgcgccttgggccgtggccttggcacgtgggttgacatggcatggcccgacccactacaggtgccgtgcggttggcgggccaaccgttcgggcacctgtagaagcaaagaaaaaaaaccggtcacacgacacctcccccatgcatgaacccatccgaatctttgcctccctccctctctccctgtctcccctcttcctctctcttgtcaggacttggccaaatttgagtccaaaacataaaatttcagagaaaattaggctagtagctacttagtaggaccaaaagtaagggaatttcattaaaatgggaagcaaacataacagaattgagatgggtgctacaaggagttcgctgatctcaaaaaactcgatggcttataaggagttcgctgcggctacgcgacaaaagagatggcgataacgctatgacaatggatcctctgtagaaagacttggagcatcccaggccattcgatcctcataacacactcttgcgaaccattttccttaaatctcagtcgttcattcgcaaccataactttccttgtattctccaccttgcttcaggatccagactttagttctaggcttcagttttagaacctgacaatgcccccctttaagaccacatgtcctcgtgggtgaaaaacatgaaaaactttggagatgaaggttgcatcttcctacgtagctgctaattcaggtaagttggtccaatggatcttccattgaacgaccgactcattgttgtgaggaatgagtctacgctccaggacagctaaggatgccgacaatatattcccatcaggatccaccagaggcaagctagattctggaaaagcttttgagcccaaatgcttcttcaattgacttacatggaagacatgatgaatatggcaattagtgggtaacaaaagacgataagccactgatccaatcttttccagaacacgaaaagtaccatagtatttggaatgcagtttgaaagaattgtggatgcccaatggcattgtggctgtaaggttgtattttcaggtaaaccatgtcaccaatgtccagag

SEQ ID NO: 9795 - DNA, 9192 bp, Oryza sativa
  unsure (1)..(9192): unsure at all n locations
agcgcggcctctggtgacttccctgaggtgccctgaactgagcggccttcctcttcctgtccatcttgttgcgttgatcctcctggcggattgccttgtcaaccaacctctcaaagtcggcgtagtccccagatatcagttggttggtcagctcgtcatccagacccgccatgaacttctcctgcttctcggcgtcggtgcggacatcctctggtgcatatcgcgcgaggcgattgaactcgtggaggtactctgtcacagtccggttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcgggaccctgaagctggtgtgtggcaaaagcgaccttctcctgatcattgcactgcaggagattcagcttcttctctattgcatggagccagtcatttgcctccatggggttggtggtgctggagaaggtgggtggcctgacgcgtagaaactctggcaacttggactgagggggagggggaccaaactgttgatgctgctgttcggcgtgctgcatcatcctttggtgcatctgctggtgctgctgctgcatctgctgcatcatggctgccatcatctgagtctgatgtgccataacttgggcgagggtcggattctcgggaagtggtggcggaccattgccagaatcactgttggggtgcacaccatcagcgcgttcttcgccgttgctgccctcgcctgtcgtgcggttgccagtcctggtgtagaccatctggagggaaaagcagacgggggaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagacaatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcggacaaccaacctccggtaccactggctggacctctggcggctgatgctggagcgaaggagagagtgaacgcgggagctggaactggagctgcaggaactgcaggcggaactggaggtgctgcgggagctgctggtggaggtgggttcctgggcgcaagctggatgcgcacaggtgcagtcgtcgtcttgcggggcgtggtgcggatccggactcctcctggcgctggaagaccctttagctgagcgttctccttcttcaggcgcgctatctcgtccttcagagcgacgatcctcatgagcttcccatcgttcaaagccttggtcaccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggccgcctcctgacaggcgtgatctgctgtgcctccagatgcctcgaccgccatgttagcgaggcaagtccccacgtagccatggacctccaagcggacacggtgaggaagctcgccgctgagcggcggaatcgtcgtgtactccggcgcgttggggtagcccaccaccagtgtcatacgtgccagctctgccacaaagtcgatcatgccttctccgcggtggttgggtgggtgaccggccatctagagaagacaaaggagtaggatcaatgcatgctcaaatccaaatttaaataaagcaataaagactcaaataagggaaacgaaccagagcgaaatttttatgcataggtcattttgcatgagagcgaataaataagacagactcacataacgacaaaataatgagaaattagatacatattaataataacaaacgaagcataaacaccttgcaacccatgttataaagctaggacctaatgcatttcacccatcaaaccccaactgactgacgaataaatcccaataattttactaaaaccctagactgactcgttttgaaaaaaccccgcttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccaaatagaattccaagcagaatgtgcattataatccccatccaggaccagccggggtacacaaacgacaatgttgacattcagatccacgtcttacaaacatcataaaagtcttacaaaaatgcagcggaaacaaaagataactggagctaagccttgactaaactgcagcgggaacaccactccacaggcatcctcgacggcacggacgaagcctactcctcggggaaaccttcatctgacacaaacccgtcctctggggttgggaaaagtagagcaagactgagtactacccactgtactcagcaagtcataccggaataggagtatgatgcagggaattaacaaagaagagctagagtggttcatttgcataaatactggcatttaaaaacaggaattgaatgcgaaaacggttgtaataattaattagtattaaacatccactgtccaacgctaacccacgttgcgacaggcccaaccgtccacctaaactatccaaattcaaaagattaccctagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataaccccctctaaccaagcacatcacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgtgaaccggtccttaactgccatgggtgcgaccagcaaaaccatgcacccacagcccaccatgtgattcattttatttaaccaacaccagagcggtggtactaatccaacattaccattagaaccaacagtctaaacattaatatgattttccccattgtgaactagttgaactaagcatggctaagcaattactagtccaaactctaatcatgttataaccccaagctaacaaaggagcatggtatcaaaatagcatggctgtaacaataggtaaccatcccatagtaatattgcaaaacaaatgcggtatttgaaagaaaacattaggacatttgcaatataggatcaatatgatcaagtgacaagcatgacttgccttgctctgctgctggaggaacctcggcgactatctcgaagtacaccggagcgtcggagaaatcggaatctaacgacatacaaagcaaacattgcaaacaggctataagactactgaaacagggaacaaaaccatttttaatggattctacacatttttcttgatttactaagacttgaatgggattaaacggagctcggatgaattagttatgaattttagaagattcactgtgtttattactataacaaaaatccttaaataatttattgcgcaatattaaccagggctgacgtcagcacaggcggctcggcgccgacatgcggggcccaccggtcagcggcacggggaggagagaggaggcgtcggcccgcgggcccaccggtcagcggcacggggagggcggtctaccgtggaccgggaccacgcgggtgatccaccgccgatccacgggaccgacggcccggatcgccctcggccgatcggacggacggcggcggcggcagcccccgggctcggatcggcatcaaagccgatcggccgacccggggctagcggcggcggtgcgtgcgcgtcgcgtcgccggcgacggcatccggcggcggaggcgacgcaaaagcggcggcagcggacggcggcaacgacccaaagcgacggcgagcgcgggtggcggcgacgcacggggaaacggggaaggagaggagaggagatgcctcaccgagggtggccggcgcggaggaagacgatggcgaacggcgacggcaggccacgggagggcgacggcgaccggcggacgagcttcggcgtgccctaaggaaggagaagagagggattagagagagggagatagaccccggcgaccggcattcgaggccgaaagcggcggtaggggttaaacccaccggagcgcgaggaaacgggtgttccggcggcgaacctcgacggggaaggggcggccaaggtagatctcgaccccgcgaacccgacggcgacgacggcgcggtgcggcggcgatcctagcggcggctagcagcggccgaagtagcaaaacggcggcggcgggtggttgcacggcgcgggagcgatggggagctcgggagaggtcggcgcaatggggaaaaagtgagagggagtgccggcgatgcttaaatagggggagagggaaccggacgtggccggaagaggcgggaatcgccggccgacgtggggagtggggagggagagagaggcgggattctaaattnnaatnccggccatctcgggcgcgggcgccagcgggaaaaagaggggaatggacncggaaagcgcggggcacgcccggacgttgccgacgttgcccggaaaaagcggaggcgtgggcgtgacggccgttacgggcgcggcggcgcgagcgggagaggcgggaggtgggagacgggtccgacaggtgggccccacctgtcggcgaccccgggagggagggaggcgggcggctggctgggcctcggcctgcggccggcccagtaaggggagggggaggaaaggaaaagagaaatgggccgacggcccatttgacaaaaaggaggaaaaagagaggaaaaagaaaaagaaaaaggaaaaaagattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcctgatttcacctgcattttcttggggtcatttgtaaattacaattttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtaaccttgtttctggttctcctttcgctggtatcaagtatacgaaccggcttctccacgtatgttaggtcctcctggatatcaatgtgctccgaatcagcctgttcttcaggtacccttaagcacttctttagttgggacacgtggaacacgtcatggatgccgatcatgttggatggaagttctagctgataggcaacttctccccttcgttccaaaattttgtatggtcccacgaagcgtggtgccaacttgcctttcgtctgaaaacgatgtactccccggagcggagtgacacgaagatacacgtaatctcctgcctcaaaagtgagctcccttcgacggttatccgcatagctcttctgtcgagactgagcaatcctcaacctttccctgatgattctgactttctcttctgcttccgctaatacttctgttccgaacagttgacgttcgcctgtctgatcccagaagagaggtgtgcggcactttcggccgtataaagcttcaaacggtgccatctgtagactggcctggtagctgttgttgtacgagaattccgcatatggcaagcttttgtcccaagctccaccaaaatcaagagcgcaagctctcaacatatcctccaagatttgattgactcgctcggtctgaccatcagtttgcgggtgataggccgtgctgaagtttaaacgggtccccaattcttcctgcagtttctgccaaaactttgaggtgaactgactacctcggtcggatactatcttcctgggtaccccatgcaaacacatgatccttgcgaggtacaattctgccaatctctttcccgtataggtggtatgtactggtataaagtgagcaaccttggtgagtcgatccacgactacccagattgaatcgtgacccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttccttgaggtcttggtacattttggtgctgcctgggtgaatggagtactgggtctgatgagcctcggtgagtatcagatccttcagttctttgtcgtcaggtacacacaatctttctcctatccagatggtgccatgctcatcttcgtggaaatcccgagcctttccgactctcatgttctttttcagttctgctatttcagaatcatttacttgagctgctctgacttgatccacgagagtgggccgtgcctccagagcggctacgaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctaccctcttgcattaggacacatccaagtccgtgacgggatgcatcgcaatagacttggaagtctttcatctggtcgggcaggatcaaaaccggtgcggatactaatttcttcttgagctcctcaaagctcttatcgcactcagctgtccatttaaacttctcatctttcttaagcaactgagtcatgggtcgggcgattctggagaaattttcgatgaatcggcggtaataacctgccagtcctagaaaacttcgaatctgcgacacggtcttaggtggggtccatttggtaactgactccacgttcgatggatcaactgccacaccctgagctgtaatgacatggcccagaaatttgacttccgtcaaccagaagtcacacttgctgaacttggcgtatagctggtgctccttcaacttctcgagtactagacggagatgttgttcatgttcttcttcggactttgagtagataagtatgtcgtcgatgaacaccacaacaaacttgtccagaaactccatgaacactttgttcatcagattcatgaagaatgcgggtgcgttggtaagtccgaaggacataaccgtgcactcatatagcccgtaccgagtggtgaaggccgtcttcggaatatcctcttctcgaattctcaactggtgatagcctgatcgcaggtctatcttagaaaacactttagctcctttcagttgatcaaataaatcgtcgattcgcggtaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaatttcctcaagttcttctctacggtgtccactggaacttccatctcgacctggttcaaggagaccccttgctttggcggggctagtgttttgtacactactgtttctcccttctcgttggtcaaggtgactgtgcgattcgcacaatcgatgactcccttgaacttagtcagccaatccatcccaagaatgacatctaggtctttggattcaagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcaaaaagtactgttgccgggattgagttaacagggaacgtacccagtacgacctccggtgctgtttgtgcctcctctgcagacgcgtggttgacacgagcctggataaaccttggcccggcacgcctgggcttcgggcatttgtcagcgaagtggccaagctcgccacagttgaag

SEQ ID NO: 9796 - DNA, 8817 bp, Oryza sativa
  unsure (1)..(8817): unsure at all n locations
ctagagctctgaaaattccactaaaaatcctgttaatgaatttcgacatgtagaactcaagaaaaattccacatgtcaaatccgattattatttgcattactttcttagggttttctcctgatttcacctgcattttcttggggtcatttgtaaattacaattttggcttgggaggaaaacttcggggtgtgacactgggtaacttgagtctggatctgtttctaccctcttttaaacctcaaacctataaccgtttcaatcttcagtttcagaatctgaaatctctcccccaacatcgacactagcggcataattccaaaatcccagaaagaaatttagtgaatcgtgccctaccaccgccacatcgcgcttcccatttcaagcaagcgcgtaggtgagtctcccaaaccttccatgatgcgcatcctccgcgaacccaggtgccccatggcgaggacatcttcccgacgagtttgaggttgagttcagataatgatgcagatacgacaggcgaggagggttaagatttgggaatcgacggatagtgtggtcacaccctctggacatcttccaccgcggtggtaaaggaagatcatcctccatgcgttctttgctttttgttccggtagaaagtgggtttaaaaattttaacccaatatatcgccttatgtacttcaaggctggtttcatggatctccactacaataagtgtcgtgcgaattttatgtgtaagaataaggacacgaggtattagtgccacaagtgcaaatgttggtttgaaggcaaaaacttcgcactaatcaatcagatgtttcagttatcaaatacggtttttatgtaaggagattggtttgtatgtaaggagattggatgatggtatatcgataagatatttcattttgacttcgatgggatattccattttgacatattttagttggtggtcatcaaattttaggtgcagctttttcatttgatattaaatctagtagttggaagttcctatatcagttgatcagaattaatatttactacaaacctaatgtatatgtgttttttctaagtttcctaaatattaatattatgtttatgactatcaaacactaaatattattgttaaggtagcacaaatttctatgagaagtttatttaatagatgtttctttaatcttatatttttttagatataaaaaaattgtaatgataattgctgaagttgatgatcatgttgctagtagtgcataagggtttagtcgtgaatatgtgtagggctacaaaagaaaatacgataggctaatagtagaatatgctgttcaaaatgcaattgaccaacttaaatactgctcctttcatattataagtttttaatttttttaaagaagtttgacaaagtttatagaaaaatataccaatatttataggatcaaattagtttcattacatctaacattgaacatatttgattagtttctttattttgtgttaaaaatattgctataatttttataagatgttgataaacaaacgcatctgccgaagggcaagcttcactcaatatgtgcgatataaagtgataaaatgtattgatttttataaaaatttgatcacctattacatgctcctgacgtctatttataggtttacagccctgggtttgtaaccctagggttttggtgtacaagtgagtttacacaaacgcccttatgacatgaacatttataggggtaataacaaacctttggctcagctacccggtctatgggcttgtcccttcatgggttgtttgcgggccttcttgattaacagggcgttggctgtcgtattggcttcgctgcttggtcagagcgatcctttggcaatttctccgctactcagtgatcagctttgccgcttactgggacttcgcctcttggttgtcttgcacctcgtttcgcggcttggcatttatgtgtttcggctggctcggtcgaaggccctcatgacatgcctctaacataaacttaatcaaatgtaaaaaagtttgacttagaaaaagttaaagcgatttataatatgaaacgtaggtagtaatcagaatttgacctgaaaatccctatctctactattataaaaattgaagatgtttctgccgaaattttggtatgtcatccatttttgagttagttgtacatcacccgtatccaattcgacatgagtcaacgtgagtccataataactattatatatccccttccggctagggctgtcaacaagccaagctcgagcgagctcgtctgccgaagctcgagctcgacacaagctcgagccgagatcgagccgagcctattgcacctttgagcttttaggcaagctcggttcgagctcgttcgagctcgagctcggcaataagtagtataatatatattttaatgacaatctcttgataagtataattattttctagttaatcacactaataaaagagtagaaaatgattaaaataaatatattgtgctaacacatgctaatttattgtgtgaatagatactaatatatatatatatatatatatatatatatatatatatatatatatatatatatatatatatatatatatatatctattagtttattatattaataaggtgaacatgcatataaactatacacagtcaagctcggtagaagcttgagctcggctcggtaaagctcgcgagcttttgcttaggctcgggttcggctggtttggagctcgagcctaggacgagccaagctcaagctgctcgcgagcctcgaacttttttgacagccctactgccagcccaactcctccctctcctagcccaacccagctggcccacaccatcccacaccccatcccgcaaccctcccctgatctgattatctctctctctctctctctgatttttctccttttcttttctccaataattctaatcctccccctctccctctccttacaatcttctcttttctcctactattctctttttcatttttttttctcttccagatttctctctacataaatatttttattttaaaattatcattatttaaggtgtgtatgtgacaagttgttactttgttcatctatataaaaaaaaacattcactaattgaataatcaaaattttagtttcaatctttggtcaataaggtataagcaaaatatcaatgcgtcaaattatggaatagccacccggttgatttgtgaggctacggagaaatatacataaaagatttttcgtgtgatgatgcatgaaacgagcgcaatcaggttcaatgctatatatgatttttgactttgttttgcattgttttgtttgtcttatttcactgtcatttaaattggctgagtttttattaatcgtaaaaattatctttcccctattgcaacacacatgtatttttgctagtctctaccttaataaaaattgaagatgtttttgccgatattttggtatgtcatacgtgtttgagttagtttttaagtttgtttgcttttggaaatacaaatctgtatttgagttggattattttaagcttgtttgtttttggaaatataaaaggagtcgtataagaaatctctttaaagaaaactcatgctaacttgagatgaaatatggacttctaattgtagctcatgattttctaaaaaaatatttaagcgaatttccacggtgaattttatcctctaaaccatataacaataataatattaaaatagcatttacccgttataatgcacggatattttttctagttaaacataaattcaaaagaccgaattggcctagtgatgcgctgcaaccatcgttccacaagtgaaagaagaaaccacttgatgcttcctaagattatccgccgccaccgtcgtcgtcggggagcccttccatctgacctctcttcatctcccatctgccaatgtcttgccggcaatattctttctcatctagacggcagtcgtcgacgaggtaggcgcatctgggcttcaacgctgccaggaattgctcggcccggaagcacgccgagaattcgtggccgaggaagaccaactcgccgccgacgcctccacgagcttcttctcgtcgccgagcaccgtcgaccctgaagatcggcagatgtttggtgcagaaaggcgggtccccgttatcgccgtcgccggcgaacctccagacgatgttgttgtgttgccctttggaaatccacttaaaaaaataaacaggagagatacaaacaattttacatactcttttattatcctagtagcaaaatgtttatgtgttgcaacaggagaaaaagagtgaacatgttatagtaaaaatcatgaaacatcgtgtcttatatttacttttgtcaacataacgggcctgttcactttactgccaaaaaaaaccttatcaaagtttggcaactatgccaaaattttggcaactagtggtagcttgccaaattttggcaggaattcttatatagttactaaaatttggcaacaaactaaatgtagcaacttttttgtcaactttatcaaaatttggtaaggttgaaaatggcaccaaagtgaacaggcccaacatgtccagcaaatcgtacttgatttattttactttcatcggttaatcctccttgagtagctattctcatgagcaccagaaacagaacgtaatcagaattgagaaacgcccaggagtcttccggctagctcacaaggtggtgggctagacaacctgggttcgaatcctcaccccttctaattatttgatattaggtcattcccttatatttgcttctttttttaaacataacgtaattaaatataaaattgtacttatattgaaacggagaaacgtagtattattgcgcaataagctggcactgttatggcctccaacagtacgtagcatcgtggcatcttacagcacggtatcatctggagacattgaatttgaacgtcgatcagggcaagagagacgtgccgagtccgactcggaaaatgtgcgccgtgttcaggcccgtccgaacctaatccagcacgtacgggtctaacacagcacaaaacatctttttaatcattccagtgtctctcaggaaaattatcgcgttcatagaagcgttttaatttgctctgtcgaccgacgatcgccggcggcggcgccgtcagatcagccatggagccgaccggcgccggcgccggcgtgatccagtgctgggagacgcttcccgaggatctcctcgtcaccgtcttttgccagctggagatacccgacctcctccgctccggcgccgtgtgcgcgtcctggcacgccgcgtaccgcaccttccgccgcctccgcctcccgtcgccgaagcagccgccgtgcctactctactcctgcgacgcctacggccccgacgccgccggactctactgcccatccaccggcgccacataccgcatccccgtgtcgtgcggcggcggcggcggtggcttccgtaacctgacgctgatcggctcggcggacgggtgggtcgtcgccgccgacgagatcggcaacctacgcctcctgaacccgctcaccggcgcccacgccgagctcccgccgctgtccacgatgcaccacgtcgaggccgccgccgacgaggaggacgaaggcggcggcctcgcgtacgacatcgttgatcgcctgtacaaccggcccagcctggtgcgcgtcccggcgcgcgaggtgcgggattgcatgtacttcagggcggtgctctcctgcggccctcacgccgccgccggcggcggcgacgcggcggcgtgcgtcgtgctgctcctgcacatgcccaggtgcgagctctcctacgctaggcccggcgacgagcggtggacgtggatctcgcctggcgccggcaccggcctccggtggcgtaacctgtactgcgacgccgcctactgcaaggacgatggcctcttctacgtcgtgcgggatgacgactccgtccacgccctggacctcaccgggccatcgccggtggcgaggaaggtgttcgacgagcggacatggagcacgagcttaccatccaggtacctcgaagatgtccacctgccatgcgcccaaccttgcagatacctcgtcaacacgccgtcgggcgagctcttgcacgtctggaggttcaggcaatgggtcagttcctacgattcgtcatctgatgatcaagacgactcctccaacgattcgtcatccgaggatcaagacgacgactcctacgattcgtcatctgaggatcaagacgactcgtcctcgagagacctgtatgaagatctcatcaccagggacatacagctctacaggactgacttccatggaaagaagctcgatgcgatggacagtctagacaatcatgctctgttcctcggttacaatacctccttgtgccttccaacggaggatttccctggattgaagcccaatcatgcttacatcacggatgattcgctcgagtttgtcaactattttaaacgaaataaaaaagaaattggcatgtggaacatcgaaagccagatcttggagggatttggtggggcgtcatctcttgaagaaccttggttaaattggcctgcgcctatttggataataccctcccttttgtagacgaaattatattgtaacaacactgaggcgatagtgttgcgttgccctttggaaatccacttaaaaaaataaacaggagagatacaaacaattttacatactcttttatattatactagtagcaatatgtttgtgtgttgcaacaggagaaaaaagagtgaacatgttatagtaaaaatcataaaacatcgtgccttatatttacttttgtcaacataacatgtccagcaaatcgtaattaatttgttttactttaatcggttaatcctctttgagtagctattctcatgagcagcagaaacagaaagtaatcagaaacagaacgtaattaaatataaaattgcacttaagctggcacggttatgacctccaacatatttatctatcttgtcttgtcagctgcaggattaaactgactagcacacccacattttattaagatttggacctgcattggagctaagcatatctcctaagccattatgttcatcgacttagttcgcaccaacaaagttctggcaccatcagtcgagcgcggatttttcatcaacacaaatttggcacgaacagtggggcacggattttatacctatatgtttgaagaagtcgacgccaatatcctggtcgcaatggagaatttgacggaggaacagaggcaacagattgatcaatcagtgactaattttcaaaagtgttatgttcaatgtttcttcatgacgtaacaaggactgattcagaagacacaatttcccaagtcgatgattgaaacacttcaaaatacagttgatgaagcagttcgtcgtgctttgcttgatcaatctggagttttggtggatacattgtgaaatttgatcaaaggaacagttgatgagttagttgctcaaagacgccagctcggggggcagattgaagaacaacaacaatatcggcttgggggacaagcacatcagtatcagtaagatgaatcatatcaacaatatcagctagaagaaactcaaaaacatcattatggagaagattgggcatttgggccgatagaattgcaaagatgatagatgagcagtttggaatcaaactcaaggaccaaacttctgtgtatcggctgccatatcctgagtggtttgatagggttccattgccacaccgatacaaggttccagacttctccaagtttccagggcaagatgatatatctataatggaacacttcagccgattgttagtgcaatgtggggaaacatctgctaatgaagctctgagagttagatttttttcactgtctttgactggatcgtctttcacatggttttcatcactaccgtcgaattctatcagaggatgtgctgatcttgtgaagcaatttcatgtctacttctttgttggaatcgatgagttgaaacttttacaatcatagatcttgctgagctttacggagcttcaatacaattttcatatggagtttgtcatgatctgtggtgctctcatttttttaggtagacctctttgaaagatctggtcgccaaaagtcaaattttacaggtttttcctcatgaaaaattcctgtaaaaaaatcaccccatttcaaagggtagttttcctaataaatcgtctgcgagaatagacaaattttcataggcagatttgcccaaccgtaaaaataggttttcaaatacggtctttaacccttcacagcctcccaaccatttatacaagctctgtttcttttgggccgcctgtgaaaataaatgcacagcgtccaaaaatgattttgttttttttcttttttacaagtagtgcatttcttcacctcatgatacttatcaaagcatcatccatgtatacttatcaaagcatacttatcaatgtatgatagatgtatctcaaatggacacgtgctttgtactcgtttttttcatccttccaaaaatgggagagatattgcacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9797 - DNA, 588 bp, Oryza sativa
tggtttggaggagttctgcaatgcaattcaagcaaagttgaaagtacgacttgtttccagacttcagatataagcttttgttaggtcctattgcttattttattgttctaaaatgaattatgcctatctatcttctacaggactcattggtgccgatagaagcttttgttccatatgacaaaggagagctcctgagtgacatacacaaggttgggatggttgagaaaacggtgagtatcatgctcgatcattaaaacatgtttttgcctatcaatatgctctaacttttaaattgaatgtttggtaaaacctttatccttcttacttgaagataacaacgatgtttccacaaaatatttattgcaggagtacacggaaaatggtacctttgtaaaagcgcatgtgcctctgcctcttgcaaggcttctcacgccgctgcggcagcaggtggcggctgtttcatgatgtgaacgtcttgcatattgctatcggcaattcacataatttgctagcctttgtagtttgtacagagctaagccatagattttcatgccatcagtttgacctgtgtagagcatcattacaaaa

SEQ ID NO: 9798 - DNA, 10490 bp, Oryza sativa
  unsure (1)..(10490): unsure at all n locations
aactttctattatatttgagaagaacttcatgattataccagagaaacaacaggaataggcactgattgccgacggttgcggtacagcttccgatgttttcggacagactccaattctttccttaaagcacttatctatcaatggcacttgattcaagaatcattagaaacaaaaatattatccatgcaaattggacaatacacttggtgaaaaaaaatacaagccttccaattaattatcaatggagcttgtcattaactattaaatggctacagatcatcaattttttttattccacgcaggtgataaaagtggcaagtcaatgatcaagatgctgcaaaatgcatgttctttcactgatggaagtagtaacaaccaacacataaaacatatctggtgatattctccacagtccacacatctaggtgacagcacatacacacagaacggaagtctacataaactatttcgatgaggaaatctgaagtagcaaatacatggatgaggaaacaatgcataaatatgtgtatgccattcaattgaaataaagatcctgacagcaaagtagtttggcatttggtgcaaagcaaaacatataaatcgttgaacttttagtaagagaatattacttgtgttctcaagatgcgcttgtcaacttcaatttgtttctcacccatacccttgacttgacctcctgactgtcgttcaagatgactccacatctttgtcaaccttggaagttgatattccatttgtgccaaagtgacctaaaaggatgattgcacatgaaaatcaattctaaatcaaatgcagtactgtagttagtttcaactccaaaggagtctcaatcgaggccatacatcacaaaatatctatgtagaaattttgatattccgatcttgcatagtcaatgcagacttgcaaaacactaccaaaagcaatatgattttgtacagtgcacgccatttcatgaagatagtcagctaatgtactggcatgcagatttttctaccaagatatctactgttccgatatggttggacctaattactcaacatgcgttgagccacatcatctagaaaagaagggctgttggatcacgaccacaaatgtattttgtatgctaaccgttatgtattaattatagcttaacatattgtctcacctttaattcaatgttgtttttaagtgttttagaaggacttctaaaatcctgcagcaagctgcagggtatccactagttatagttgtaatagttcgcatttgccagagcctaatagcccaccaaagcaacttaccactggtagctggtaaaggaactgtcattagcattttattgaaaagattatgttctttatcacccaaatatagatgagtgaaatgtcataggaatttttataactacaaagacagttcttgttacaaggagaaatttctgctaataacacagctgcttattatacaattaaagccatgtcgcttgtctagaaaatgacaccaagatgttcagttcagttcacctgtagagcagcttcatgtgttgcagccctttggttaaatatgtccagaataagagcagtcctgtcacagactcgaacgcccccaccaaatgacttctccaagttacgcaattgtctgaattgataacatagcaaatgatcaaggataaaatcttggaataagatatagcaaacagggaaaaaaagagaaatcgagtcttgcagaagtaggtaatgatcatcttacccaggggacaactcatcatcgaaaatcacagtctcaacatcatgggcatgaattgcgctcttgatttcagcaactttgcctgaaccaatataagtccttggatttggggtagaaagcctgaacaaaagcagaaaccatgaaacatctgcagctcaaacaagacatgtatagaataacacactaagggaatacaattcatatacattatctcgaaaggggatataattagccgggccggcctaagataggcggaccaaatttacttaagaaaggggtatgtacatatttacaagggaaaggggatataattcatatagcaaaaatgtaatatgattcaacatttcaactggcagataatagactgttgtttgtggcatcttttcatgccatcagggtaagataacaatgcaaaaacttttgaaattaatttatactggattgatgaaaagtcctggtaaagctgtggcacgttttcagaaccatacttcaacgaacattaccatgtccctttgcagaggttgaatttcgtcatagaattccctaaagccagacatagggtgtggcatgaaattgagtgtcattactttcctcagaattcccaatttatgcttttgactgaacagatatgattgcacaaactagctaaccggaattttcagtccatatgatacttttccatcaatattagttcaccttttgcacatgaagcatcacaaagatggacatccctgctatacatatcccccacaggaaaagataatgtgtagcaattatgttttgtttatgcaagaaacgaggttgtatagcaaaatgcatagtcgcataccatttcttaggaagcataaccacactacaccaccacattcaatcaattatatggcacctaacgccacgccaacaaactacaacatgacctgattcgggacttacttttgataggttgagccgacaaccatgagcccggcggtatccgctagctgctccagctcctcaagtgattcctctatactgaacatacttcctccactcctcttgcactcaaccccaaccaggtatgccttctcttgaaaaatctgcaaaaccctccaatttcagtaaaattcgaaccaacaaattttcaaattgctatgtacagagtgaattatccattctcacatgcaacacaacacaggtgagttaacatcccaattagttcagagagaagagtttaattggacattaaaaagatagataaatctacaggaggccacgatgaggtgccactacctccttgccgttgatgagcttgaaccggtcgtgccccggcgcggcctcctcctcctcctcctcctgccgccgcctgctcctcaccggagccctcgctggctcctcctcctcctcctcctcccccgacggtgccgaatcctccacctccccctccccttctccacctccatccgcaactccgggctcctccacctcggtttccgcgggcggcgcggcctcgacgagccgctcgtcgagcgcccgcgccacgccgaagctgcggcgagggcgggagcagcggagggaggcgggcctccgttgacagcacgaggaggcggaggcggaggtggaggggagggggagcgaggcggtggcggcggcgccggtgaagaagcaagcggctctcatggcgcgcggcgacggcgagtgacgcggcgagtcttctcggcgagtggcagtgcggctcaggtggtggatgggttgaggtgggtgaggcgggacacgtggcgcgttctccgccgttggatagcgtgggaaaggagattgggctgttaggtagcacgaatctcgatgcagcccagaggagagtagacactgctctgtgtgtctgaactctgaattttgtgtgtctgaattttctgtaacagcttacgagcagtacactgaagagcaatttctttttaaaacaaaatcaaaacacgattcggagagaaaatgtgaatgtacgatttgaacccgtcaatgaaattttgcaatcaagtaatactccagaaggcaacataatcaccaaaaaaaagaaaaagaagaagaaacattgtgatcacaaacactgttcatcacagacccatcaaagcaactctgaaccttaactgaagttgagtgatcataaataaagtaaggtactaattgctccgtttcacaatgtaagtcattctagcattttccatattcatattgatgttaatgaatctagatagatatatatgtctagatttattaacatcaatttaaatatgggaaatgttagaatgacttaaaacggagggagtaacaaacagtgttccttgccatcaccatcaccaccaacaacaaagccttctgtttgcattgtgagtatatacattatatataaatacataaattacatcaagaacacccacatcacataaattaagaaaaagaagttatgactgacacatgccattctcacatccccaaaataaacaaagtgaaaatcagcataaattaaaaataaaacatcacttctgaacttcacccatggcaggcagtctcacacaaaccctcttgtgcatcatcatcatcataacttattatctacaccaataccacatgattgaagattgcagaagcccatcatatcactcccaataattacttagagaagaagaagaagaaaaaaaacaagaactcgattctttttcctcctgaattgggtggttggttccttcctccatgattgatccatgcagccaagcaagaaagagagagacagagagagaagcagctagtggacggcgatgttcatggcgctctggtcggagagcttgtgggcgtgtggcttgggctgcttcttggaggctgccggcttcgcggttgcaggttgctgcggnnnnnnnnnnnnnnnnnnnnnnnnnnnnnnnnnnntgctgtcgaggctgtcgcggctggcgcggcagcacggccgcggcgtgctgtcgctctcctccgacgagttggaggcgtccgccgccgtcgaggccttcctcctccccagctttggcgacttgggccgcgtcgtcggcagctgcagagaaaatggtgcagaaacagtcgtgagatcaatgttctttttctgtttcttcttctgaagattggatgtgatgaagttgagagtgttcttgccttcttgtattcagccttgggagaaggagcctcgtggtagaagcttggcattggtgtggccttgaacgtcaggctcttcctcagcagcttcagtgcttcctcttgttctttctgcaggttcagattgtgaaaaattattacagatcagcttctgaaaaattgttcagcctgaggctatgctctttagactgttggtaacaattaatttagatatttgaaagtaaacctgattttttatttattgaactaagagatgcttatggatactgcatctctgattctattcttccagctagaagaatattgtgactatagagagcagttccaactaatcatgaactgtttttaactactgttttcaaaagatcatttctcactaatctctagtactcttgctcatataggtagggaaaaaagtttaggtttagttatatgcataactgaaccatgatcaagagtactgacagaacttcagctactccaaacagtggacaaatttcaggttaagctatctgaacctcaaagggggttatggtgtatggagacagagatgaatatacatatctgggaaatggccgcgtcaaaataaaagataaattaccttcaattttgcctccaactgaatcttctcttcctccaaagcttggtgcttctcctccaacttcatgtaaaactgaataaaaccatgaaaataaacaaatgagcaatttccccctttttatccaccatatttcatattttaattgttaataaataatgtatatacttctctgcgcttctcggcacgttcagtacatctgaaaactgggcctgctggaactgttgtggtccttccatttgatgatttcctgcattttcaagagataaatgaattaggcgctgttcaggaaaaagaggttgtacacaacatgaggttggtgtaaaagttgtgaagcttacgagttggtgagagtagaagcattcccttcgtcagtattagtagcttgcagtgacttccttgtagttgcagatgcacttctctgtaaaaatatatagaaggaattaatgattcatatgcaagaaagcattcaatttggtcagatttatgagaaacttttgtttctttagtgagaaaaatacggcacttttattctactgtaaagaaactgaaaagacatacagtatactttccatatgtttcagttcacaaatttcatgaattccattacttaagtgaaaaattaaagattcatgaaattgaacatgtcaaagaaatggaattaccttcatcttctttgtcgaagttgtcaagacacactttgcattttggaagacatttccatttccatttccagcacaagctttgtcatttgacagatcaggagggtggccagtagcatcatctgtctctgatggagcagcatcctttgcttcttgaacatcttccatcgatgtgactgaggtactgtcacttcctgctgtttctgccattggagacaacagatcctgattttcctgtttatcaccattgttctcatcactctgctgcatcacatctcccttttcagcattattagcaggagatgcttcatatggttctgaattcactggctctgaattcatagcatcattgttgtcagtagacttctcacttgccaagggaacaacattttctgtagctccattggctccatcagattccaaaggttcagagattgaattatcagattgctcaactagaacaacatttactgtggcaggcacttctgatggatgaggaacacttgtatcatcagacacatctatgttgtcactagcaggagtgatagtaacagtagaatccagctcctcattgaaggattgaggtacaatttcaatacccatactactcctgaagaagtgatacttcaatgagtacttactgttgataaccttcaaaataaagatatcacatgttaggacaatatgatacttttttaatcaaataaagacatggagtaagggacaatattgaccagagaaaggaaaataggaccctgcactattttcaaagaactgaaattgacaagccaactatgacaaaatcatttatcctccctgtggacactgaaattatttactacctaccagggtccaggaacatgacatgcataggtggaaaagaatgacgtgtggagtttgacagcatatctgattgaaagctattattttattttgagatcattttattttgttttcttgcaataagttgtgggaatgttgtcattattaaattgtgagcaatcatattattttatttggagggccatgcaataagttatggaatgttggcatcatcaaattatgggaagacaaagggaaaaaaaaaaggagataaaaaagatcaccaagaattgacccctgtactgctacaaactagaaaaaagaaacaaagaattagagcacaagacgtgcacatgtaaatcttgaattgaccaacaaaataattatttgataatttaacatttgaaagtgctcggtgtcctttaaaaagcctagaactgctgtgaattgtacttgttcactttattttaggatttagcagctaagacccatccaatggtaaagaaatacaatttggaagtttgttggcatctaatctgcatgtctgttaaagcaacaaaacagcaagatctccatgaagattccggttgtgcatcttgctaatattataaaattttatcaaatttagataactgaacatttgacgacagctggtacagggccatctgcacctcaacccaaaattaaagtagatccgtacgcaacgagactgatgatgtgtgcagaattattcttgacattttgccaaccatttccaatgaacaaactgaatacatcctaaattattctaaacaagttgatcatttctagtgctgaacaaaatgccacaaaacgtactatctagcatgtattaagtccgaagtccaaactagtatgatgttcatatcttgtaagacagcgacatcacgacaactcaaagtcctgtcggcttataacaatacaacatgacaaagaagataagattctcaattgcgtcattcatgataatgagatcaaagactgacatatctatcatcagctctgcctctttctgatgcaaaaattaacagtaagtttcagagcattgagcgtcctttttccaaaattgagatgctttttaatctcaacgctttgctccgtagctgtacttcccattatctaaactacgagatgcagagaacgacaagagggctaaacagtaaacactttcaccatttcgcatcatcatacaaaccactaaacaagaaatgaagagatgctctttctttcctaactatagctagtagctaatgcaatgtaagttcagataaaatgttaaaacaagagtaaccatcaacaacaacagtttcagataaactaataaacaagagtggcaattagcccaggtttcagagttcagacaaactgtcaagcaacagcagcacttgatgcaggatttgcaggttcagataagctgctaaacaacagagtatcaacactttaacccccaaaaatctccaaaacaaaaccaccccctaactagaaatgctaatcgatcgacacatacagaaaactaaaacaatcagctcatcatcctacttcatcatctgagaagcaaaactgaagagaggtcaccaaccttttgcgtttcttgactcctctcttctcctctcctcttcttggttggcttgttgagttcgattcccggataggcacagtgaggtggtggagggtatttgtaacggggaggaggctgtggacacagtggtgggttcgttggttcaaaccgggttagctcggaggcagctttccatgagaaggggggggccttgcctttgctttgctttgcttttctgcttgggtccctctgctgcctcctcctcctctcttcttgttagctctgctttttttgcaattgttgcaagctgcagcttaggctgtgtttagttcacgccaaaattgaaagtttggttaaaattgaaacgatgtgatggcaaagttggaagtttatgtgagtaggaaagtttgatatgatggaaaaagttggaagtttaaagaaaaaaataggatctacacacggtgttagctgcttggagtatggtggtacgaatgggtaccgggtacacggttggttcgaatgaattgggcggcctcttcttcttcctcctgccttcctagcggttgatcacttgattgtcagccatcttttctgtgttttttttccctttcttgggaactgcagccatccttcttgtttgtgcaattgtgtgatcatctccttctaaatcaccggcatgtaaaagaggagaaaaatagtttctcgtgaaatagttccatttagtttactgttgtttgagtcgtgtcgtaaatagagacctaatgttgtggttgggtttagagagcaacttaaaaaatattgataggtaaaaattttatatctgtgtttttagctgtttaaaagcaaatgctagtagtaaataaataatgaaaaatatattaaaatcaactctaaaactaaggtttaaaatttaaattttagctgcggctgatggtaagccaaagaaaaaacgattctctacggaaattttaagggttaactcgagatgtgtcatatatactccctcgaataaggaacatttgacgtcgggagaactacgtcaaatgaatttgattagagtgagtaacaaaagagttaaacagtagattaggtaagttaagctttactgtcattgtgggtagagtgaaattatgtaagcgtgaaataaaggaacaatacatttcacgtgaaatagttcggtttagtttacggtcgtttggatcatgtcgtaaataaacaacgattacttttctccacaaaattaactcagaaatgttactatggtcccgttcgaatctgattacaggatgaagattaagtacgcacgtaaaacgaaacaaatcatagttaataaagttttaattattaaaaaattgaaaaacagatttatttgattttttatagcaacttctatatatagaaagttttcgtacgaaatatactatttagtagtttgaaaaacgtgctaatggaaaccgaggaaaaatctggatgttgttggagtttagaacggaccacatgatatacatgttccgtaaaaaaaaaaaagacaacctctaaagatgaatctggaaaaatgcttatttaggtttattccccgaagttaattttttatgagatggaaggcgtattgaggagttaaacttatatcgattaattaagtaaaaattaaagtacttttgattatgaaattgggattacgtgggatggaaaatctaatgatactgtcgaataattaagtatagcaggtacggtttgatggtggcgattagagcactgtgttgtcaagataatttgacggttggttggcccggaagttaaattagttggtcgatgactatttgattagttggctgattgctatagttaagccttgtttacgcatgtcgacacttcgtcgtgataggataggtttacagttccatggtcatttcgaatcaacagtgttttgaaggctat

SEQ ID NO: 9799 - DNA, 1224 bp, Oryza sativa
aatcaatatgctttcggtcgttctggtaatagtgcacatggcggtgaggtggttcatcaaaggcttgaccttgatacgacctgcgatccaatggaatagatggatcccacatgggccatggtggttgtggctgatcagggtgagatacccatggttgtggataggtagggtaagatgggtagtaatatggtggatatagtggcaattggatattgctcataggagttcttgtgttgtaattccattgtataggactatggaaggttggctgctgaaggcgtcccatatgcatgggttggtaggttgggggtagtggtagtggtgttgagtgaaatggtggtggtattggtagagtatggaagtacactgaagcattccactctagtgtcgaagtggttggaaatgcaggtggtgatgtttgtttagacaaagtagaagttgataaagcacagttagcatgcctaagatcaaagacttcatgtttagttggtttagatggttgtttatcactcctcttagctggttgagtcactgattgtgtattacctgtaaacaagaaaattgtatcacctctcgcccttacaactggagaaagtccaatatgtcctatataaacctgtctcacctctcgcccttgataactagagaaaatcccaatatgtcctagataaactttagactatgtatcacttcatccttgttagcttgggcctgggtgtcacgcccagaaattcccaaatagaattccaagcagaatgtgcattataatccccgtccaggaccagccggggtacacaaacgacaatgttgacattcagatccacgtcttacaaacatcataaaagtcttacaaaaatgcagcggaaacaaaagataactggagctaagccttgactaaactgcagcgggaacaccactccacaggcatcctcgacggcacggacgaagcctactcctcggggaaaccttcatctgacacaaacccgtcctctggggttgggaaaagtagagcaagactgagtactacccactgtactcagcaagtcataccggaataggagtatgatgcagggaattaacaaagaagagctagagtggttcatttgcataaatactggcatttaaaaacaggaattgaatgcgaaaaggttgtaataattaattagtattaaacatccactgtccaacgctaacccacgttgcgacaggcccaaccgtccacct

SEQ ID NO: 9800 - DNA, 3783 bp, Oryza sativa
gtttaaatccaggaactttagtccctgtcatatcgtatgaatttagagtattaaatatagactacttataaaactaattacataaatgagagctaattcacatgataaattgtttaagcctaattaatctataattagcaaatgtttactgtagcatcatataggctaattataaattaattaggcttaatagatccgtctcgcgaattaatccaggattatagaataggttttataataatttatgtttaatatctataattagtgtccgaacatctgatatgatagggactaaaaagtaagttttagtcccacctaaagagggtcttagctctagctggccaccaacctttgccaacgtcgacgtggctggcaggtgcaggtaggctgcacggcctacgctctccttgctagcctagccgtttaaccaaaccgcccaaaccatccagctagccagctaaccacgcaaagcgaccgtcgccatcgtcgtcgacgccgacgccccagccgccgtcgccaccccatgcacgcgtctccgtcgccgacgccgccaaaagtgcgtagtgtatgtttagttcacgttaaaattagaaagtttggttgaaattggaacgatgtgatggaaaagttgaaagtttacgtgtgtagtaaagttttgataggatgaaaaaagttgaaagtttgaaaaaaaaaaattggaactaaactcggccgtagtttggtacaagtacagcgcgcgtgccgcggatggatggatcgctcgccgccgccgccacagcatgcaagcgcacgcggccaggggttgataaggccgtgcggttgccgcgtccgctttcgccccggagatcccaccgccaccaccaccagccgcgcgtgcgtgcgtgcgcgtcactgtaggctagctagctgttgcgcgcgcgcggccggggcggtgcggtgcgcgtcgaggggatgggggcaaaagcgatgtgtcgagggaaaagggctaattaagccaagtacaccgtacgatcaagcgcacaaccgtcgcgcgcgcgagtggggacgacggcggatgcgggggaaggcgagggtggtgatacgagggctgaggccgtgtttagttttctccctattcctaacttttcatcacattatatcatatcaaaaactttcttacacacacaaacttttaacttttttcaggaactaaacacacccaaaacatatatgagcagattcgaagattgaaccggcatatatcttaaaatctgctcaagtcaaccatgaacacctgttgtcgatgggtgcgtgcgtcgatggcggtggccggggacgaggagagtgatacaactataagggttgggtttgtagtttttgttttgagtaaattgcattggtggtaaggtgggtataatttagtacacgaacttatctaatttgtacgaactaggttcaaaatgacttggcaaggttaattttacctaactgatgttgattaggatgtggcatgtatacatatatactccctccgtcccaaaatataagtatttttagctatgaatctgtataattgtatgtccagattcatagctaaaagttgttatattctgggacggaggtagtagtgagtatacataaaacatgctatatttataaatttgttttctactttatcttgaatttcgtgtgtttctaaccctttattatttctcgtttttttatatctctctctacgatcactatatctcattctatctttttattgaacatgtgtatgactaagtagcaaccttcttatatatatgtttatgtagtatcctaatcggcacataaatcaacaaaattagtcatgtaatgtccttttgatcttaggtcgcacgcacaagataagttcatgtatcaaaacgagcattttacaagttcatacactagattgcacccatctgacacgttcgtgtacgtaccgccgatgtaatttactcttttgtttttttccatacgtgatcaaatttagactaatatatttatgtgtcttatcatcgtaatcacaatcttgttaaattttataaaatttttatgtaactgtttaaaccatgtgtatatatgtatgtgtaattatatctggggtgtacaaattaaatattttccggtagagtatggactgatcgtgtgtgccggccgtagacgtttggggtgctgttcacgctgacctggcccgatcgacggcggattcttctttgcgtgcacgtattcgtatacatttgattaattggctgttttttttttgttttggatcctcgtaaaaaagaaaaaaaaatcatgctgggaattcgaaatgatttacattttgtctttattctctttaaaaaaaacaaactcttccatttatccaaagctatctccagatctgagcattctagccatgccatgcatcgtcgttgtattcaaggtaaagtcaggcgcattaaaaaccggtagcgtgctaactaatttaatatatcaccgttgcatacatgccacgtcataagcaaggttgacaggatcgggatactagatagtatcgttttgctcaaagtaatatcgtatcgtaggatcgtatcgtagtatcgggatactataagattttctttttttaagtttaattaatatttatattaattatatatagccattctgtataaaaaaatatagtaatgatatatatcatgcaaatagagacatttatcaagagaaaccacgtaggttttgatatatttaactgattttttatataaatttaagcatatttagttacattattttcaaaccgtgttatttaaaataatattttgtagtatcgtagggatcgtagaatcgggataccacctaagattttgtaggatcgtgtagtaatgaataggaggatcgagatactataaaaattaagatactatgtgagatcggtatcgtttcggcttggtaggatcgtaatatcgtaagatactaggatacgaatcgggatactgacaaccttggccataagtcttgacaattaaccataccaatattacattgctaaatttcgacaattactaaaatcttgttaacgtttggatgcttttttttataaccttacctaaatttagtagtacgtgtttgtatgagaagaagcttccgaaaatgccagtaacttttagtagagagataaggacaagagtatatttagtttgttaccatacttaaaattggtaataccaaaaattaatagagttcaaagtaaaaaagcaaagtgaagtacaagcccttggacttgtatgtttatgtggtgtcttatatcatcctaaataatcaatcttgtcatttttgtattatcataaataatcaatcttaatgaatctagacatatatatcaatctagattcattaacatcactatgaatatgataaatgctacaatgacttacattgtgaaacggaggaagtaattattaacagtttggttatttcaatctagggtctttctttgaagtcatcctcttattgttgcaacttgcaagagttattgactatttttttctccgattagataggtactccctccgtttcacaatgtaagttattctaaaattttccacatcatattgatattaatgaatctagacatatatatctatctaaaatcgttgacatcaatatgaatgtgggaaatactaaaatgacttacatcgtaaaacggatgaagtagaagaagtacatacagatcatcacaaacgtatatcgtcgtagttatgcgctctcaatagatggagcaccaatgataaa

SEQ ID NO: 9801 - DNA, 1811 bp, Oryza sativa
tcctgcagccccgctttcacttacatagttacatcaaagctcccattgagaaacagaggtctttctgataaaaatattaaatacaaatattgcactggaaaaatttcaggaaaaatgagtttgtgatatccgtatggaacggacactgtacgtctgtacgaaaatactacagcactgacaatcaaccacaattgcatctgagttctgagatgattcatcttttccattttactttccaagtacgtactccttaatcaatatatcgatataagaaatacaattctgaataaatctgaccagagtgagtagatattacaatcaaagtttcccatttacttgtatgatgcaaaacaacagaatattatctatcataatacaaaaagtgttgataatttagcatagttagaggttttgttgtgtcctcttttcaaggttgtttcaatgaaaacatctcattaactaattctgcttgaaggaactaatccatgttgtatggatctagggtatctgatggaaagaggccgcccttgtttccctttcagtaattgatcatagtttataaataagactacggcaattacatcctcatggacatgcctaggattatccctgtccatcttcaagagatctgagtaatgcaagttgtgctttttggctgctgcatgaagagctgcttttactagcattttggcacttccctgaacagaacagaactaggttagcagcagtaacagttatggccatagcagcaaacttgcagccttttaggtcatcaagaaccagagtaccaaacacaaatatgtattgtatgccttagaacacaggtaactaaatggaaaaagaatccattatacacctctcaagcctgaaatgagaaaagtcaactaacagaaacatgttttcatcctgaatcctgaatgaatgtggaggatgggcactaaaattatattacaaggcaagcatactaccagcactgttttcatgctaaacagaactctttttttttgcatgtaaataaatcttgatcatatactgcagcaggctataaatctcgagtacttgaacataaaaattggtgttctttccatgtaattataacatttagtattagtatggacctacagtacttagtaacatcacttggacctacattcttgataacatcacttggacctacattttagttaatttatggaactacaggagcgcaatgagtgatacagctacaatttgcatatagctaatacagtcataccacgtgaaccaaatgagtgaacatcattttttttttgtgtgtgtgtgggggggcacataggcgtatcagaatctcaaatattgctatatgcctaagcctttttactgtgcgtgaacttttttgcaaggcctggcacagcataaacattttgtaaattgactggttttagtcattattgacaacataagaaagctaaacaatttaaatgaagcactatataaacaagatgaaggtgagaaaatagatagttggaagcttacagaagcttgatggtttttaacaatctcaacagcttcctgattggacagatattcccatagaacagctgagccaaatatgatgaagcggtcacttggtcgaagaacgcgtgaaacaatagatggattggcacttagtattggtttgttgagtggttccctgctatactgtgggtatttcaagtatgcatcacctatcgctctcaacacctgcatcatgcatacaatgcataagtagaacatataagattcaaatattgtgacacaaatgaaatggtaacataaagctgacctgcacg

SEQ ID NO: 9802 - DNA, 11182 bp, Oryza sativa
ggtgggccatttcccaccacatgaaggaagaagccgtgggatttcatgagcaatatgtcttcgaggaagtgcaggactagcctctgatgtcatataaggctgtgtttgagggagaggggattgagaagattgggaagatacgcaaaacgaggtgagctattagcgcatgattaattgagtattaactattttaatcttcaaaaatggattaatatgattttttaaagcaacttttctatagaaaatttttgcaaaaaatgcactgtttagtagtttgaaaagcgtgcgcgcggaaaacgagtcacaatctcccctttctcctgtgaacgaacgcagcctaagtcctaattacaacaccaattagctgcattataataggaattacacgagtaattaggttcaaaaagtgaaaccaaagtaaagaagcgaaaaattgaaacctgtgatcatccacttgtttcttctcatccttctgtctgacctcatcctcagttatgctgtctggattttcttccaagataatatcatcttttgtcatcagtctagtcatttcaccatagaaaccacaaatcaattgaatggtaattgtaggatttcttggatcattccaaacaccagtcatcaaagcagaccctgcatcaacagaaccttcactctccacttttgcatatatctccttaagccttgacaagtgctcaatgttgataaggttattgccatgcagacccactctttgcagactgagaccaacattgaaccttagcttcagtttttcaagattaggcattgcatctacctcaactttgagccaaggtacagtgcacttgagtttaaagtacttcaaagctacgaatcctcctttaccaaaactgatcctttcctcaggtgctctttggatatacacagagagagaagtgagtgcaggtaacacactaagaacatcaacatcatgtcccaacatctcactaatggcaatcttcaagatactgagattgttcagttctttgattcacctaggtaggcatgaaaatatgcatgagcgccatgaaaattcaaaccttgtcagaagaaccggaggagatgaaacactgaagtcatcagaagaaatttccataattgaagaatcagcatcatccaatgaaccagtaaataccagaattagagacttcatgtttttgagtttattgagaacagaccctagaagtttcagattggcaggctgtccactagaacatgtcatgtgaagattttgaagatttaccatcttcccaagatccacaatactttctgttgagctcccgctgagatcaaaacaccctaaagtatgaagagacttcatcggctcagtgaaatggggcaaagtagtctcacttggaagaatcaactgttgcaatcgtggcaaataaaaaatatctgatggaacataactcaatcttgcttctatttttaactttgccaaatattgcaactgtcgcatctgcattggtagccttatattcagatggcatgcatcaatatacagatactttaatccaagcaactcagcaatttctgagaggtcataagttacatcatcatcatcagcagataatcgaaggatcaaaactcgaagaactctaaactcagcaatagaaggtgtacagcggagaggtccaaaaaagacaagcgtgcgaacttgtgaccatctcaacccaattggtgttgtcacatcatttgcattgccaaaacgaagggacaaccgacgaatcttatcagcaattcgcacatctgtctgatgattatcaattgcaatggcaaaattgtgctggactgccttagaccgaatagaatcaattatcatgtaatgcactctaaaggacaacacttcattatcaaacctggtctctacaggttgtattagcccatagctgataagctaatcaaaatagatcaatgccaccctcttctcatcatttccatcaactgtatcaataaatccttctgcaaaccattgactcaacagttcatcttttaaaattatatcgtcttcttcatatattccgagataaagcatgcaggctttcaaaggatgaggaataatattgtaaatgaggtccaaaatcccttccaatttagaacttaatgattttttttacaacattccattgctctgtgcttggtggcaatcgtgttaaaatactagctacaatagccatcatgagcggtaagccactaaagagttgtgcaatctcagaagaaatttcctttagatattcatggactctgctgaagaattcatcagattcaactttattaaatggttccttcttaaagatgtatttgcggttatcaacacagcacctctgagctacatgatcaatttctgtagttatcaatattctactgtaaaaattctttggcaaagtctgattgatagtgttccatatatatgatgaccaaacaccatcaattacaataaaatacctgccaaaagtcataatttagctaatccaaagtctcaaaaaataagggatcatctaaataagtgacgatataaaccagggcttaaagtagtcagattttttttttttgaccgcaggatctatacccaacgataaaaaaaaatctaataaacaagttactaaatggaggaaatcaattactaaaaatggaaaatgaacaattaaagctaataaattagattatcaaaatgataagccaattaaaagaaagaattaccttttgtcattcagatatgacttgatctcatgggataaattatccacctcaacagtaccagtaccaggaggatcatgctgccgaacttgtgagaataaactaccgagcaccctcttcatgtcaggtttccgagataaccttagaaaggcacaacattgaaactgaaatccaaacttctgataaagttcttcagcaagggtggtcttgccaacaccacaaagtccaatgatagcaatgaccttgcattcttgctgcccatcatttagtaacccaacaagtttatccatatctttgtccataccgaggtagcagcgttggctggtctcttcagctaacgggagagttaaagacattgttccatttgattcccacccggaacgtctctctaaactaccaagatcataacgcttataaagcataatcaattccttcaagcaagaactgaaacttgagacctcatcaacaattttttgcctccatgacaatttcttctggagctgagaagcgttgaagcgggataacttctcctggagctgagaagtcttaaagaggggcaatttcttccggagtggagaagccttaaactggagagctctttggatcttggcattagcggcagcatggaaaagctcatcaacaaagtcgtcgatgtcgtagcacagctcccgcacctccttcatccagtagttagcctagaagggagggccctccagatctgatggttccatcagataatcttctatcaaaacttggaggccgtctttgagcacacctagcgctttcatctcttccttgtgcagccgcagtccaggctcggagagcaaccggaccagtttcccaaaaacaatatgaatggctcccagcgaggcagtgatgggaggatccatctccccacccctctccatcttcccaacactagagaacaccaaataaaccatggggattgaattacggatagcaggaaattaaacgaatagcgagaaattgatgagagggtgaagaacataccatgcaaatagaatcgaaatcgatcgggaattcgggattatcccatagctatcgataccttgaacttggaggacctgtgcaagggcgggctagggttagatcaagacaaggatatggtctaccagtgagaagtggagacgggcactcaccaagacgaggtttcctcgccggcggcgggaggtcgcgaggaagcggttgtcgccggcggcgtcgctcgagacggaagtacggaagaatccgacgccgcgccgcgtccacgaccaggagaagacggcgctcgagtcgagtccaatcgacacggaacggctccgggaagagacgatgccttttgggctgggcctcgactccgtatcagttatggttatggaccgtgttggattccgtcctcgtttctatttttttttctggaataagttcattttgactcccttaactagtgtaattcatatccctaaccctaaaccataataccagatatctcgacccccaactattaaaacctgtgtaatttgactctctcggtggttttgaagggcggtttcgctgacgtggtgcctatatgacaatattgacctagtcttcgttccacgtgacgttgatgtgatgcttatgttgaattagaattaaaaaaaatctgtggaccatttgtcattcaaaaaaaaatatgggacccacatgctatcctctctcctttttcctccctctctccttttttcttcaccttggccaaagtggtgacagaaagcactttttcctccctctctccttttttcttcaccttggccgaagtggtgacagaaagcactggaacggcgacgacggcatgtgggcgagtacgggagggtggctgtgccggtgcgacctggcagggccgtgccgttaaatttacaggccctgtacaaggctctaagtgaggcctaaatcaggtatcaaatatagctaaaataatgtatatactacagagcaaatgcgatatattaagaatagtatatttttttaactcttgttttgcataatcagaaactgccaaactaaaaacggagaatatttgttgctgttgctggcttgctgcttagtgccttgcatgttggttgcttgctaacttgctattagctagatgaatgaaaatatgaaattggagaagctggctggcggcctggcgctcgcaggagacgagacgttcagactcaagacgaattgaataagtcacagatacgaaaacgaaagataatacaaaaggctgtggggcctcggggctcggagtcgagaatacgaagcgccacgtacgcgaagtcgccatgcggagacatgtgtggactcgaacgggttttcggcgctctagcctcacacgaatacatgggccttctctgattgggctgatttttttgaggccctgaaaatttggaggccttgtacggtcacatggctcgcacgcccacgtgcacggccatgagacttggtgcacgtgtgaagggaatccagggcgagggagggcacctatgcagctactacctcaacgacatggaaaaaagcaaacagtggtgagattcttttcaaagttatcttaataatataatagaatgatagattttgtgccgcataaaagttagttgctagtatcaagcgtagcaaacctaccaccctgcgggtcccgtcaggaagccgctgccctaaaacgggcacgccggcactaccgccatatccctcaactttctaccgtatgatacagctgtagaagcaatccccctcaccctctacccccaccatacatacgctgattcttattaggatggtcgctatctactatccatgaagaatcaaatggtctaaatagcatcaccatcaaggatgactagaggttggggtgcgccgcctgtagacaattaagttaagttaatagatcgtaccttgtcttgtatttataggaaagtgcattatgtaggacaagcacctaaggtgcaaagctaattagggtggcataatagtggagggaaagtcaatagtttacttccatagtgatgaattttacagtcgagttgtagcaaaagaattatcctatgataacacaaggcattgatgtgctcttcatagaacactaattgttgcttagatgtgagctgccttatagaagtggaagacgcaaatggactgaagatgtatgttattctgcactgcaaaatttgtccatcatttctttaggctgcatcgaccatctgttgatacatgtaaaaccatggtggttgaatcatttcctgctgtttggacctggatgttgattgttttcttgccttccatgagtggctgtatgtacttctgggaaaattccttagtaaagtactgtaatggagactgcatgttagctttttgttacaggcataaaaagaaaaatagctactccctccgttttatattatagactttttagtattattcacatttatatatatgttaatgaatctaaacacatatatgtctagattcattaatatctatatgaatataggcaatgctagaaagtcttataatataaaacggaggaagtattaattacagttactaaaagctgaatagtatgcggaagaacttactatcctatcttgctccatgaacgtggtgttgatagtgacaatgtagaatttgcttgattggctcaggaactgctcgatttcagttctttatgtcagatgtgacttcaacgttttttgcacaaaagcacagatccttgaattcacgtttggtggtccctatgggaaaaataggtaaatggtagtttgtagagagtgatagttataatcaggatgcatacgatcgaagattgactgtagctggtatgctacgttagcaaagggaactaaaatatataatgtaaaaaataagaatatagatgtttgaacagaacggtgattcatagatgaggttttagattttatgagtatatggtgagatgtatctttactacataaatgcattagggggtgtttagatggggctaaaactttttagcccatgtcacatcggatgtttggacgctaatttagagtattaaacctagactagtaaaaaaactaatttcataaatgagagctaatccgcgagacgaattttttaagcctaattaatcaataattatcaaaagtttactgtagcatcacattgtcaaaatcatggcgtaattagactaaaaaaatcgtctcgcgaattagtccaaagttatggaatgggttttgtaattagtgtatgtttaatactctaaattagtgtccaaacatccgatgtgacagggacttggaataagtctctagaaaccaaacaggcccttagccatctaatcgtgttgtcatatgatagctgatgtgactgtatcatgtccgtggattgtgtgattctattgtgcccaggtgtctgcacttaactgtgaacagaataaaatttcagaaggcagtttcaattggatagagatggatactaaatttacctgatttcttcattccggaggcaatatcagttgtaagctctttgccactgtcggaggatgtaatctgaaatgcaagaatgggaaaggagcataagtgaaatcatatatatacaagtactcacaaaacggttgcgatttaggtggttgaatcttagcatggatgatacgggtcgaaccaagacttaaaaaccctgaaacaaatgctgactataagttgctaccaagatgaggataatagcaggggaaatagaacagcaggccaaatttataatagcatgtatccaattaacccattttttagaataaaaaaatagtgatggtgagtcgctgacagactgccaccaccactattttatcctagtagtatagattaaatatttttagagcaatcgtgatttattgagtatacgtgaccatacgacgtgctagtcctggttttatgctgtaataataaagtggtaaccgagtaaaataagagcttatataatagtaggctataagctagttgcaagaagataaatgaggagagagaacggcagcgggctacagatttatagccagctgtagtacggactacaagatacagtgtgtgtatgacaggtgggaccaaatattaataggtagtatgtaactattgtatgaatgatctattagggcacccacaatggttatctataagctctctacaagagatccatgtcagcatattttcctacttagaagatattaaatgaagagagagagcaaagctatctactaacttagaggtagtctatagagaaaaacgaggcaatgcatgagagagctatagatacccatgtagacatactattgaggtggtttactattaatctagtctattactgagatgtgcatgttttatagataacaccttactttaccattgcgggtgctctttaattggctatatagatgaattggagttattagttggctatagtattaaacttgctctaagaagctcaaactacaaccggagttgtcgatctccgatccgacggctcacattaaccgagataccccttaacccgctccaaaatatcctcacccgctaaacccacctccactctcctccacccatggccgccgcggccatggccatctccccttccatccacctccacctccacctccacctccaccacccgcctcgcctccaccgcctcctccacctctccaccacctccccctacccatggctctccgcctggccgaccgcccaccgccgccgcgtccccctccgccgccccgcctccgcgctcgacctccgcccggagccctccccttcctccgactccgacgacgacgccgccttcggcaccagccgctcctcctcccgctccgccatgtccctcatcctctcccgcctccgcaattccggctactcctactcccccccggagctcccgccgcgcccgccgaggggctcggtggaggacgtgttccgcgtcgacgacggggtggtgccgaacgcgcggggagggttcgacgacgacgcggagtcggcgctggtggacgcgcggttcccgtgggagctgccgatgccgccgcccgaggcggggcccagggcggcgaggtcgaaggcgtggatggcggagctgacgctccccgaggccgagctgaggaggctgaggcacgccgggatgaggctcaagtcgaggatcaaggtgggcggcgccggggtcaccagggagatcgtggagaggatcagggacaggtggaggaacgacgaggtggtcaggatcaaggtcaccggcacgcccgcgctcaacatgcgcctcttccacgagatactcgaggtgcattgccgatttcgcaattattgtgttccttgaagttgtttaatgcagcactatagattattgcaagcgggaaaatgctgaattgctggaacatttctcagaagttaaactaattgctagacgctcacgctgcatcataaatttagaattggtgaccttttcagtttttcttagtggagttgtaactagtattgatgccctatgtgaactacaggagttttaggatttgattactggtagaattctttgtgatttggtacttgggaagcttaagcacaaaatgtgaggttgagcacggtttacttcaccgctttgtttcataaattgcttatgaagttatccctgagcaataccatttagcctgtaaagagattcggttgttgtgatgaactggagagtgaaggtcgggtgtgtttacagtggttataactattggtctctatgataattattgatactgttgtttgctcactccagttcttcccagctgttgaatttgttcaactgagcacctgacatccaagtgctattatttagctttgttgtaaaaaggttctgacgaaaaacgtttaaatgccaagcaaatatttcagcaaatttcatgcttataaaatcaaattttggaactaaactgaattgaggactaatgtcgaaagcaagatgttgtatgctgcataaatattccatttttgctgctgtaatgtagctcccatgataaataacagagaaattgacttaccggctaagtggaaattatacaaccgaaggttactgtggatctgttaacatgtacactgaatgtataaatttcttaatatggtatttcatttcttcattctgcaaccaacctgtcagatatttttggatatatgtgttatgtgcctggtaactctagttaatctgatctctgtttcttttgattgatggcggttagagaaaaacagggggtttggtaatatggaggtctggaacttctgtttctctgtacaggggagtagcctatgacatacctgagcccactaaaggaacaagtaagaatacacaaactcttggtatgaagtcctccatcaaagagccacctggtcattcgttgctgcctaatgagaaagtaaacgagatgcaagacaacaatggagcattggtatctaatgctgagaaagatacactagttgaaccagttccagaaatcaaatatgaagatgaaattgacaagctattggatgagcttggaccaagatacgacgactggccaagacctgatccatcaccagtagatgcagacttgcttcctgcaactgtaccaggatataagccccctttcagagttctaccatatggagtacgaccatctctcagcagaagggacactacaaatttacggcgtcttgcccgtgggctgccacctcactttgctcttggtaccttttctatcatttttagctaattattattatttcaatcaattcttactatgttgtagacttgtagtgacccttttcttttctgatgaatattagggcgaagcagacaactccaaggcttagcagctgctatggtgaagttgtgggagaaaagttctattgcaaaaattgctctgaaaagaggagtgcagcttaccacaagtgagaggatggctgaagatataaaggtatatatacactctttaactttactatccccttggcatatttagtgctttagagcttagaaatgttcatcgatttggcaacagcacagtacaagtttatgcatgcaacataaatgtttcgagtcctttctttcacatatattgagataaaagatacaacatcaattatattcctcctttttttagaaccctatacttttatgcgcctcgttttttgcctttcatttccctcgaaaaagtctgcatttcatttgtctagctaatttaatatgttgtgttcgtttgagtttgagagaatatagcctatggaatctaggaccttgatgtatttattagaagtcaattatatgttatatcattctctttgatctggaaagagaccatgcgttgatacatgcctggatgtttggtttctgaatggttatttgtagctccagttcatttgtttaggtggggcagaagatagctactgactgatgattccaaggagctgagaaagggctgcaggaa

SEQ ID NO: 9803 - DNA, 705 bp, Oryza sativa
atctagtacatttgaatcctcatattcagagacagtttgtctaatacaatttcacagcctttattcgatataggagatcattgaacttcttaaaatattttcaccattcaatttcgtatgttgttaaggaatgaattgattattcatgatgctctttttgtacaccagaaattgacaggtggtgtaatgctttcgaggaacaatgactttatggtcttctacagaggaaaggatttcttgtccccagaactcgcggagaaactgctagagagggaaagatgggcaaagtccttacaagatgaggagcaagcgcgattaaatgcagcgtcttccttttcttccagaactgaggcacctgtagagcctactgtggctggtacccttggagaaactcttgaggctaactctaaatatggaaataaactggatgagaattatgagaacaagatgactagaactgtagaagctgcaagacatgctgaccttgtaaggaagctagagtggaagctccaacttgtaagtgagagtttgagtagtaaggctattttgttaaatttatcagtccgctttgtaagatttcatcttctgaacagtccagtttttatagcaagattgcattttagatcagtttagatatctcaagataaatatagcaacttatatggtgtacagactagccttgcatcagaaaacaaaaccaacaca

SEQ ID NO: 9804 - DNA, 5841 bp, Oryza sativa
ttcctgcagccctttcgacaattcggtagctgtccagaacggtgatgatcgaacctcccttgatggcagcgacgccaattctgacgacgagggtgactactctgacgaggacgatgatgaagacgacgacaatgatgaagaggatggttttgattatgaaaacgatgatgaggatgatgtgcctccgactacttctgatggtgatctatacaaccacacggattttggtagttcagacagtgaaaactatgtttcactgtcagggaggggtgacccagatgtaaaaagtaaagggagtgcccttgacagcagaaactcgtacagtgagcaatcaactgaactgacaaacacatgtagttagatgcactgcacagcacgtaaataggactactacccaatttatttggtcggtgccatcgttggctgctgctttcattacatcttttggagctgcattcactggcgtctttactgcaagctggagcctgattgactttgatcgttggagctgatttcactggcttttttgaccgaaagtccagatctacacgcatatagaccaacatgaatcttgtgcgtgagttcttattatggactatattttggtccaatttcattgcttagaaatatgttttacacttttacagatcatcaggagcaccagcagagtaaaaggagcaacttcctgaagccctgatgatccttgtaattagtactccctctgtcctaaaatgtcctaaaatataacaatttttagtcctcaggatttgtcctaaaatataataacttcaccaacattctcttcctaaccaatcacaacccttcaccgtttacttttcctacctaccttcactacctatcccatcacaatcctttaccattttctacatactttttcttaataaccgtgtttaactctaaaactttttatattctgggagggagggagtaattgtttaaaaggtatagagaactcctgtgttccaaattaaaagagtcaaatagttccctccaatacatgttagtataatacactctcagtttgatcaattttatagacaccataaaagtatgtttaataatggattcaataaaactaatttgttatcgtaaatgttgttagtttttcgacaaatttcgtcaaacctaaaaaaaaatagtttgtctttgagctggacgggaggagtagattttctttgaaccactgtaattctctgacgtggcgagcaacgattggctgacccacgccggatccggcccggcccggcccacgaacatactactgctgaagctgcaaaggaacagggctccgcctgacgcggcggcgaacctccgtgtgctgccgtcgtgctggcgctgctccgggcccacttgtcatcgggagagagagtaccagtacagtagaccagagcgctcgatccgatgctgttgatcgcgtaggataggatacaccccacaccacccggtggctgtggcttgggcttcgcttcccaaggcaaatgctcccggaggaaacgaaatttgtcaacccaaccgcgacacacgccgcgcgtagtggaattactactagccatgggtttttctttcttttttttttctctctttcagtagcaatgctcctacactagggctaagttcagttgatagtgttgagagtgatttgcgcatgattaattatatattagctaatttaaaaagcgtgaaagtaaaaaaacgagaaatgagagttaggagccttaggagaaataactaagtctaagcataggtgcaaatcataaataaatggtgcgagggatggaattttacgaataattacttttaaaaagtactatgaccgttctaaacacacacaaaatagttggtacagtatgtaaaaatattgtacatgagtgataagatcaaaggaacttgaaatcatgaggtcatgtgatttacttattttgttttgttgcattctatgtatataatagtattatataatttatcgacttattcaatcgaagagtctggtagcaactccgtgttacgaattgtagaaaaaatgacgtggaatcaatattgcatagtattcaatatcgtgggtgttttaatttttttcatcaaatagtcctcccacctagattactctagttgggataacacagacctaccacacgagttagaaggaaaagattttttattggctccaattgtctagtctaaccaattaacatttcttcatcatgttgacaattattaggcaaaattaagtttatccactgtagaggaggcaaatattcatattatgcatccgttgtgtacatggtaattttagacctatattgatgtcttcccacttctcttaatttgctccaataaaatagtttctctctgttatttttaatttgatattgtaagtaaaattggaggtgtagactagaccgaagaatatctaatgtgtaattaaggtttcctccccacttcattcgtctcataaaacccaacttagaatgagattagctaatctattactataatgaatatgaacgttctcctatccaaattcactgtaatagattatgttccatctcattttagtttaggttttttttcgacggagtatgttctaccaaacagattagttagttagtattgaaattataagcatataatgatttaatttattccataaataaatcatgacattgcaaatgtaaactaccataaacgcattattagatctatacatgtaaactaagcagtaaaacatgaacatatcaaatatgcacaacatactgagcacgtaccgaggtggcggaaagaccggttgttcggcaagaactactcgcggttgcgggcgtcgacgaaggcgcgcagcacgcgagcggagaggaaggcgagctgtcacggacgaacagggagcagtcgtgcgaagcgcttcccaaaaaccttattactgtcgccttctcccggtgcaggacgtcgaagacagaggttctggagacctgctctcccgatcgccggtgcacgccgacgagcgggatggagtagtctacaagcgacggcgcagcacagagtaagaggcaaaccctaaattgatttcgcgtatcttgtgtgaaggcggcgactcgcttgatcagggcgcccgcacgatctcccggtgcaggacgtcgaagacagaggttccggagaccagctctcccgatcgccggtgcacgccggcgagtgggatggagtagtctacaagcgacggcgcagcacagagtaagaggcaaaccctaaattgatttcgcgtatcttgcgtgaaggcgacgactcggtttatatagagataggtcgcttgatcagggcgcccgcacgatatatagagataggtcgcttgatcagggcgcccgcacgatatatagagataggtcgcttgatcagtgtgtccgcacgatatatagagataggtcgcttgatcagtgcgcccgcacgatctccactgatagaaattgatttcgcgtatcttgcgtgaaggcggcgactcggtttatataggataggtcgcttgatcagggagcccgcatgatatatagagataggtcgcttgatcagtgcgctcgcacaatctccacttcgcaaaacaaaaccgcaaaagaaggctaggcgaggcgagtgttccccctcttctctccaccacacatgctttaattggctaggagggcatcatcccttttaaagaggtccccctcttctagaataagtaaggtggtactaaactttccatgtatactatctcataaggtgggcttttatgattttctaaagaattaatctttgaatgggttaaggcccatctattaattcaacatttagcacgtcaaaacaaatgcaaggatccattcgcagcccctggctagccgctagctactcccaattactagtactaatcaaaatcaatttgcatgtactattaaaaaacaaacaaacaaacacttaccttttgcactctaatccatatgcatgtgactctcagaaacaatatccacgaaaccgagcaaattattaatcaagcaaacaaacacatacctttcgtactttagcgcaaacataatctaagctagtgtccatatcattaaaaagtacacttagccattctcacaaagtactcgtacttgacaccggccaatggaagggacaagcaaaataaaattaaaaaaaaagaaaagaaatccccctgaattccagtgaagtggccttcacgtgaccaacctaatgagtggcgatgcgttcagcttcttggtgagattgaactgcacgtgacatgtttcaggcttgagagtgctaggttgagtgcagctgtaatcacacagcactacactacaagtgtctggctgcattgcaagaagatccaacagaaagaagaaaataagaggaagaaagagaatcaaggttcaaggaggattttcagcaaaaatgaacgaaaaagaagtactaaactaattacagacagacaattatacatatttatttggtaattctctatgagtggttgtgcccttttacacaaatctagggttttgtctgactactatatattagaaaattaagttaatctcagcaatagtttgaagtataatagtctgtttgacacagcttcagcttggagcttagccaaacagttaacacttcacctaaaatagaaacggagctaggtgcagcgttctcataaaataaactaaagatgtggacctagatttagactactccataactcatctttaaacccaactcttattttaggagttgaagttctatcgaacaaaccctgaattacaacaacacagccaccacctctctttgcaagtctgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaacccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccaagataaataaattgacgggacgtttcagtgcaaacataagaacactatatgaaatctccgttcaattgatagctcaaattttaatcattacatttaagcacaaaattcctgagagtagaaatatatctaagttgtcctctcaatctatccaattaaacccacaccagcaacaccaccacccccaatggaaaccctatttaccaccgacatcacaaaacaggacagccatgatggctccaacatggaaaccccatctcttttcccacaaaaaagccatcattaataaggaaaagccactaattaaccaacctatataaaaaaaagcacaaaaagaaaaaggacgggaaaaaaggcgagaaaaaaaaagagaatttccagaagcgcgtcctgacacccgtcctccccacgaaagagagagacacaccgaatccaactccccgaaacccccatcccgtgggccccacacccacacctcacactgacagtgggcccgggtctcccaacccgggcccacacgtcggcgagacgggaacaccgtcccattcctttgcctcctccccccacctatgctgttttttgttttgctttgtttttttttgctcccactcgataact

SEQ ID NO: 9805 - DNA, 1928 bp, Oryza sativa
aggagggagggagagggaggcggcgctgctgctggtgctgatcgcggcggcgtgcggcttcgtcgtcgtgctcctcaacctccccgacggccgcgccctccccggagccggaggagtacccggtgcgcctctctctctcgtggaatctactacttgctcgttcccgttcatcctcctccggcggccgcccgcgctgatgaacttcgcgattcctttaggcatttggtgctctgattctgattctgattctgattctggcgtgctgcttaatttagccgcgtgcttttttttttgtgctgttcctgctgcgaactaatggcgatggcttgatggctttgcggtggggttgggtacaggtgcggttggggagcacacgggagggacccatgtgtcggtgaaggaggtgggtgattcggattcgagttctagttcgattcgattctactctgttttttttttctctccaattttctgtacattttttttcaaattcagttcagttgttgattcagtgttggtttttttgcagaggcggatggtagagatcgtgagacagcagcaggacgtagcagcacaggaggtatgtaaaagttagcttgattttagctgcatgtggatgtgtatacacattgtgtggttttcgttcgatttcgtcttggtggagtagtgtggtcgcagaatggagtagtgacactctctcagtctctctgttcaatccataaagatgcagagtgctatactgctatcggagtatcgattttgttgtgctcagtgatctgttctaacctgagatgattcatctctgctgaaatatagcttctggtgtaaggggaatgcttagtcttctgacaggacagagtgaagtaaattgaattagggatgagatttgggtgccctttttgtgcatttctgacacttgtcctagtttacagtggagacagttttgtgttgcatccctgagcaatatgcgtaatgttgctcaagctcaactaactgtgtttggaggctagtatagatatccaatcaatgcaaatttagtgaagtataacttctggtgagtggggaatgcctagtattctgtcattacagagtgaagtgaattgaagaagtgatttttgtgatccttttgtttttcattttatacagttgtcctagttcacgattcaatcgattttgttttggtcccctatgggatatgctcttttgctccaatgataatgttttgtcttgactggtttggataatagaataaatattcaatcaatgcacttaagagaaactgatgtcagttaatttttctgcagttagaaggacaaactgatgaaaatgctgcagaggcagatgaaagaatatctagatctcctcctggcactaaagagaagttatggatgatgcaagaccagctaattatggccaaggcctacttgcagtttgcttccctgcatggcagtgcacatttagttcgggagttgaagttgagaatcaaggagatagagagggtgataagccactttagcagcagttcccgtgtacccacgaggtaagctataatccatgatctgcaagtaaaggattgatttgtaatagtagttcagtctcacaagaataaatatggatagttgtgctattgttaccatcaatagtcagttctatgattgaaaccaaagcaattttgcagtgcactgcagaaaattagggcaatggaaatgaccctatctaaagctcaaagagcctacccacattgttctcatatgacagcaaagttacgtgcaatgacacatcaaagcgaagagttggtcagagcccatcgaagcgaaacttcattccttgagcaggttgcagtgaggacattaccaaaaagccatcactgcctagcaatgcgacttacctcagaatacttcctgttagatccgaaggaacgtgaattt

SEQ ID NO: 9806 - DNA, 347 bp, Oryza sativa
catggcctgcaaggtttcaggcagcgcgtgaacgtgaatgggtcgcaaggccgctggccctgcgccgcccatgcgcagcttgatcacactgtcggccagcaaaggaatgctgaggatgtgatccaggtggctgtgactgatcagaatgtggttgatgcgggcgagctcgtccagtcgcagctcacccacgccggtacccgcatcgatcaggatgtcgtcgtccagcaagaacgacgtggtgtgacaccgcgccgcgatcgagcccgagcaacccagcacacggatcatctcaaggcctcggtggtgcgtgtgcgcatcagccttgcatgaactgcatctgggtgccc

SEQ ID NO: 9807 - DNA, 722 bp, Oryza sativa
  unsure (1)..(722): unsure at all n locations
gagaggcagtatccataagcatctcttagttcaataaataaaaaatcaggtttactttcaaatatctaaattaattgttaccaacagtctaaagagcatagcctcaggctgaacaatttttcagaagctgatctgtaataatttttcacaatctgaacctgcagaaagaacaagaggaagcactgaagctgctgaggaagagcctgacgttcaaggccacaccaatgccaagcttctaccacgaggctccttctcccaaggctgaatacaagaaggcaagaacactctcaacttcatcacatccaatcttcagaagaagaaacagaaaaagaacattgatctcacgactgtttctgcaccattttctctgcagctgccgacgacgcggcccaagtcgccaaagctggggaggaggaaggcctcgacggcggcggacgcctccaactcgtcggaggagagcgacagcacgccgcggccgtgctgccgcgccagccgcgacagcctcgacagcannnnnnnnnnnnnnnnnnnnnnnnnnnnnnnnnnnccgcagcaacctgcaaccgcgaagccggcagcctccaagaagcagcccaagccacacgcccacaagctctccgaccagagcgccatgaacatcgccgtccactagctgcttctctctctggctctctctttcttgcttggctgcatggatcaatcatggaggaagggaccaacca

SEQ ID NO: 9808 - DNA, 263 bp, Oryza sativa
ctgctgggctactgcctggagctcaacaaccgcatcgtgctctacgagttcgccaccaaaggctccctctacgacatcctccacggtacaaaaaaaaccaaattaaactcactactagtagtactcatcacaacatatgctgtgcatcaacgacgaccattcacgtgtcgttgcaccaattgttctaaaggaaccccgtttgaaacgcataaattttagggaaatactacaggtccatatcctgttcggacaggatgatacct

SEQ ID NO: 9809 - DNA, 4906 bp, Oryza sativa
  unsure (1)..(4906): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcctaacaaattaattaacaaatagtgtatatgttttgtaggtgctcgagcatgcattgctggaggattcttttgaggcaaatgtccgtgactacaccaaattgatccacatatatggcaaacaaaagctattgcagaaagctgaggatgcattccatgccatgaaaagcagaggtttgccttgcgatcaagttatgttgactgcactgatggacatgtacagtaaagccggagatctcactcgtgcaaaagaaattttcaacgagatcggattgcttggcctaccgatggataagcgtgtatacggttcaatgatcatggcttacatcagggctgacatgttagacaaagcagaagacatgatcagtgaaatgggggatcagcagattgttgcaggaaaggaagtttacaaggcattgctgagagcctattcatacaaaggcgattcagaaggggcacagcgagttttcgatgccatacaattcgcagggatagtacctgacacaaagctttgcgcacttctggtgaatgcttactgcctcgcggatcgaatcaacgaagcgatgatagtaacacggaatatgagaagcgcgagaatcacaccgtgcaacaaatgcattgctttgatattgggggcttatgagaaggtgaacaggctagaaggagcactggcatttttgacagagctcgaggagaacggcgttattattggccaagaaccttctcagctgcttgcaggatggctcagaagacttggtgttgttcaagaagtcgaacaggtactgaaggacctcgctgtagacaggaagaacacccttgaagtagacaggaagaagaacctcgcatcagacaggaagatcaagaggaggaggagcaagagcaaacgcagttttgcatcatctctgcaacgcaagtgattagctagctgcaacacaaacctgcaacattcttgactggcaacaaggacatgtgctgccccatgagtcagattacaatgcaaacttgtatacatgtttgggatttcacaggcgatactacgataagatggtaattaagctatctgaaaagaaaaggctccatccaaggtgatatgcatcacatgtaactcttagaggaacccctaggccctaactagaattttgatacccagaacagcagcaatgttacaaggaagctctaaccagagcagcaatgttatccttgacacttaagttgatcatgactcattatcaacaatgttttggactttttcttctttctcttctttccttcagtggctgtcctaggctcaacatcttctgaagcctccggcttcttctttttcttcttcttgggagtttcatcttgttcgagattgccattgactgccatctcctgatcctgtggctcctctagcttgtgcttctttttcttcttattctcattttctggatcagtctcttctgcagcaaccttggcaggcttatcaaggtccatttcttcaccatcagcttcagctttagacttctttttcttatttttcttagcagatgtgtcgttcttctctttttctgaaagaatttttttggccagcgtgtaaattaaaaattaatatgcttacatgaaatacaagttgtaccaatctgacagatatgaatgaacaaagagcccttaccaccaccatcctctgagacggcatttgtcatatcattaatagcagctttcatcacatcaaggttcttacgcggtgcaatacccttgtcatagaagtctagtctctcctcaacttgttcgcgcagcttctgaccgaaaactgaggtattcaactctggaatccacaatcaaatgagaaaaacatagatcagataataaccatgtgtaaagcatgctaacaaagttctcaactaacctgaataacagtcgatgcgtgaggcaatggaacatttatttgccaggtatcgagctattctgcccttgttcctagttgacgcacggccaataaaagatgagtggaatatgaggccatacttgggtgtgttaccacgagttttcagagctctgcagttaaatggagagagcaatcgtaagatttcacagatcataaaggtaaaaagatttgaaatatttcactttaaaagactttgaaaggaactgacaataaccaatgagggattgaaagaagataagaagatcataagtattaagtacctgaaaagtgccttttcagcgccaagaatttgaagagtggaagcagcgcacttcgcaagatttgaaagactgccagcatgagagattaaccgagctccaagcctccaacaatttcaccaatcaatgatgtcagatttggtgcaatgtcattcatctttgttactagatactcataaagattttttctgtattcagatagattcatgaccctttgagcgaactgttggacattgatcaaatcaactggtgaaagatcctggcctgaaaacaccatggagaacataagtgaactgcaaagaagccactactgcgactattagggacatactcaattatggagcaaattgtattatagttacccatggatgcctttgctgcttcaacaatttcttttgccttgtcctcatctccaattatatctgctaaagctgggatgtctttttctgctaaatcagatttgttcaccacaaactttgcaatcttagaataaacgtagttatcattcacgattttgaccagctcaggaaaatgccaagaataccattccctgcattgtggttaagcaccaatttattacatcgataccaatatcgcacagagtattttaaacgtattgcgtcaacagaattggtaaaaataagtttgttaccacgcccatcacaagcataacaaaacatgagataatgccatgtggacggtttgatatctcgatggcatatagctttacattttttttttttgactaactcaccggggggggagagattccccacctgaatttatcattgcataaaagagaggaaagaagaggcttgacaaagaaccaaattgtaatcacaactaatacagatatacatgagagtgttccagtcataaacgtcgcatgcacttgcagcatgttataggaatcctccacatggtataccactacaccagaagtacccatacttgagaatttaacatttagatacatggaaaaatattaaattgcattagaactcactcgaacattcagcagagatacaaagaggatgaatgtgatcagaggaatcgagcaaattcaatttaaccataaaggataaatagagaggccatgctggtggtccagtctttctcagctggaccatgtgaatgtaaagatggtataactgcatgcccacggcatagcatttctaggagtaagataccaaaatataaccaaagacaatctgggataccatggagcaaatgaaatcaagaacaaacaactagaatattttcaggacacatcagcatcaaaacataattgaggtgattaaattccagtcacaacatctaaaaatctaaataaaaatcactaaacaatgaacatgtaaattaagcaaaagatggcaacaaacctcactctcatggagaaggaattgatatccttatcaagtgtatccaacaaaaaaatcgcttgaattaccatgttatccacacggttcacattgaacttaacctttgccctgctatagctatgccccaggcctagctgagccttttccaagtcagttggctgcaatcgaaaacaaaggagcaagtaaacaaacaataacaggaaaaaaaccattttatgcaaggaacatatgaaagcatcaaagcattgcagtccaacaaacatggtagcaataacagagggttataatgcagaacctctctgtatggagttccaggcaaatcacttcatagtctagtaaagttgcattggataacaaagatgctatgtcaagcagcaagtagtaaaatcctatagtcagtaactctacagaccaaattcacgcaaaataaaatttaagctaggagcattagaatttgtaatttgatcaggacttcaagttttccgagtgcagtataagcatcaaaacatcgatcagcgacacaatactattgcagtaactgagattgcaccagtgcagaactgcagaaggcatagtgctaccatccacccccacatggccacatgcccctattcagatcagttacaatacgatgtcatcaaacatacagtagaaacaagcgcaaatgtgaaatcaacaaccttgagttgatcaatgaaatgatcgaagtgtagccgcactccgcggagcagttcctggacgaactcattgcactggcaggggatcccggtggcctcggagatatgggacccgaccttgggctccatgaccccgacgctgtacttagccttcttcccctccttcaccttgggcaaattgagctccaggaagctcctcagctcatcagtcataatccctgcacacgaccactcaaccatcgcatcacctatcaatcattcaggagagcgagcaggggatcggcggaggcgagaaggcgccgtaccttcggagatggcgttgcactggttgagcgcgtcgacggcggaggagaaggggagaagccggcgagcttgacggccttgctgacccgctggagctcgagcacggaggcgcgggcgg

SEQ ID NO: 9810 - DNA, 8333 bp, Oryza sativa
agtaaaattttgggtattcaactaattttattagatatatgtgtttttcttttattactaaaagctctttattttggccaaaatccattgctatttgggctgttaaaatctgaaccgttctaatacatttttacagttttggtatttgttatttgtcatacgtctctgaggtaataatgtcagtaaggacaaaggaagcaatatgcatagacaatatcgttaatttactccatcgatttgagtgaattttactttaagccaccttttgtcgtataagtttcacttttgaacacccttaatccaagctttttattttggactagctaacttcacgtttgttgcattttaaatcacgtcaattctcttatatggacatgtttattctctactatgacaaatgtatggcacgcttgtaggcacataattttgcaagcgtaacagagccaaacatgcttgaggttgttgatgtgctaaagaagcggtcagaggtacttgtaggggttaatatgtgtttgtgcgtgtgtttatagtggtgagtgtacagtttatatgagtgcttgcctctatattgtgcttcgcaagcttgagctcgttgacgaccgtactcctagaaaggagcttgtgctcgttgcatccacgagggtggcggcgtttggatgaggcttcgcccgtctctcttcgccaaatctggaagtgttgacaaagatgagaaggtctacactgtggtgatgtagtcgaggtaggtttgtcactgtcagactcgggtgctgaggcgatagacacgttgctaaagctccgatgccaactcacacgcactagctgtctgactcagcgagaaactcgcagcgacccaaactatggggcttgtagcatgggaggaatcacaacgataagacatgactctagatgaaactaggtgatatgtctcttgctgtgaaatttacggatgaataagtgctagtaaaacattatagaaatgatgatttaaaatgttgtgaaaattatggaggaagatgattcgacgtaattgtatgttgaactttacaatattatattttagatgacgtgttatgtttgtatgatatttaaaatgctctagaatagtaattgttaggtggagctccgacgaacgtcgatggagaaaatgcacctatgaaaaaaaaaacctcgtccacacgcaaagagacacacaataaaactgcttttgataactgagggaactgtgtataactggttccggggttgagtgatggtaattaaaccgagggagaccaaaataaacttttcacctttattttatggactttttttttatgctacaccgcctgaaggcctcacagactcacagttttaccgggccgtatccgagcccatcgtttagcttcgattcgaccattccccaaatcccaattaactgaaaaaaaaaaaagaaaaagaaaaaagtctcctcccagtagtgagtccaaggagagggtattcgaggggttcagtcgaccggcggcgagcatggcggcggcggcggcggcggcgggtctggaggaggccctcaggcccttccacgatagggcctccgatgccgaggttcgcgctctcgtatccttgagttcctgaccgtcgtctatccgcgcttcgtttcgctgtggtcagagttgttattaggttattaagttgttaaattcgttcgttgttgctaagagcggaagtaaatggaactagtaagaatttttacttttccagaaactagaacatagatggtcagttcgtatggtgggcttgatttggagcaaagtcaaatcggttgagcgatgaactagtagctagtgctagcatattttagattccctttgctcttatattatccttttatgacttggtggtgttacctgatttcagtggataatccatatgatcaccaattgaaagttttggcatgaaagaacctgaggaaacttcgaaaaaacgtacaatttttgcgttatctagagtatggtggtaatgatgttttagggcgaggtctgcgtgatatgtactacataaagacaagttctcacctccggtctgctttaatagagacaacctaattccatatgttaataaattctaatgtatgcctcagacttacaaatcgcgatccttttcagtataggactagctttcccccatgccacggcaagtgcctaaattagattgagaatttggcttgttgctgtattacctaatacctaccaacgtctactggataactcagtggttttagactgatagttgtcctgggaggtatgccgcatggctatgtttctttattgtcagtcagcatgaattgatgtgtttgaccagccacgcatcgaaagcaatggcattctcatctggcttggttgctgtggttacacgaatgcgaaataggtacaggtggtcttctcaatgttttgttcccatatcttacgctgtttctttcatcttgtagacacgtttagcaaagctggaagccttgctgctgaacaaaggtaagttaaatatgggtgtagcatttcacaggtgcttgttggtaagagaaatgcctcattgttcgtttacatggttgatttatcagatggcctgacgagtggttcagagacaaattcatcagccgtgaaagatcttcagtcaaagcttgatgcagttaacacagaatgtcttgctgaaaaggaaaaggtattcatctagcttgaaaatgtcaccaattgtcaccatcatacagctgtttgatatataaccatatctatgaacgatctctgtagaacaagaagctaatcatagagaacgagaagctccagtaccgtatcacccatctcatccgcgcattgaaagaggcagattcaagatagagagccctaccaagctggacctaaagctaaatttgtttaaattgaagcactgtgtatgatcttgtggttttgtggactgcgtgttcttagcaccatccatgaatttagccaaaactattctagcgatcttgatgggtatggttaaagcaaggtattgatttcgaatttttgaaacataattaaactgcttgtatttgactattacacaaaattgggtgcgactccctgtcatctcccatttcgcaagatgatttcagtgctgaaaagtgaaaaaaaattgctgcaattcaactcaatgtacagttgatatgacatgaaatcttttggagaactcaagagtaatgtgattaagcaaagatattttgatcttttttgatgaaggtgggtgtgtgattgctccgacaactttcatgccagaagacaaaaaaggtcatcactttacttgtaactcacattgcctctcacattcatgcaccattgcatcctttttttcaccaaggaaaaatatcctcctaccacttgttcagactaaaagcatcctccaatcatgccatccatttgcattagtggttgatactgctaattttactgttctcaatgctcctcaatttcccaaactactcatgtaaccataaccatccactcgatccctgggaaaccagcattagcctcgtgacaagggaaacatagaactaatgaacacaatcccatccgcgtgcaagcaggttaatcacacaaaatggcaccaaattcgacagcgaaaggagctgggtaaggggagcctcactcgtttccttgttagtttatcatccacggtttaaaaacctttttttttaagaaacactgcaaacacagacactcaaaaatgctcacacattcacctttatgaacacatatatacatcctaaacctgtaaaactgtgaacaccttcaaaaaaaaaattggaccaacgtatcttgagattgactaaatcatcacggacgtctcgctattgacgggtaacgcctaccactgaagggataattaggtttaaatgcaagcatccatgtcaaatttaaaacttaaacccgggttaaaagttttttctcacatagtctatttatcagcatcggcttgaaaattgttaataagtcagttttgaaagtttgcaccacaatcatcttagcttgtcatccaaagtcaaattttaaaatgtgaaactcaattttagagtttaatttgtatttttttccatggcagtcactttcccagttccggtttttgaattgctgctattaacgcagttatgaaagtttgcaccataatcatcttggattttagaacttgcagcctcgtatttttatttatgcttatgcttatcaactaaaatttaaatttttcaaccttaaatttagagttgattttgagggttttttcatcgtagcttattttttagctttgcttctaaaccgttaagaacacacatataaaagttttatttataaattattttttatttataaatatactgtttcgattttttttcttcaatatgacaaacgtttttttttgagaggacaatatgacaaacattgaggctgttggtaaacactggaatttcccctgtgattacatacgtgtgctcgtaatgtttcttatcacggactgttgaatcggatggggagagaaaagtttagaagaaaaacaaaaaaaacggacatggggttagctagcgagctcatcgcaccttccagaagcgaacgtggcaaccttccctgggccccacccctcccctcccaccgggccatgtctcatcgccaccctacccacactcactgacgtccggccccacgcggctgtccccaccgcccccgccgtcaccgacgcgtgggcccggggtggctgtccccacatgtcatcgactccgtagtacggcctccctcccgtgcacgcaaggcacccatcccccgctttaaattgcctcgccccactgaccgccgccgcttgagctgacctgaccccgagccgagccgtacaccaccggaggaggaggaggaagccggcgaggtgacgctgcgagatcgggaggtagggttcggggggaggttttgggtttggtggatggtcacggcggcggcggagttcgtcgatgggcaggtcgttcagggactcgctgaaggtgctcgaggccgacatccagcacgccaactcgctgtgagttcagctcgcccgtttcatcttcctcttcctcctcctgcttgtgttcttcctgtgtccagtgctgagggtagaggctgctgctcctgctgtgagatagtattgatgtgtgctttctgaaattcgttgagcttgttgtgtgttgatttgggggctggcttggatgggggtacattaggattactctatggggacgttgctggcggcgcaaatgtgatctcactggtggtgatgtttgatgttcactgctcagtatggtcagtctagttggagactgtttagaaggtatcaagctgacattttcttagtcacctcgatttgtggttagacattttaataggcatatatgttaggacttgcgataccttggatgtgttccctgtttatattgcttcagtagtactgaaagtttctgctggtaatggcctttcatggctgcagtgacacctgtcaccagatatactgcttaagtggccaaagctatctcctttggccttgcaggtctgtttgtactactttggttttgtcatcatgaggttttcttttttgttgttgtcggtgtgctatgcagttgtgctgctggttcatcacaattcgctatcatcgtgtgttctgaaagccgtatttggaaattgttgtccacaacatgcgctacacactaagagctaatatcatttggcccaactaactactgatcatgaattttattatgttgctgttacatcttttggttggagctgtgtaaaaaaaatatggctctcatgttactatgttggccatggtaatttagtatttcacttgacccctatagagttgttgcttactgtcctatgtggagataaagaagcaatatattaatgtatttttttatgaaataactaagtgacaggcagagagcatattttacattcctgacaactactatgtttggtatgatagacctgttttgatgtttttacaatgtgtcaagagacttgttgaaacttgagacattcatcagtctatgaaccagggtccatgttggttaatgattgagatgtccagttagtaaatggtgatttctatgatccatgttgctgttacatcttttggttggagctgcatatacaaaatatgactctatggagttgttttctattcattgtggagataatgtgcatgtttaatttgttttttttttcagaaataaccaagtgacaggttgaaaacaagtgttttacattcctgacaactaatttatttgctttaatagatctattccaaggtttttacaatgtatcacagatgagttgaaatattgagtctatgtaccaggtgccttaattgtttctgaaatttcaactttcaataaacatgtgcacggagtagccatgagagtacatttatttatttagttttcaaattttatatgtagagaatgatgacaaatggtttgttgatttgagtacacctattgcaaactgttagcataggtctgcaaccatatttttagccattcacgtataacatcgaccatattgttaatacccccatactgtgatacaagtccttttattgaagattcagaagtcctaccgtaccatgtatatcaaacttgcagaaagtcacctgagtctcatgagacattcagctctactccaaacatcaaactttgaatagttatttttggataaagctctacagccgtctagctactgagctgcctaagatcattgttttacaatagttagactaaattattttgtttgtaaaaatgcagtgctgctgaatttagaagggaatatgatggcgcctgtcttcagatgagaatgtcatactgtccagctgcacacttcttcctttttcttgtgcagtggacagattgcaaccttgctggtgcacttgggctgttgaggattctcatttataaggttgagaacagtcctgtttagccaagttcctttctaatgctctttctgctttattaggagccatggttaatcttaactatacaggtttatgctgatgggactaccaccatgtctgctcatgaaaggaaagcaagcattagggaattctatggtatagtgcgtactttggatatcctattgttttacacatatttcttgaactgttctttttttcattagtgttggggttttttctgcagctgtcatatttccttctttgatgcaactacatgaagggatcaatgaagtggaagacaagaaacaaaaggcaatctgtatagaaagatatagaagacgagatgaagatcagaaaatggtgatttcagagattgatgataacatcgaggaggaatgtggcatatgtatggagataaatggcaaagtagttcttccaacttgtagccatgctatgtgcattaaatgctaccgtgactggtacacatcttcactcttctctctgtggcgtttatattgtataagggggttcagttcagaaaatatcttttatgtttctctagctgtatagcaatagcacttctgcatgatgaaaattacatgttggatcttcagtttaattaattaaaacaatgagactgttgctaaccatcatggtgtgccagtaatatttcgattccttcaatttattagaatcaaatgaaagaattaccctgttcctatgtgcttactaataaaaaattggacccttttgtgcttccttgaactctctgcggcttgcgatttaaatcattaattctgttgagcctggacaagtgaaagacttattcaaagaaagctcaagagtttgatgtcccatgcctttctgatggagaacctaccactgcttcttctaatcctgaaacagggcttggcctgttgacttagtcattgaaggtcctccaaccttaccccacccacggatgatattctaaaagatagagggtcacagatgattaaaaaatagatacaaagacatttaaagtaaaggggtgtatatattattcatatcctctatctacggaaaaaataaacagagttcgtttttgggttccctgaaggctgaaggtcccagtggattggtcttagcttgctagctactgtactactagttcatgttctggaaacttgctggtggtagttgttaattggagcctttgaggctatgtggttaacaatctctaatggaatggagcaacctcatttcagttcttattaaatggctggttgctttcagtgacatatttatctttcaggtttattaatttctggttcaaatgttcaaaattttggatctttgatacaggaagtaaagaatagtgattgaaa

SEQ ID NO: 9811 - DNA, 1389 bp, Oryza sativa
tagttctcaataatcctaacatgaactatctgcaaatatggcacctttctaactcttactacctccgtcccataaaaattgaatttctatggaattaagaacatattaggaggatagacaaatgactataataaccctatttaatgaacgtagtacatgcataaattccatatataaatgtgattaaaaggaatgttgagataataggttagagatgggatggaaggaaagaagattacaaggaaatgtaatcagtttaattggtcccacatcagtagaaatacaatttttatgagataaaggttcaaaggtaaaaattcaatttttatggtacggaggaagtatactttatcatgtattcttcattgcaggagatcaagatcccagtcttgtccattctgccgcgatagtctcaagagagtgaactcggccgacctatggatatatacagataacagggacatagtggacatagcgacggtccgaaaggaaaatcttaggcggctcttcatgtacatagacaagttgcccacggtcatccctgaaactgtttttgacgtttacgattcccacgtaaaatgaccttgcactcatgcacaaattctttactggtgtgttactactagtgctgtagaaattgtggagcccttggtgttcatgctgccccgcttgtagaagctgtaagcagctaagctcgccgaggaggctcgctatacaaaggtatatatgtaaattgtcttggctgtatggtgtgtacctttgtgaggagttaggagaatctgatgccagtcagtctgtaagtaaggaagaaccagcaaccattgactttgtttcttttaattgtaagcatttcactttcacccatgaaacagtgaagaatgccatcctgacagcttgattgctcctgtacgatgctgttgctcgttgtgaatggggagttttcagttcctggaagaagaatcaagaaatggagggccactgatttgatcgtgcacagaagtgagacaagagtctgaactggtacagtatccccaataataatttcctgatctgctgcacgtgcatcctctatctctgtaatgtcttgcacgttctgaaaatggagaaactccactgcatttggagctctgcagttggatacttctgagcctgtttggcacaactttaccttttttgtaactggagtccagccaaacagtgtaaatagtttcagccccatctggagttaggtgaagcattctcacaaaatgaactagagaggtggagctgggtttatgctgctacacaactcaactctagatttaacccctggagcttaatttaaaagttggagcatgtcctctgtcaggatgaaaactcatcaagtttatcttcgttcttgtccaaata

SEQ ID NO: 9812 - DNA, 19087 bp, Oryza sativa
taaatgtgttatggtctcagcggtgtattcacgggtacctaaatatagggcatatgtgtcttccatataatctgaaaagaagctacatgctagctcatctcgcttgctgttaaattgtgtttacagatattattatgtacacgcagctgagcttttaataaaaatttagtgagaccaggatttgtcgttggtttttatcttcatgagtatgtgttacagtatatatatatgtggatcagtggatgtgtgagggtagtagtgtttgtgtgtacgtgtcttctgtgtaatcgagaaagaaaagatatacgctagttcagtgcacctgctgattacacttagctgtaccgcagattcccttgttcttggacgactttaaaagcctcgaagatctttcaggccacgagctgttgatacgtttgctcaagattctttcgtgtataacaaggtcagatgtggtatagtttagtccatgtccgagttgtgttcttggcgttaagtctacttaggccctgtttagatgggactaaacactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacgggttaaaacttgtcacccgtcacagatgagtcatcagtgtcgtgtagtaaacacctgtccgtcgtagatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttgtatgctacaagtgagattcaaactcaagacctcaacctccatatagagctcccttaccaactcacctactcaacacatattgactactaacccaatgttattattttgtctatgcttatctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgtatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcaaaatttaaaaagcccgtcaaaggtattgctcatacctttgacgggcttctattcaacggcccgtcactggtatccgctcacctgtgacgggccagaaatgaaagccatcacaggtggcggcccatcacctctgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcggccggatggctcaccggtgacgttatcccgtctgacccgtcagaggtaatggtcactagtgaccaaatcgtttgcccgtcacaggtatcccgtcagaggtgtgaggatctggcgtagtgaaaacttttaagtccctatcacatcggatgtttaaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctagatctaaacaccaccttaacctgactagcactgaacaagacaatgcgttttgttctgtcagggtttgatttttagtgaaaactctggtccccagatcgaacagacaaattaagctgttagattagtcttgaaaattgtagatgacaaccatgacaaatctgtggagatatttcatgagttatttactaggacaaagtgtgctatatatcagcaataatgcaacctaagcttgatcagatcatctgatgagtggatttgtctgtctgcatttcctttcttgttttcgtttactcagtggaagctggaagctggtcaatgatagattattagtatgctagctgctgctgctatactatcagtactggcaaattacttacacctggtcaagaacagattcttagtacgctacctggaactatcagatttgagaataaaataacttctgaatttattaagcccatcatatgatcatatccagatgcagattttatgcactatttccagattggcaccaacaacatgctttaaagtatgtatcatgtcagacgtgattaggcatattaattatccagattttgtttccattcgtgacagatacacattggcaccattttcaccacaaatcttcatcagatatttcctggcacatgatccgatgatgagagtggagaggtatcaataaccacgcgttatcgtcagcataagcaaatcaatcaagtgttagattttcgcggcgaaattaaagtcacagatgtaatctgatggctatctaatcaccaactgttccttcaacaattgcgttgtgaccttgttaatatagcgttggaagattgcacaattaagctagtgacgacaaaaaagcttgggagatgcgtgcacgcgaccagcgagtggatctgtggatgtcaaacttttctgtcgtctaaaagtccccttttgcgtgattgtcaaacagtaaatcttctgttcttactttacccttttccttatttttctcaataacaacagagatgtacttgcacaggatatatcttaacggagtagggcatgttaggttactgtagtagacgttactcctatatgttaggatagagagaattgttaaatcttttctagtttcattgtggtttgtgccgcgctgcacacttgcaccggtgtgatcaacttgatttagatggaggctaactttgccacacaaatgtgactaacaattttttgaccataactatagtaaacattggttaaaaaataagagtatgaggtatagaccaatgtattaataaagtatggatttgctcaacaccatgccactcaaccaaatactagcataagaaaatgtggcaaacctaagatttagtgtggcgaactcgccaaccaaacaaccccaacattttccggtatctaaggaggatggactgagcttctactcactactagaattaatccctagaaccaaaaacccaagggaatggcgcaaaaactctagagtgaaccctagggaatgccctctagggaagcctagtcgatttggatagcaactagaacaaagagggattttgggggagattggagaacgaaacaacaacaaatttggggaggagaaacccttgtgctgttgtttaggggagttgggggggggggggggagaagatatttttgtctactatattgcccttcccgcaaaaaaaaatcgttgctgggagttttgcctccaaaattttatatgggatctactttggttgtcactgtggcgccaagaatttcactatagagcttatgtggtataagttctctaggttgcatattgttactctagagaacataaatcttccctttagttctccatagtcaccctagggattcttattatcccttgagttctaatttagactctagggaagttattgaattctagtagtgagtggcagattggtagctcggagattacagttcgcgatggacaaccaattcaataaacatgtttaggttgctttgagcagagaaatctaattagatttttttttacattttggcgtggtttatagaaaaccgaagcttttaaaaactaagttgatgagaatatggagaagctctagttccttgcgtcaatgaaagtataaccaccattttcacacttttccatatttaaaatattataaccactgaatcttagaatcacgacatctttttcagataatccaccaaattattacagtagattatttgctccacgtctttaaaactacgttttctgaaaaatatttcctccactataagctacttgtttgattatttattaggtttgtttatcaaagatatttattttttttctatattttagcagactagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttggtatttttaagtaggtatgtgtataattaaataaatttacaagtaaaattcttcattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatacttttttataggtttgcttcgaaataaacatactcaatagaactataattgtaatgcttctgaaaaaatgagcactaaaaatgtacttattctctttttttcggctcgagggaccaacaatagacttatttccgacctatgccggtcggcccacggccttttgcgcatgagcgggcgcacttttcctcccccaggccgcaacctgggcttgggtcggaaaagaggcctcactctcgatccctcttgggccgatttcggcccggacgacaccggccgtccgatctctagggttttgatcggacggccgagcgtcaatagcggggaaacaaaacccactccctctcagccgcggaaccctagcccatttccctccctcccatctcacttcgccgccctctcctccgcgcccccgagcggcggcggcgacgacggcgcccctcccccaccaccgatggcggcggcggcggcacccccaccacccacggcagcgtcggcggcatcctcccccaccaccggtggcggatctagcgggaggggaggtgccccgcgagcggcggcgacggcgacggcgcccctcctcccgcgagcggcggcggcagcaccctcccccaccaccggcggcggatctagcgggtggggaggcgccccgcgagcggcggcgacggcgcccctcctccctcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacagcgacggcggcggttcggcaacgacggcgacggcaacggcggcagcggcggcgacccccttcgatctaattttttgtttttatttggatatatgtgtgctggcggcgacccccttggatctaattttttgtttttttgcaaagtgctataaggctgcatgtgattctttgttatgtgctatgatttttttatatgtatgtaaatatgcacttgttctcctagtgatgctaaccgaataggacttggtataattcaaaccaagtcctattcgcccaaacagaaacaaagtcctaatcagctcaaacgaaaacagatgggagtttgtttcctatttttgtggaatcggacatattcttttaccgcgttgatgaatcggattcgttccggttttttttcacccggtttttttgacggacgatggaagcacctcttattttttaagtagtagtagagtagatataatccgtgtcaataaggggggtgtttggataaagggactaaactttggtacctgtcacatcggatatttggacactaatttagggtattaaacgtagactacttagaacactaattacataaataagagctaattcgtgtgataaattttttaagcctaattaatccataattagcacatgtttactgtagcatcacataggctaatcatggattaagtatgcttaataaattcgtctcgcgaattagtccaggattatgaaatatgttttatcaatagtctacgtttaatacttataattagtgttaaacatccgatgtgacgggtacttaaaaaaatttaaccccatccaaacattgcctaattcgagtgatgacttcactaacagtttgtcatcccaacagcacgaatctcaaagcaaagctggatatatatagcgcgcccatcacgcgcactcttccgccgaaccgagcaaacgcacaaaccaaaggcggaagctaagcaagcaagcagcagcagccgcagccatggaggcggagaaggagatgtcgatgagggagtggtgcgtcgcgctccccaaggtggagctccacgcccacctcaatggctccgtccgcgactccaccctcctgtcagtaccgccactccctctcctcccttcctcgctgccttcgcctgcctccctccccagtttttagatttcttgaatttgatagctagtcacttggttcttgatctgattctagaataggtcctcatggcagtatatttcttccaaattttagcccctatgcatcatttcatctgatccaagatcgtttggattaatggatttggtcgaacgattcttgatttctaggaggggagtttagcattttttttcttgagatggggaattcagcacttaaagacctaattgtgcacgcgaaattcgaactttggtaggagactaggagtgtgccattgtgaaatttgggttttgacaaagtgtatattcattcatacatggtcaggaagcatgaagaacaaatacagcagtctgcactctgcagacatcgggatcctggcactataaatttataatattggaagtgctcatgtgggacagaatctttgcctaccttttacatttttataatgctacttttgattaacataccacaaatgacttggcctccacgaaaatgacctcagttaggagttactggaagacaggcctgatagttacttcagtattactagtgtatgaatatggataattttgtttcccacttcagccaaaatattatacagttgtaaattttaactagctgtttaaacaactaataggtctgtattgttaccattaagtagtaccaaattgactaccttgattttaaaatgcaataagccaataactactttgtcttcaacaataaagaataccagacaaaacatatgtgattttttctgcagtagcattttgtttctatctttcaaaatgctaatgctttgttgtcttcttgaatagagaacttgcaaagcaactaggtgataaaggagacattgtattcgaagatgttaaggatgtaatcatgaagagtaagtggaagatttttatttttatttttttgttagtgttgttcagcagagttaccaagtctaagccatatcaaaagacattatgaactaagggtgtaaaagaacctctgaaatattaatcattaatcacatggttagaaaaaaaatgtctgatggatacctgtgttgcaattctttgtgagccataagtaattagggtgctcattaactctggcttctgaacatcttaaacagatggaagatctctccctgagtgtttccgactttttgaactgtatcatatacttacaactgatcatgatacagtgactaggatcaccaaggaggtattgtgatatttatagttttgtgatttgtatactgtacttgccggattcatcatcgagacaaaattggcaggttgtggaagattttgccatggagaatgtagtatatctggaaataagaacaacacctaaggtaatatttttatttgtctgttccgtattcctctggtacatttttttagtctctgtggaaatagtgtgatttattattttactttattttgtttcactgccatccagaataatgaagccaaagggatgaccaagaggtcttacatgaatgctgttattaaaggtcttaaaactgttgaagctgttgaagtcgtgttattcgattctaactcaagagcagataaaactcctatgagtgagctgggtggcgacacaaggaaaaagaagatatatgttaggcttcttctgagcattgaccgccgtgaaactactttggctgcattggatactgtatgttaagattttacaaactgtctaacattctaagcaaatttagcaatatgacagctaatgacaatatctataaatcgttcacctttgtttgtcaggttaatttagcaatggagatgaaggatcaaggtgtcattggcattgatctttctggcaatccagttgtgggggagtggtaaaatattctgtgcctgtgttgaactaagtggatacatcctacataatttttgtgctgacattcctgggatttttaaacatttatgaagggagacatacttgcctgccctggaacatgctaaagagcttggaatccccattacaattcactgtggcgaggtctgcaaatatattagaacaacttctgaaccactctctccttcttgatcattatttccctgcagaactagttgatcaatgaagtgaaaaacttggtgacaacaggtagcaaacaggaatgagatccgagcagtgctggacttctgcccacagaggctgggtcatgtctgctgcctcaacgacgaggaatggaagaagttgaagtcgttaatgattccagtgagcttttctctcattgtccctaaccaattccatgtcacactcacacacgcttaatccaaaactgaaattctgcaggtcgagatatgcttgacttccaatgttatgaccggtggtgcgccttcactggagcttcatcacttcggtttgtccctggcaatagtagtacttaaaaaaatcttgacaagaacttttaagttactgaatgttgacaagaatttttaagttactgaatgttgagaggattttaagtttctgaatcttgacaagaattgaagttactgaatgtttgacaagaatttaagttggcttcccagctgattaacatttttgagttactgaatatgtgcagccgatctgtacaacgcgaagcaccctctgtccctgtgcaccgatgattccggcctcttttcaacgagcctctcaaatgagtactacctcgttgcatctaccttcggtatgcgctctccttgaaaaaagatctgcaaatagtctgacaattgttgttgttgtgtgtgtgtacagtactctgaactctgaatgcaaaatccaaaatgtggcaggtctcagcaaggctgagctgtttcaactagctcaggacgcggtggagttcgtgttcgccggcgacgagttgaagaggtctctgagagagttgttcgagcgcgtcgggaaggagctgacgacgtagggtaatccaagatgcgttcctgtcgatcggcgtcggaacaaataaatgtatttattatccatgtggtctcgattgtgattttagattttccatcgtttctgcgtttatgttcccacgggcgtgtccagtttaagagtacaagcggccgacccgagaatccacctatatggtgggtttggataatgggaaataagggtgggattggaattagaaaataaatgaagggttaggattaaatggaagagggagaatgaatggttaggatttaaaatgggtgggaaatcatttccctttcccatttgccaaacactaccataatgtaacggaaataagtgggtaatctaaaaaaatggattacccatttattcgtactatgggtggattcgtgggccggcccttgcacccagtccagtcccttctcccgcttgcaaatcccggcgccggggatgcgagcacggtggagatctccggggagagtcgccaccgcgcgcctcgccggcgaggacagagaaaaggcgtgggccttcagttgggccggaatgggatgggattgcggccttcaagcggcctgttatgtatataggccggaacgggattgcagctacgtgcggcccgtttaagtcggccgggggagaatgaattcgaccggaaatgagtggaagttgacattgatttgaagtttgtatttgattgaattgaaacattgagctggaattttaaaactacacaaaacaaaggatggagtctttaaacgcttccgctactaatgtcgcacaaggcggtaatgatttttcagaagagtagcgcaagcaagttccttgaagaaactgtttgcaaaaatacaagtcttgtttcgatcaaaagcttcaggaactctatcgtagcaacctcataaggccacacctcagatctcatgtagttgttttgtacaaaaaaaaaaggtacgaactccaaaaccccgaaggcttgacacaaactagatgcaaatgctaagtcatgagaaaatttaaaaaattgtggacagtaagtaaggtgttcttgcatcagctactcctatttggaagatttaggttggttgtttactgctagtctacaaatattgccgagagagaacagctgtcaggtaataacagattttgattgccgcggcatcctgtccaggtgatcatttgtaccatccagtaatcatgtacctcagccaaaagcagaataggcatgacaacgcctgccagacatgaacacatggagttattattaccacagattgaaattcacacagcaagtataatttgtcaaaaaagcgatagtaacggacagcgatatgtttaagtagcatggggctactagagagaggattggatctccaagtaataaggatatcaatgtcaagatatctgaaaagtgattccatttgaaccaccattataccatataataacaaatgtggattagttaccgttatccaaaaaaaataaatttgtggtttaaggaaatctagtgaccacaaaaaagcagataggataaacggatggcttaattcaaagaacttattcctcatttaatgttgttatgcatagcacaaagttttagctgggattttgtttgcagatattccttgtgtactgacatttgcacgaaccctaggacaaggcttagccataaccataatggagtagatttgcaaataccaactactttattcatgataacttccacaatgaaacaaaatgaaatcagtagtttgtagtagtttatagcatcaatgcatttagattttacctgaaatatgagcagccttatgcaaagggtcctctctgtgcatcttccaaatatcctaaggaatatgtttaccaagttaccatctttggtacccgtcaacagtcctgtgtggggatcaaacctgtgggacgcaaacacattttacaatatttatcagaagttcaacccacacctcaataggttttctgaaaatatattctacataccttggcaacctgtgccttgggcagggaacaaacttaaacagctgtagcaaatagaagcacaaattaaagtgtaagcagaccaaatgcctaattaactaaagaagatattgtatcaattgagaggaaaataaaaaaaatgaaatggattcttccatacctgtgggactgagcacagaaagttaagaacctcaggtaaaaagaagagcaataatgtctcgctgcaagtagagaagagttattgatcagctgcagttgctaatcagtattgggtaaagcaaactgtatgcacaacgagcacatgctagaaacatcagacagatgcacatagaaagtattgatggcacaagagaagcctacacagttacgcttccaggatatataattgtatggatggtacacaggaagttcaacaggcaacatacttaacatttcaaaactagatattaaatccaaccaacactctgtgggctgtactagaccaagaggaccatcccaaaagatcaccatttacatgctttacattatatgtggcagaagaggtaagagaacggtgagaaagtgcaaggaggaaagacttaaatgtgcatgaagctagaacaaagattcttgactgtacttcactacagaatgcaggctgttaattgcatatccttccatatcacaaacaaccactccagatgaagctcgctaagtgcttcttgttttctttattgatagataataacggaacatgttttttagactaaaggtcagagacccggcttttaatcgaaagccacataggcagagtcttacaactggggataccagcgaaacagaggagcataacatagtttaaacacaaaactcaggacacaactcagcacgctaattcaggcagacaaagcaaaagcatcattacacaggacagattaagtcacaaccaaaggataataacggaacatgtaagggataactgaggacgtttacctgaaatgacccaaaattcccaccacagccaatgccattccagaaaaataggtgtaggtatcaccaacgaaaacagatgaaggatacctgatacacacacatacaaagtcattctttctgaaacaaagcaaaagaacttttttctttaaataaatgtgcatgcttcccatggtccttaccagttaaatgcgagcaaagctaatgaagtggtcaagaaaggcaggacaagataaatcgagaatgcatgggcttgttgcgcttcaatgtccgtagaagatcctatgcgcattacattatgtatcaaaacctaaaaaatgttatacaacatcagtagacaaatagaatttgggttacaaaattctcatcgacagatattttgttcataccgcagcagatataataactgtctgcccaacttcaagaccattcaggccagcatgtatattgatcgaatttgtacaaaagactgctaataggagcataaagagcttgtacagagaacctgcatatggaagacaatgtcaggtcagtgcattgtatagctatttgctagcaataatagaatgaaggttcatccatagagttaggttgaaacttgcataaagaaagcaaataagcaaaatgaagaagtatatcacagatgcactggctcaaaaatcccttctttcattcattttatcttcaacagatttaggtcacttgtggaagaagcatttaaagtggttcactggaatgagtactgatggtagattatcatctagcacgttagcagtcagcattcacatatgaagcaaaaaaaaatagttgccaacaaggattaatagtgctattacaaaaacgtaggatcaatactataagatccccctgtactaatttgcaagcctcctacgacctacaggattaagtgatatacgagatcataaattgatgaagctaagttcctatgaagtaaaccatcacacaagttgaccagagtccatgttaggcccaatgtttcaccaagtccccctgtccaacagaagtctttatttaaaagtttataagcccactgcctaaagcatctaggccccggtgttaattttggtaattaatgacaagcgctaattgtggactaaccgttgtctttgagctatacattttaagtcaggtccacgtcatatgtgcgcatggatgattatcgatggattaaaattgacggcgcaaagcaaagagaaagaagacggtaaaactagtgctttaatttagaattgatcgaggtgtagggcgatcaaaattgctagtttattttctagtttcgccgtactattaagaggggtaatgacctagcaaagagatgattgaattgccacattaggtcattgcattttcatttgtgctctctttttcatcacacacacattcacttgcaaattcactgggttcggcctgaccagggggcggtcagaccggccacatagtggcggtctgaccggcgtgccctggctggtctgatcagcccccaagcgggcggtctgaccggcgcataaggccggtctgaccggcggcacttgcctggtcagaccggccccctggaggccgagatgatgttgctcgggatggccgatacagagccgacggagccgtagtcgatcagaccgagccgaggccggtctgaccgcccactcaactccggtctgaccggccaggccgatggggccctctgacagcacttcaacggctagttttctagccgttgcagagtagcacggtctgaccagccacatacctccggtcagaccggcagagcacaaagttgggggatttcgcccccaacggctagttttggtgggtgggagtataaatactcccccaccagtagcaaggggactctcttggcacccaattcaattgcatacatcccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgccgcctcctagacggcttgtggatgagttgcccggtgacctctccgagaagattgtggaggaggcccggcgccggtttgtgagtggtttggagttcaccaccttcggagtgaaagaagaactaccctagtgatcgaggcttgggtagtcctctccgtgggccggctcccgccttgcccaccccttgacgaagggggcgtgcggtggcttcatggttgagcggtggagttggactcgcctcaacggggagtaggaaaccggcgagtttccgaacctcggtgaaaaatctcttgtctccttgtctcatttgattgtcgcatttacatttgtgcaaatttacttttctagaaacaaactagagatcatatcaccctaagattactaaacattgacataggagtgtgatttactttcctagatatatagttgagccacaatcaccctaggtttgcaaaacataacttagttgcttagttagagttgaccctcaccaagcctagcaacttaggttagttttgattaggtgtcatttagttttaaatcgcctattcaccccccccttctagtcgacatctcgatcctacactgccactgacctgagggacatgcctacttatcagttacacggataaatttatttggaccaagaaataacattgagggcttatttagaacattgggtgactggaaaagctaaattcttacagaggaccttggtgaaaggaaaaagtgaaatagctccagcagaccatacttactgattgttccataaattctcataaaaaataatagccagtactgtggtactttcatgtcactgataatcacaattctaaatgatataggtcgtaattaagagatagtgtctagtaactgcatcagtgcatacaaaaaagttagtgaaatttgatgaaatttcaccaattactttaagtaaggaaagtatcaattctcccaccttccaacaaagatcatcagtgctgcaaccagaattaaaatattgcgcaactaatgaatattcatcatcacaacgttagcttattttggacttatcaacatacctagctccagaacagctactccaacataagatgttagaggctttggaatgctgacggaagtaccaccagcatatgccatcagcaaaggaagtgctgcaattgtgggtagtagaagtttcctgttgaacacagaccattccaaaataatgttattatcataaaagggaagataatagtacatcatcggagtaaactggaaggcattatgaaaaacaacatacactctccatggaacatcaagaacatcatcaataaatccaagaagcaccataaagcagactgatgctagtgccgcgttgtattcaacaagccactgcaacaaggaagtcaaaaacagtaattgtaacacatgtttcaggtcacaaagcaacgtttatgaatgccaattatagtaacttctagtcaacataccatagagtctgctgtgaagttgaaatgttgaaatagaatagcaatgaccaagtagacaatcccaacaacaatgccaagtgcctcaggcctgcaaagcaagtaaaatgcttagacaagcaagaatgaaaactatttgatttgtacctccagtgagtcctgctaaactcttaaatatttcgaacaaatagcacataatgggtatttttcatatcttaaaatattctcttacatgctcagtaaaactctagaggtatgctgataatttcctaaaatcctactcctatacttcatgagcaggttaagagtgtctccaactgaatttttaaaaaccttgaagcatatgtatgcactagcatgcattagtaacatggcccaaaggaggtagtcacaactcataaccttccttaaaacaacttttgtgtccttgttttgagtgacacgtatttccgagaatcaagaacttttgccaagaagaaaaaaaaaaagagaaggaactgttggatgaaatttgagtgattgatgaactccaatgtatcagttcagtttacactaaacaagtagttagacaaaaacggtatggtgcatcaactctacctctacgtgtcggcatgcaagacaaaggaaatgcttaacatcccatagaaatgtaaccctatgatgggcccagaagaaaaggaaaattagttagaacacacaaaatctgaactatgttattcttcagtacatcggtgaaacactgaaactagacaacacaatttaagagtttacaactaagatagatctttttttaatagaacaacttactctgcaacccaaatgtgattatcttcccaaagtgcactaaatactgctggcgtgtttcaaattcccaaagcacactaagtcatgctaacactttccagagaccatacctacccaattactagctcccaatcctacaagacaaatttgagtgaacctgataaactattacacgtacggagcatgcatgatgtgtcaggttccacaatcaacatttgtaatgcgaatgtagaatgtaagacaggtcagctaccgcaacaacaattaccaacatacagacgcatcacttgaggaaattcctacttgagctgtcatgcaaaacagtcaggtaggactgaacaaatcaaggtattgtagtagcgtgccctctaattatggcgtataccccaaatgcactgaccccaactgagctaaatcacaactagtatcagtaaccgctacgagctacagtaaccatctgcgtaacaaagatcccaaagtcaaaatcctcgcccctgatgcttccaatagcagatcctcaacaatgacacctaaattctgatgctaaacgctcaaatctggttaaatctaatcctagggaaatcgcatttgcaaacactgcagttaaagccatctttcagaaatgcaatcggtgactaacactctgatctcgcccatgggcaagccgcgcttgttgatgtccttcccccacatcccgcgacggaggaggtagcgtgcggcgacggggacgaggcggagcacgacgacgaagccgccgaagctcatggccccgcagatgaggatggatcgccgcagcgccgcgtccagcgggtagtgcacgaacgcaaggtacgagaagggcgcgaggaaggccaccatcgccgcggcgaccacgcgcaggttcggcgcccggagcaccagctcagcatccgcggcctccgccgccgccaccgcagcagccggcctcgcccgcggctgcgcatcagcgggtgccgccgccgccgccgccgccgtcgccgcgggcctgcggcgggcgtccatgggagactaggaggggagtgctagggtttcggcagagcttctccggcgagtcggctggtgcggcggcggtggcgggggtttggtcgccggcgaggggggccgggccgtcgaggaggtcggggaaaatttatagccgcggccgtgttgtgacgtggcaggctcccattggctggagtcacgtgttcggcggccactggaatggctagcgaagcatgaggaatcttgcgtggaatcgaagtgatcagagaacgagatctggaccgtccagatgttatctaacggtgtaaatcttcctcagttgaaactgcccttggcctgcattggcattggcattgatactgtgctgaggtgatctgagccttagatttaagatccgatggttgtagggactgcagaaacataaccgagtggttgacaaggggtttgatatatttgataagcccttgagaaataaacaaaagtaaccaaaaaatatttttagttaaaactttttatctctattcttagagttttataaactcagagtgtgtttgataaatgggatatgagagatgggactgggaaagggaaatggatgaatggctaggattaaataaagtgtgaataatagatggttaagatgctatgttgctctttggagggtgggatattatttttcaatcccatttgccaaacaaaacctcaaggttaaaaaacaagcttaaataaacatccaattttaaataaaactttgaaaattaattttggttcttatggactcctaatttaactattatactttttcacaaggtttatagcagatttatgttggcctcctatgataagcatgcgtaaaagatttggaatgcacgtttttattggatacataactagttacaaacaaaatcacaatcccacagaagaagcaagtggt

SEQ ID NO: 9813 - DNA, 1675 bp, Oryza sativa
attaacatctatataaatatgggcgatgctagaaagtcttacgttgtgaaatggagggagtagtagagaagagcgtttgactttgtaaagaaaaaaaaataaaagaagatttgtgctcatgtgctaatatgcccatgacactaaattgaggcataggtatataattcacgataatttgctccctcgcttttaaattagttgttgctttaactttatcctaagataaacattttaacttttgattattaatttttataatgctatataggctaacatgttaactgtacataaaaacattactcatgatgaatctaaaaatatataaatattataaagtttaactgcatggattattcaaatcaacgataaatatttgactcatgacaaagctaaatcggcatgcaattgtggtcttatctctactactacaagggtgtgtgcacggaaaacggagcggttcattagtgcgcgattaattaagtattagctatgcttttttaaaaaagatcaatatgattttttaagcaactttcgtatataaactttttgcaaaaaacacatcatttagcagtttaaaaagtgtgcgcgtgaaaaacgagagggaaaagttaggaaccagtagtgccgaacacacctaaaagaggtagccttcatccttctgcccccctcctcctaaaaccacttccttccataaaaatcgatttctctaagaaaacctgaccataattaaaaaaaaaaacctaagcaaccaaacctatccaaattcttccactaaactaaactaaataaatagaccattgcaacgcactgctatataactagtttctccaaacaacaacaacaaaaaaaacaaaacaaagaactcaatccttgaaaatgttatataatctgatggagcttagttcacctatggtatttgaatctgatgaaaataaaaattaagttgacgcacgtaaaatgaaaaagccattagcacataactaattgagtttttagttattacaaacttgacaaatagagatatgttgatattttaaagcaactcctgtatagagagtttctgcacagaactgtttagtagtttaaaaagcgttataagtaaaatgatcttaggccctgtttttttctccaacaagggttagatgaagattaagattttcatagcaaaaacgcttttcaaactgctaaatggtgcgtttcgtgcggaaactttctatatgaaagttgctctaaaatatcatattaatctattttttaagtttgtaataattaaaactcaaccaatcatacgttaatatcatatcgtttcgctaaaaaacttaatttgcatctccatcttacaccaccttattcagaaacgtatctctctccgatttttctttttctgaacacatgcaaaccactaattacaattgtaagcacgcaaaaattggaattctacttctaagcaaaactgcccacgtcaccaccataaatctgattggcctggtgataactgtccacgatatgggctacctatttgtttaaggaataagtctatacacgtccctaatttcttatccggttggcaattttgctgtcttgtttttaatcaagaacatacaagtatttttgtttctttctcgtatctggctatattcatataatactgagataagaattgcatagttatatt

SEQ ID NO: 9814 - DNA, 14015 bp, Oryza sativa
  unsure (1)..(14015): unsure at all n locations
ccttgcaaacagcaagggcatgagcgcatggtattccagtgaggtttggctttaggcattcgcacataggaggagtatcattgtgtattattactttatacttgaaatctcttcgaacatatgcagtatgatttccttgcactactgcaactcgctcacggtcaaccttgacctcatactcaccaccttcatcaccataagaagtcacgtgcatggatccagccttattccctcgctttactaacaaattctcaacccgatgggaccacattttctctgaatctgcaagttcaagagcagattttcttctatcagcaaaccattctaagcatttattaaatgtttcctccactattgctgtcacaggtaatctccttgagtacttgaacacattatttaatgattcagaaccattacttgtcattataccccaacggtaaccaccatccatgcattgaaacacctctcaggtttctcaggctcatctttatcctcctgtcgatattttccaacactttttagataatcaattgcatttggacaactttgtgtaattgcatccatgccttctacaaacctgcgtggtttcttcttctttacagcccacttgaatgtttttatcacatcatcatttttacatcgcttgtacagattctcagcaatatgttgggaacaaaatcgatgcacacactcaccaccaatttcgttccatccgatatgtggctgcttgaatacccactttatagccttgtgacgatcagaacaacacacatgaaattaccaaaaccaatcacctcttttcttagccatctcataaaccaaccccaattgtcactatcctccttttccacgattgcaaaagcaagtggtagtaacctattttcagcatcatatccacatgctatcaacaacctgccccgatacctaccagataaaaaagaagcatccacactaattaccggtcgaaggtatgggacagattcaatgcatggcccaaaagcccaggccaaacatttgaatgattggtgtccttcaggagatgtaggatttgatagaagttgatattttgtacccggattagatgctttcattgcctccaacaacggtgtgacaagtgcatatgattcttcccaactaccaaacaattgaactatggccaactctcgaccacgccacaacttgttgtactttggtttcacatttttatatctttgtcgaaccaactgacgtatgcttaatatactcaactccaaattctcctttagatcatcacgtatcacatcagcaatgaccgctgctgttagctgtgcatgatcaaatcggtcagcaggtgcacgacatgtgtggggaaattggcaagtttgtattttccaactcgaaccaatttttgttgtttttgcatatagcttccacttgcaagtactatctttgcacttgaaatctagtcttgatttgttgcttgtagatacccttacttccatattattactaatgtgaaattcatttactgcaaactgtaggtgttgcttggagtaaaaaattcgacctttggccaatggactctcaaagtgtctctttgaaccaaagaaacaatcatcagctcttgtctgacgcaacacagaaatgtcatgaaaggcacttacggggtgcttaccagacctacccatgagtggctgcgattttgcagaattaaccaatgcaatactatcattcatattctcttcgtcttcgctaccctcctccacatcttcctggtcttcatcctcgtcaatattgccttcattgtctgtctcttctccaacataagcctcctcttcaacatttgtttgcaccacattcctagcattatgaccatcaagggaaggcatcacaattgattcttctccatcttgattagcttcagaagagatgacatgactaggtgattgattaactaatccttgctcaataatttaaatggttggagcagtgttaggttcattatttcctcttgtcatgacaccaatacttgaagtatgacttctcccaatattaattgatgcagtctcaacatacaattctaccatatgccaattggtccgtgctgatgtcatttcaaggatcatttgccaagatctttcctcgtataaagggattaactggaaaaaatgtggaccaggtgccccaacatcatacctcacttttataaccaatgaatatgcaacctcagaaaaatctaggccacggaaaatctcatttttcacatcttctagcgtagtagacttgatagcaggaaaagtgatcttgggaggaatactatatgatgcacctgccttctcttcgtatatgatttcaccacccgcatacacaagaacaattatcatggctcgtgtagttgtgcctaaaaaacaaataacatgttattatcattcacttgatatacatgtgaaagtagcgtgaactatttaccaaacatatataaatgttgaattcaatctaagtttttggcataatataatagacaatttatatataaaaaaacatatgcggaaaacggtgccccatgaaaaaagttatctaacttatcgtatatatgggaaaagcgctatacggtccaatgtagacaacggccaagttgtagtgtgtgtatgtataaaccatttaatataaccttcgacagtgacaatgttagtgtggccatagtgcaactaaaattcatcaattctgagcacatgagactaatcaaactagcgtgcagcaaacaattgatccactaatatgaattgttagtattgaaaatttagtagtataataccacgttgtttgtattctctttgtgatatgaacaatggaaaaaaaaactcgttgtatgcaaccttaaaccctatgattttgatgtactaccggatgaattagatttgaacaatggggaaaactcaccgtctatgcagttccaatatccaaaacggaagccaacatctaaaaccaagaaatattgtttgctgggttagggcggaggaagctgcgatggagaatgaacaaagttcgactctgacgacaacggcaagatggcaaactgccctagttttcttgactccccgtaatgatgcaactaaccaattttagaggtgggttgttgggttaacttaatcaattcagcagcccaatacggcccagtagtttgttgggctactggttagatggaaacatattgctgtatatgagcatcttgttgcctaaataattaaatgtgattgttgcgtgctcacatttgtaattagtggtttgcacgtgcttagataaaaaaaatcagtatctctctagtagactagtgctagtagcaaaacctaccgaatatggaacacaatcggagtcgatttccagggccgtgaaacacaaacgctactggactcctttccgcctaataaaaaagctcaaagctcaccgcgacaagaagaagcccagcccacgacaaaccacacccaccaccacgcacgcacgcacggtatacatacaccttcacattgggggcgatgggcagcagcaaggccaaccacccggcggcttcctcgtccaaggtctcctccgtctcctcctccaaacccaaacccaaacccaccccgattagaaaccctacgcctccgcctcctcctcctcgccgccgcacgcccccgcctccgccgccggggtcgggcccggggccgcagcgaccttcctacctctcggtagcgctccgccgccgcgggcctcccgcgggcagcgcggccgggaccccggcgccgccgcgcgccgccgccgcctttgatgtcgcccccccggtcgccgagcacacggaccccgttgtcttccccgcttcattagccgagatgagcggcggcggcggcagcagcagcagcgacgatcaggtatataccccacccccatctgctccccgcgcatcgacactggctggctcgtggctgctacggggtaattgcgtttttgggtgcgagtgaattaatgttgtgttttttttttttggggggggggcggtattgtgatgcttcaaagtttgtctggatcatggtacatgtggcactagattaacgcaataagtatgctactcacttgttttaggggcttttgtggccgattactgcataagctgttgttgctttgaagttatatggagtaagagtagttcgtttgagttttgaaggtgctacttcaaaattttaagtggaaccaagcattcccttaagccaatgcagctccttctgtgttagcttgatatttagggctacagatatcgacgatatttcgattaatagttgttttggacgctccacaagttattatggtcctgtggttatgattttctcatcatatagttgctcctgttgtgcagatccttctgtttgggagcttcacagaggctgaaaccaagttgtggcagcctaatgcaaataaaacacgggaactctctgagatccagtttgggtcactgaatttctcagctctaaatttatcgaaagaatcaaattctattactcaaggtgctgtctatcctgcaaaattaagtgacggccagaacaaaatcatcattacaaaggatattgcatgcagcaacaaaaaggaaacagtagctcctacattaccaaatggcaagccagtgctattcaatggatctcccactgccaatgccaatgtgtctcccaacaatggcgtcattgagaataatcagaaggctgtagctgcagttctcacgagtgttcctgctaaaaatgtcagcagcccagcaccactttcagttccagaggtggaccatgatgggatcgaacgcaatcaaaacagcagtttagtcccagaaataactgaaaatggagggccagctattgatacaccaactactgcagctccagtggatgagcttgtgacaagcttaaataaaaaggactttcggaacaagcccttgcttcctcatggtttgaagaatacaggaaatatatgcttcctgaattcatccttgcaggcattgctctcatgctggccttttgtccagcttttacagaacttgaggaaccagaatatacctaaggtgctgctatttaaacaattaagcttgatgttctaaccccgcttatttcaggctaatttttctgactacttgttgcattttaggctggttacccaacactgaatgcatttattgagttcatctctcaattcgacgtgctcgatgattcaaatgttaagaaagacgagaagtttgctacaatagcttcaaaatcagttattccctccatgtttgacacagttctgagaaattttactccagatgtgccagctggaacagcttctaggccaaggtaaaagactgttaatgcattttttttaactattagttttacttgtgtgaaagtaactcatctagttgttaatgctgataatctgatgtttggtttgtcggtgcaaattgtggatatcaatgactttttggcattttctttaacatctttagtccaacaagccatggatggcagtttatagtctggtgtttagctgatccttctagtactataatatattttgttcattctttcttaaagagctgtattgagtgtattaagttaaaaccaatggctcaatgcttacaagcatgattgcacgatgcttacgatgcttttgaacccctgactatatcctttttgttttttaaccctctgcttgaggctttgcttgtgtatcactatgatatttaggatatatgccatataaatatgaagttcattcaaacaaagtagtttgctgcatcacatatcgctgggacattgtgcatgctattctctatccatttctttgtgttgttgtagatgtccagttttaagggttcacctcaatttgcagtaagctatccttgtttcagtttatgatgctatgtacttatgcaggcaggaagatgctcaagaattcttaagttttgcgatggatagaatgcatgatgaactagtgaagcttaatggcaatggctcaaattcaaaggagggtatgattgtttcatcaaatgatgatgatgcttgggagactgttggaaagaagaacaagtcagccataatgaggagtcagagttttgttccctccgagttaactgctatttttggaggccagctgcaaagctgtgtgaaagctactggtaaaattttcttgtgcagagaaaaagcgcacactgttttggaaattttaatgtccttgctttccatgtcattactgttatggtatatctaaccaactcaacatttgcttgtgccatgtaactctataaatgatgttcctaagcatgcacgaaagttgtcagggaaatagtgtatatgcttatgcttgacaattgagattaacttaaaaaaagaaactgttatactatttatttctccctaagaagttatttgacattattaccagaatcatgggctattgtccttattttatacctggaaggtttacttcattgtcattcttctagttttactaacaagtcaaatcacacccattagtccttaaggtattactgaataccactcctacatgaatcatgtaactcaatatacctttcgcgaatatgttccccactgatcatgaactcatgactggcaaaccatttttcacagactcaaggtgaaaactgtgtttgagtgggtcaaattgtgcagtcatttgctcagctttgcttggtgagtgcagactgatggattattcttttatctgcaggtaacaaagcatcagtcaccgttcagccttttcgactgatccatcttgacatattccccgatgctgttcagaaacttgatgatgcccttcgtctgtttgctgctcctgaatctttggaaggatacagaacagctgctggaaaggtagcttgttgaaatttactctattatttgacctcttaattatgtcaccactcaaatggtttgttaattgcatgtatgtaaacttggtttttttacatgcaatggaaaatccattttgcatctactgcattttactcagtaaactatttatgaagccttccttttttaatgttaatattctgttaaagctgctatttaataagctatgttgttgaaacttctccttgtggtaccactatatttggtgctttcttcttcatatgaaagatgcaactgttatttcttgcaatgagttaaaattacaatatgtcaaactttgatcttgcaggctgggttggtgacggctagaaaatcagtgaagatacactcactttcaaagataatgatactgcacctgaagaggtttagttatggaagtcatggctgcacgaaactcttcaagccaattcacttccctcttgagctggttcttagtcgtgatctgctgagttcgccatcatcagaggtgatagtttgcccgatatggttttatacatttcctctcaaaattttgagctatctttcatttgtttcatccctccattttcctcttacagaggcaaccatgtcttggttatgcaattattgtgttattgcatatgcagtaggcttaagcttgcactccaagtttatgcacccattatggaatcacgatcatttcttagtttccaacatgctattgaatttgagacaaattgacgcttcttcaaatagttaaaatgggatctaacaacttgatttcagcacatgcagagtagaagatatgagcttgttgcaaccatcacgcatcttggggcaaacccgtccaggggccattacactgccgatgcaaagtctgccagtgggcagtggcttcgcttcgacgatgataacgtcacacctgtcagtctgaacaaggtcttgcatgaccaagcatatgtcctgttctacaaacaattataagtttgggggtattgctacggagttgattagcggttctcttattgcttgaacagctagatatatactaactatatcgcccagttaatgtagctgccgtgtaactgagaatcttgtgtcaagtgcctggtttcctgcgtttatttatatatgcttgatcacatagtgggggatttttgttcaggccattgttgaggttttgtaaaatgcaaatgtcatcttggtaatgaccattaaagtaaccatgagatgatatcactcgttagccctaagaaactatattgatcatgttattgcggtgttgcatttgattatattaaaacgtgattaaaacgtccagcttgtgagcttgacgattgctgaaatatggctctatggctgcctactgcgcttcaggtttcagtggctgtcaatcagtttggaaagctgaagctgtagagatcaacctgaaactgtgaatttgtgaagcagtttatgcctactatatacgagagatcgtggctgatctaaaatgacttctgcagatgccatttcctcgtaatgctggatcatgatccgcaagagatgatatcttgcactacaaaatgaattctgcagatgtcatttcttcacaatggtggatgatctatcaaatgaggtgtcatttcttcacaatggtggatgatctatcaaatgaggatttcaacactctttgtgcagatgtcatttcttcacaatggtggatgatctatcaaatgaggatttcaacaccctttttgcacagttgtacactgatttgtatttttctcctcttgctcttgtgccatccttcatctcctttcagagactcaattctcccgaggctttacactactatccggtacgtatacctaagatccccctccgtcccagaatataggtttttgtattttgggacggagggagtaacaatcactccactgttcgagcatgaattgatgtgcaaattattcgatttctctgtcaatacgtcctaatttgcagcttgtgacaaccatcaaatcgaggaagctgccgattgtgctttgctgatgttatctgttcaaggagccctgaaagtctgaaactgaaaaacaacatgaataacagtgaatgattagaacccagaaacctgctaaattgtttatcagtgaacatcttcataaaccgtagtggaacccttctgaaatcaatctgaactgaagctggcatctgcctgttaatacattatacataataaaattaccggatcatcattttgtgcagatcaacacactgtaactgtagtatgcagaaatcccgatctgcagttgttcctgtgatcctgtctagcattttgtaaagaagaaagcactggagcatgaaaaaaccaatctgaagctgttcctgtcaagcattttagttgtttgtttgcgttgatacgttctttgtttctctgtggtattgtcaaccagtcaaattgcaatataatatcattgagcgttatatttgaccaagttacttctgaattcatgcagaccactatcacttttgaccaattacttctgaattcatgttcctttctctattatcactttgaccaattacttcatttatgttcttcaccctacaatcacttttgagttttgaccaactacttctgaattcatgttcttctccctagcttgttttagagacttgactgctgaatcaacatggccttccataatttgctacctaactgaacctaaaccaagacattctcttgcacgatacattttgctttcatgcttatagtttagaaaccatgtcttatcttgcattgcatactaagttctcaaataatttaatgacagtttgacatggctgagctgtatgcctgtttatgcaaagctggcatgttcatcatacgaactcttcagttcaaagttgagagagccaaccagaaattgaaagccaacgtcaagaataaatcagctacctattgttagaatgtctatggatatctctgcaaccttaacagccagctgcagaaatcaatctgaacttaatgctgtttccgtctagcatttatctgtgacacctcacacgtagatattgctccttgaatggtacttatgttgctttcatttctaaagttactaaatcatgaccaattcgatggcgatttcggtcccagttcgtcacatttccacactgatgtctttcagaggctttaaacttccaccttcttttcagagctcccaattaaatcatctttcttgatcagtcacttccatttttgctactgatgatgccagtaataaaccaccatcatcggcatcgcacatgatgacaattgacaaaccaaccaccaactttcgagatccaacaaattcacagacaacaaaagagcaggtttctaccagattctgaagagagcaaaggaataatcagaagttgaaagattctaaacattagactgcttgccatcttaatatatccaacattaacaagggcggtagtagaatcattagtacacatgattctacatcactctctatttttgcttttttttttctaacacattttagatgatgcacctgaaactgaacagaagctgctttactactacaagggatgcagcaccagaaagctgcaatttttccccctttttttttcagtttttatacacagtgaagaaaagcagagagactaaactctgaaaactccaaggttatacactagacagcagcagcagcagcatcaccactcacccatggcgctctagcgaggctggtggatgacgtggcgggcggcgccgcccttggcggcgacgaactgggccggcttctcggcgtgcctcaccatcccggcgccgcccaacctcggcgagttgaggctgagcgccctgagcacgtcggcgtcgagggtgggagtcgtcgtcggcttgtggtggacgggggggtcgggggtgtagaagaggtcgtcggtgtcgaccatgtcgaggaggtcgagcgagtcgtcgggcaggagcgcggcgaggtcgtcgtcgaacacctggcggtggtggtcctcctccgccgcagcgtcctcgtacatctggtgctgcctgaaccagtggtcgcggaaccacgccgtggtcttgacgagctcccaccactccggcgagaagtcctccaccctcctgaacgccgccgggatgaacggcgccgcgttcgggttcagcgacgacatcgccatagcactcatccctcactccaactgcaacaaacaagaacaagaacaacaacgccatcaataacccaaaaaagaaacaacaagaaattcgctagctagctagctcatggcgatcgatcaagatcgtcgaagattactactaccttttcttgggggaaaatatctcgtggcgcgacgcgaacggcgattgattgattcccgcggttttgagagagaaacggtgggtttcttgtttggcttggctgcgcggtggtggagggggagcgcgtttaataggcgagaggggaggagtacgagcgggtggggtggtggggccgggttgtcagtgggagtggctgacgtgtggggccgggttggcgtgtgggtggggtgggttggggtgggggtggatggtgagttggtgactggtcggtttgggtccctttttcacatggggggtggggccaatggggagtgtggtgatgcttgggcgggattttctgtgggcgagggatataataattcgggtggaagtttcctggcgatagagatattgaagtgctcctatggagagagagagagagagagagagagggtgtgtttaatgtgtaaatcgtgtacggtttgcttgtagttatcggataagatggggctgtttggatgggacttttcagtccaaccagatgtttgacactaattaaaaatattaaacatagactattgataaaacctatttcataaccctgaactaatttgcgagacgaatctattgagactaattaaactataaataatttatgtgatgctacagtaaacatgtgctaattatgaattaattagacttaaaaaatttgtcacgcaaattagctctcatttatgtaattagttttgtaagtagtctatgtttaatactccaaattaatgtccaaacatctgatgtcacagagactaaagtttagtccctgatccaaacaccacctaagttctgttcttcattcattaactacttcaatccaaaaataataaaagaaagagattccaaatacatttttaaaaagaaattgattcattctctctctatcccaaaataataaaagaaagagattccaaatactttttaaaaaagaaattgcaagcgtgttgaggattgaacacgagaccgcaaggttgaaacgatacacccgttaccactactgcatttctattccaaaacataacaaactttgagtttaaaggttgctattacctagcccccgacaaatatataactaccccatccattaaaaaaaaaaaactcaattctagctacgaacctggacatggtttgtcttttttgacaaactagtaggtagcaacatttttaggccgtaagaagtaataaattctctttttattaaattaattaatgtggggattctatgttcattcatttcattatacttctcttggtcataaatatttcttcaaactctataaaatttcaacaactgattttatgttaaaagaagtttttaggatctaataaatttatgatattataatagtactttttgagataaatctatgtagtagtatatcatttgttttgtttcaagtcaaaacatttaaaaaatcatggattgtcggaattgtaagaagtttgatcagatattatcgtaagcatcaaatgtttttgacaagaggaagtacattatgccaagtccttttcggttgcanntaattattnngtacagttngtatattatagtatgacaaagtcaccattgtacagtgggatgactagaaggtacgcattctaaattatttatggacgaatggattatatgcgttattacactttttaaattatgatttctccaaaagtaggcaattcgtctatgctatttttatttttataaaatataatatctaatttcttcgtacttaattgcaaaataacaagtagtgacatcaagaaaagctttttaggattggttgagatttggacatgatctcaatagctttatatatatatatatatatatatatatatatatatatcaagaaaagcttaatttattcctacttagttgaatctgcccaaccataaaaataacaggccctaacattgagaaaaccaaagcaactttttttcagaggaaaaaaatagaagatgtaaaccaaaactaacccccgaattgatcagcaatgttagtatatagccttggcttacggcatcaggaactaaaccacagattaactaaatccaacatggagccctaattatttatcagatagatacaaacacgtcgccatcgaaaaccggcaccgtcttgtaatcatacttaattgcaaaaagaaaaagatttggtgaaacgtttcttttatgcctagttgggtggtgacatcaagaaaagcttattaggattgattgagaatttagacatgatctatcgacgcatgcactgcctttgctttccacgcaacacccatatgagctgaaaaattggattgcagaattatcaagaaagtgaaatgattttgattgctatgctgtggaactatagcaatcagtccgagttgtaaagtttcagttagaagaaaaataattgcagataaaaattcttgtctgttttactcggtcaaaatcgccggtcaactggccggtgtgctgctccactcaaagtctcctgtggtagactttggggttacacagagtcactgttctttgaacgcggtgatagctaggtttactgtatgtgtacatcctgtttggaatgagaaattccgtggaaatttcacagtattttcaagacagacaatgaacaaaaaacatttaatgattttttcaggcatatgaaaaattcctatgcttcaaacgagaattcacgatggatggtctgaatctagaattaagatctttttgacgtaaattcagagaaatatgttcgctgacatgttagacgacggggaaaagttatgtcagagattcttattaatccctaaatttgtagtggg

SEQ ID NO: 9815 - DNA, 12037 bp, Oryza sativa
cagatcagctaatcaaaccggtgatcattccagcgtcgtctcatcatcgaccccatgtggattgcaaccgtgcacgccaaccgacaatcaatcattgggtaacctctgcatcaacacgggtttagaattcagagaagatacgagttcgattagaattcaggcatgatcagcagcagtttaattataatttcagaagataagataccatgagctgtggatgttctgctgttcgtctgttactaaaagatcagttgtactagctatgctatgctcgaatgattgtgtttctccatcttttttaaggttggattaatttaagctgctaattacgtaacttgaggaagataatttagacttatattaaattatgtggctgacgtgattttgatcgatgggcgagatgcacatcggttgaatgttgaattggaccgcacctgctgacccattcgaatcatctaaagtcgcgcatcattttaaatactaataatctgggcacacatcgatcgctaatttgagcactgggtttggagagaataaattaaaagaaccaacacgacaaggaacagacatctcattgatcggtttcgccgtcgcaatcggcgaaactatgatgaacatgttaaaaataaataatttaagttaagccgacatcactccatttgaaaatgaagctagtgggatgggttatattatggttttggttagaattttgccatcgattaatatgacctatagctctaccgtaggttcttcagcttatcgtccgtaacaaaaaaatatatttaggagtaatttttattttagggttgattttaatttttttaattttattttcttgcaaatgatcgttaattaataagagcacatatataaaagtttcacttattatttattcttataagttatatgcgaaatgataggattatttaaggccatgttttttaacacttttccgacttatacgttcgtatttttcacacgcgttttttaaattgttaaacggcgtgccttttataaaaagtttctatagaaaaatctctttaaaaatcatattgattcgatttaaaagtcttttttaactaatatttagctaattatacgttaatctgctcgtcgggtgggaggggatctcaaccctaagtaaatgaacacagccttaatcatcttctcacacttaattgcatacagtatcacttctacttttcttttttttttctttgtggaaaagactatgctattagtagctattagtatttcttttgattccttgacaggtgatctgacgcaatttgtagctattaggccccgttcgaatccacttaaaataggggattaaattttggattaaaatagcacgactttcaaactgctaaacggtgcgtttcatgcaaaaattttctatatgatccatttttcaagtttataataattaaaactcaattaatcacgtatttattaccacatcgttttgcgtgaaatacttaatcttcatctttagaagattcaaacaccacctttttaggtatcagaaagtttgcatagcaccatggctagctaatgatggtatgtgttgaggtatcagaaaggtggcaaaggtgcggtcaataattcagtcgaaacagtccgtacatgtgacattctgttagcaatttcggtgatgtcgcctacacaataataagataaagaggatgccgaatatgactgaaatagaaatacgagtactaaagatcatttttttcgcttctgtgcactagttcgctgagatggagagcatcaagcatgccggccaagtgcccatagtacaggttatgtatagtacatgccctcttttttccctcgttatggaatgaatttctattatgtatatttttttcaaaaagtatattataatactctcaccgctctaaaatatattcagtccgtgccaaaataagtacattttgcatggtttatgtgaaacgtttgatcattcgctttatttgaattttttttatgattagtatttttgttattattagatgataaaacataaatagtactttgtgtgattttttttcataaattttttaaataagacggacatcaaacgctggacgcggattctcatggctacacttattttcggacggaggtaataataacttttagccttcaacatttgtcctaagatatgacaacttattctcttctctactaaccacaaccttgcacctcctaattttctcacctagctaccttatcctttcaatcaatcacaactttcacatactttctccgttttataatgtaaaactttatagcattgcccatattcatataaatgttaatgaatctacatatatatatatatatgaatgtggataataaaatacaataaaatatatgtctagatttattaacattcatatgaacgtgggtaatgctaaaaattcttacattatgaaacggagggagtatttaatttcatctattttattgttacttgtgattaacactaaaatattttgagacagaggtaatagttaagtcatttgttcgaaacattcctctttcgaaggtaatgagcgtccaaaaggacaagccaggtgaagtgaactggatgagctcatcgattggctcacctgccaagtacaccggattgggatcctctaacgtgacgtgaagtcagataaacgtgtcgactgatatgtgggcctcaccgtctacgggtccacttgttagtgaccgcgtcggaggatatgcttccaagtacaccgggtgctagctagcctactactgctagtctctagtgagagtctagtctcctctccacatgttacacgttctgagatgaacgcaaacgcgtgatgctcacaccaaacgacgaacagaaacgccaggcccgtttagtacccaaattttttttcccaaaaacatcacattaaatctttggacacatgtatgaaacattaaatatatattaaaaaaaactaattgcacagttagggggtaaatcgcgagacgaatcttttaaacctaattagtccatgattaaccataagtgctacagtaacccacatatactaatggtagattaattatgctaaaaaaattcgtctcgttttttcaggcaagttataaaattagttttttcattcgtttccaaaaacccctttcgacatccggtcaaacatccgatgtaacactcaaaaatgttcatttcgcaaactaaacaggccgagattgagcactgtacatacataaaatccggtgccggggacaagccccgtacgtctcgccgcgcgcatcgtggcgcctagtagctctctattagagcaagttcagtatagccaactattagctctaatttatctatagtcaatctaatagcttattcatacaatagttacatactacactattaatacctggtcccacgtgtcatacacatattatgtcttggagtccgtgctacagctggctataaatttgtagcccgctatttttctctcttcttatttatcttcttaaaatatgtttacagcgtctgctattgtacctgctctaacctctcgtgggttgcctgccggcgatggcgatggcgatggccgagagacgcgtcgtcctgctccgtgcggcgccccgtacgtccaaaagcgcatgcatgcgcatggttggttctggtcgccgtcgtcgctttcgcccgcgtgggggtgtcgtcgctgtcgcgcggcgagaggccagccagggccaccacagtccacagctgctgccagctgattgcgttgcaccgcgcgcgcgcccgaattattaccgccgcggcgtgcgtgcatggcatggcaacgatgagtacgacctctctccgatggcgtgtgagcgtggatagatcggtccaggttctccgcaaagggcaaacgcattcccggccgctggtcccaacccaactgcagttcgtgttaccaactactcccctctccaacactgtaataaggggcggatcctgaaaaaaaaaattagggtgcttaattacacagtgtttcaacccctgttaatttagaggcttttagtttattatttatagtgaaaaagtcgaagagaatgctgcgaagatatctatagatcttgtgaggtgcagggggacttgacgtgggatccgctcctctgcatgtatcatgcttgctgctgcctgctgccaccggcgattcatcatagccgttgcgtacgtgttgctttcctaacaacactgcatgcaactgatggtcgtggagctatatacaagagtactctatctgttaaaaaaaaactgattatgtaaccagtttttttttacgcagagtacggttgcattctttactcgtgttcttaacttcacccctactcgctttttacatgaacgcttcccaaactatttaaatgtatgtttcttaaaaaaaaagttatatagaaaagttgtactataaaatcacactaatctttttttagaaaataatacttaattaatcatacactaattgataagttattttccaactcagtttgtcaaactcagactacagctggtatgatactaaggctgcattcgttttggagaacaaaggatgtgcttagatggtggaaaagttgggaagttaggagaaagttggtagtttatatgtgtaggaaagttttcgatgtgatgtgatattgggaatttggggggaactaaacacggccaaagggagtttgtttgttccgttttccgcgcataggcttcccacactattaaacggtgtgttttttataaaaattttctatatgaaagttgctttaaaaaatcatattaatccatttttgaagtttaaaatagttaatacttaattaatcatgcgctaatgactcacctagttttacatatctttccaatcttctcgatcccctctcactcgagcattagggcacccataatggttatctataggctctctacaagagatctatgtcagtatatttttctacatggaagatattaaatgaagagagagagagcaaagctatctactaacttagagatagtctataaataaaaacgaggcaatgcatgagagagctatagatacccatgtagatactattgaggtggtttactattaatctagtctattgctgagatgtacatgttttatagagaacaccttactttactattacagatacttttagtgtacggatctagtagtcatcggcatgcagctagctgggatcatcgaacgaccaacgtactccgacatagtacgtacggtttcgaccattgattgatttgggtctcgtttgattgtaaaagcaaagctcatctgactgatcgagtttagctagctactgggcaattggggtctttcttttcatctagatctcccggctagcttgatttgcgaaagagtttcctactttcctttgtttataaagtacgtttagtgatcgatcgatttctttgtttataaaaagctctgaggatggatgcatcatcattcatatcctcgtcactgacgataacatgaggcgcccggtcgattggcacgccactaatattattgccgtgtcgctttcagcactgcgaagatagcggtagcaaaggtgcctttgattgattgattgatttttaagggtgattgatacttagtacattacattcctagctgtagcctgtgtttagttcacactgaagttgaatagcagttgggtactccatccatagctgaggatgaaacacaatatgatatctagattcattctattagattatgtcttatcccttatgttgatttttttttgacggatagagtacttcgtatagtctagctatacagtgtcttcaggtgttgcagaagtctgtgtgctgttgaacgaaccagataggagaaattggtgtaatctgcttgctggggtcatcagaaagcaccaggcccgatgatcaagacccacaagacaccaaattggtggcccctgtgagctaaagtaaggatacctttgatttgtagaaaaaatgtagaaattttggaggatttcaatcctatagaaaaaaaatcatatgaaggcctttgaaacgaagagttgaatcctatccaatcctttaaaatttctatggaatgggtaatcctatgcacatttggggaaaagttagcaagagctctaacctcttggaacatttcctctgagtctatctctctcatctgattcctgcgtttttcctgtggtccaatcaaatggtcattcctgtgtttttcctgtattttgcaattctctgttttacaattgtattcctgtcagaatcctatgtttttcctattcctctgtttgttcattcctatgattcaaaagggccctaagctttgcaacatcggcgatccacttccactccatctgaatgctgtcgtatagctgccgttcaggctcaaaattgcaagttgctgtttctgaaaccgatggaattcagtggagaagatgcacaagttcagtaaaacgcttgatcacttgttctgatagtcagatgattaggaagaacacagaagtacaaaacttggtcaccaaagattagttcccagctgactactctgatggtggtgccacatcataatcacaacagttgagaaacatttgttctgatttattaccttgttcaataatcacacgctcttttttcccctgatttattctaattattaagagttcccaacttctagtgagtgagtatcattcttgtttgcgcttttcagacttcactcgaaggcttgcgaacaagattgaatgatgagctatatatcatcttgcaggttgtgatctttgcagcgatgaacgcaagagtttcagtacaacacttcgaatggaatagcgatggcgtccgacgaggcttctggttgcaaagaatctgaccccacacgtcagagtaacaacaagtagcaacccgagttcatgggccacttgggccgctctactacttgggctctgggaggttattaggtccacgcggtgggaaatcacaaggattcgctcgcagcagccagcagcgaaggttgccgttgccggttgatttggtgcgagagtttagtaccacctcgcctgttcagctgggagaggcggtcgcgctagctataaaaggaggccgggggcctccgtttcaactcatacctttctcggccttttggctaagatcaagtgtagtatctgttcttatcagtttaatatctgatatgtgggccatgtgcccacttcgatattaaatttattttttgtgggggagggtccaccacagtggcttgccactggggccctcgcacgtcgcccaggcgttgcactgctgcccgggcctggcgcaccccaaccaaatcaaatttaaaacttttaactctttagaagttggtttaatcacaattttttctgaagagcatgcttttgtaaggggggactgtaatagaattgtttaaaatctaggttaaaatggttaatttggattagcagtggtccttgcgtttacattttccttcagatccatcttgatgctgtaaaacgcatgcagcaacaatagagcagtttgatgattcaggagctcttgtcttcctctccaccccctgcgccccgagcccccgagcatggcgatcctcgcatcccctgctccctctccagctccgtcccgcccgcagggacgcctagttgtcctgtcacgcaagagcttggcaccccactggtcatttgtttgttcttgcagtcagatatatatataggggatcgagatcacctgcggtaattaaatcaatctggagactggagttgcggcgccggcgctgtggacgaagacgacgtagggttgctgcatggtcgatctctctcaggcgtccagtccagtggcaatggacacggagaccggcaccagcaaggggcaacggcggcggcatcgcatgcgctgatgatggagacacggccgaaaatcgcaaccgcccgacggccggtgtatgtgctctggtgaagggcggtgccggtgcaattgggcgatagtttagcctgggctttaggtatgcgcgcggcaagcaagcgttccgccgccggtggcgagcagtggtggtaacccggcggtcttggatagcctgctcgttaatgttttcgaaaccgatggaattcagcaggagatagcagagggctagagaaaaatagagagcgaccacacatcaacctctcaatacgatgaaaacaagggccagagatgcaataagcagtaaaaccataatcaaatcggtacaaattgaacgagaattgttcaaaacaggcatcatcaccaaataatcaacaaatagatttcaacttcattgcttgaagacaacttcaaccttccatgctttcgaagagcagcaagtagcttccatcccgatagaaaaaggcagaacgttcatgtaggaattaagctaaaaccatccgcatagatagatgcaatggcatgcctgagctcagtaataactaagatgaagaacctaactccagccgcactcaacaatacggacaaatattgctaccctgtaaaaataaagttgcatatacaaaattacaaatattgttaccctgcataggacatcgcaaaccagagcagaacctgcaaattacaggaaaaacgccattgtatacatattcagaaaccggcttgacgacttcaaggcaaatgatgctcgtaacaatggtaagactagggtacaagaaccaaaacttctctcttgatctggaaactggagggtggtgagacagaagacgcacccaccaccaagacctgatcattgatgtacccctgtgacccgctgttaacctgcaaatattgttaccttgcatagaacatagcaaaccagatataagcaggtaaagtacacacccaggtaaagtacaaggtaaaggacaaccaggtaaagtacggtaaactgcattgtatacatctggtgcaactggtaaaactttgttcctataattttttaccctaatggaaccctatacaaaatccaagaaagatgaattccttttgcagcatatacaactaatgtttgcaacggactgttactagcaatcttaacgaataaatcatcagggatgcctgtaagcctacccaatctggtactctatctacgaatggcgaaggaaaaccatggtgaaagggatcgcctcctcaatgctccacatcaacagcgcctgcttcgtcatccatcatctacttcctgccaatgaggtgaatgaacatgcttagacaacacagctggatgccaactgaacagaaagtcaacttttgcacaagtgaaaaccatgcatggagttttgccttgccgatttgacatgatatgcaactactattgaacatgaaaaagggtaaataaaaagtacaaattggcagagtatcatgtttccaatgctaaaagctagtttatttttttggttgtaaaagaagatggcaagcaatatcacggaggttccacatgttttacctcgtaactgcactagtactactctcctagaataccttaagaagttgactgtaacaaaacctatttatgtgactctagtatgaaggacttctagcaaaattatttaattaattttggcctgttgagaaaacgacagctaacataacgagcttaaacgtgaaactgtacgacatcaaaaacagaaatgggaactggtatcatgtagtttttaccatatatgatcacacagtagaaaataaataaatatgtgcagtactcatcacgaaggaataggggattcatcaagcagaaatagcaactcaccttagaaatgttagtgcactgcaatggaaaaccagctggctcaattgtaagatatctcaattgacacaagaatctcagcaaagtacagatgaaatccaaattatgaccagaagagtggagcatggcaaggtatttgcaccccaaatgtttctctctgtcagccctaccgagaatgttataacttgaccatggtaaaagttgtaccagatatatgcttattgcatgtcattctcaataatttgaacgcttcacttgtcagatcagcataattccaaaaagaaaaccacaaaaaattgaataatccacaaaagtagccttctcccttttgtagattattattgggttgcacgactgatatatcatcctatagcacaagtaatatatgttgtgaggcagactggcaacccgcaccactagtcagcagaacttgtacgagagcagcagcaaaaagttgggtagcagacagaacatgccagatatataagttttcttttcaatgtccaccataccctataaagtcaccaccacctgaagatcaatgtcatgatcagcaggaacaggattctcctcaggtttattcttggtttgcaaaggaatagattcctttatcttaccattttctgatgctatgatcagtcctttgtcagatatcctaatgttgaaggggtcatcaagaaaaccatccgactgcgtcactgcagcagagtgttcattattttcagtacagtcaagctcttttggacttataatattatcaagctcttctggacttttatgactatcaagctcttgtgaacttcgatgattttcaagctcttttagactattttgattatgacactctttttggcagtcttgattatcgagttcacccaggttattgtcaagactatgacactccttaagaatttcatggttgttgagctcatgcagacagtgtgcttctccaccagcacatatgctttctccagtactatcaagctccttcgtattgttaagattgaagaacatttccatattgacatcaaactcttctatcttgttatgatcaccaagctctttctcagtgctagtactatcaagctcctttgtactgttaagattaaatagcactttcatattgccatcaaactcttccgtcttgttatgatcaccgagctctttctcagtgctatgactgtcgagctccttttcattatgatcttcctgcgcttgcaaacaaatatgatcaccaacttccttttcaaaactatgatcattaacctctttctcaatgatatgaccatgagacccttccagactgtcatgggcaaccagatctgttgggctcctgtcttccttgtcctctatagatctgcttgtgacgtcatccttatcagattgagccataaggatattatctgtttgtacatacggacaaacaggtacatctttcaaacggcatctatggcacttgaaacctatgagattattaacattctcaagagtaatagaatagatgtctccatggaaccaatctacaagaataaacaattctaattagaacaacaatttgtgaaatacaaaagtttgcagtggcaggaaaagcaacacaagtcactgcacaaccatcaaaaaattcaaaaatgataaaatatggttacataaagaagtgataagtaaatgatgctcctcagtatgtccaagacctaaaagtaataagtagaaagcacataatccacaggaaaaggatagtaaaatctgttaatttgtttcaagaggtccaagcaaatttcagattcatactgtccccatctcttagggccaaatatagtcattctatacagagaatgcaggtttaaaaaattacctccacaatcttcacaggcaatataaatagattctccactgtagcatttctggcatagacggcacactggaaaaacttcagacagatcagcatcttcgcagggaaagacaactctttctgtcctaaaagatattgcccgatcatcatttgggttttgtgtccaccgaaggccatctaaccagtatgaataatgagaagcagtcctcctcctctttgctgaacgctcagatatatttgaattgcctttcatgtactttgaatataatctttttgatatacgtttagctggctcattcttgggcacattggctggttctttcacacgcaactctggcaatttattctttgactcattcagcgggtacttcctaggtcggccacgcttgcccttattcttgcccatcttctgcttggatttggc

SEQ ID NO: 9816 - DNA, 716 bp, Oryza sativa
aaaatgtatcataatctcttcattcaactactgggatggcagaccaaagttgtaagttttgtcattttgagttgtgtactgactgtatatgtgttgtggctagtgaccgctttctggggcatgcacagtctgttgatacaatgctgaaggttagagcctaaaccttgtgacaattcttattgtagcctactatttgttgttatatgcaatcctttgtaagccaaatgtcttctttttttcttttagctggatgaagaaactctaatatctggtgcatcggatggtgtgatcaggtttggtgccttgcttccctttaccctgccccagttcccaataatatgtattgctgttttaacatgatgcccatgttttcctttcagattagtgggtatcttacctaacaggatcattcagccactcgctgagcattcagaatatccaattgaggcccttggtacgttctgatcatttgctgcctgcttaaaatacgtgtaaaaagtacatatgttctaactagttacttacctttgcatcacagctttctcaaatgacagaaattatctaggcagcatttcacacgataaaatgttgaaggtgatctctcttttcccatcccccccatagcgcaccatatttttagtctaaataactgtatcctatctaggaagcatttcacacaataaaatgttgaaggtgatatctcttttcccattccc

SEQ ID NO: 9817 - DNA, 3501 bp, Oryza sativa
ttggttatcatggatcttgagcggatttaaagacatatactttattcatatgtgcaattcgtcacgtttaggttatatatatacatatgtcgtatctagtttctgggatatggaaatgtttgttattcttgtgcgcctacttgtggtcttcaaatgataaggatgtgcttttttttgagtgccaaaagagtcaacattcataattgatggttctacattttcaacaaagttatcttctccaatttatacccgtgatagtttcaatctttttgtggcagatctgccagcagcatgaattttttacaaataagaagggtggtcgacatgtaaaattccatacattgataactacttatgaggtcatacttaaggacaaagctgccctttccaagatcaaatggaactatcttatggtcgatgaagctcatcgattaaagaattgtgaagcatcgctgtatacgactcttttggtatgaacagtatttcctgaactaaaaataagagtgagttgactacctggaaagatgactctaatttcactgcccccacacaggaattcagcactaagaataagcttctcatcaccgggaccccattgcaaaacagcgttgaagagctctggtatgcgattttatgtagatttatggttggaagttcatattcttattgtgaataggtgactagagactgcaacatgttcatagctgttgcattttgcctctatatatatttttgttttacctttattattctttgtcccatttttgctgagtgtattttaaaatctgcagggcgttacttcattccttgatccatctaaattcaacagcaaggatatatttgttgagagatacaaaaatttgagttccttcaatgaaactgaggtaaatatttttctctttcaaaatgtacttttctcttgacctagactattctgtcagcattggacatccataactttgcttgatttatttttatagcttgcaaatcttcacaaggaattgaggcctcatattctaagacgagttataaaagatgtggagaaatctttacctccgaaaattgagcggattcttcgtgttgatatgtctcctctacagaagcagtaaatactttgtactaatgtaagtttatgttccttttattcatcattgagataaaatcatttttcctaattaattattaggtattacaaatggattttggagcggaatttccagaatctcaacaaaggagttcgtgggaatcaggtgttgataaatcttgagcactattttattttagtaatgatttcttctattcttctgttcctacgtagtcgctatgacggtgtactacttttatatatgcaaacctttattgcctgatttactcgatgcattattattttttgacaaccaccacttatctttaacttcacaactatttataattaggctgttcacaatgcttgtgtaatgctgattgtccttcatggaatatcctgtatattgtatttgagaaatgagcagtgcatatgtagcagttctttttccaatcgagggctatttttcctgagctaatctgcagttcttcgtgttttcaattttttatgattccattttgttttttctaggtgattcttcataatatacacacaaagaaaatagcattaacaaaacacagattcttctgcaggcacatttaaatgtctggttatttaaattattctagctaacttgattattgcatatgcaggtctcgcttttaaatatcgttgttgagttgaaaaagtgctgcaaccacccatttttatttgaaagtgctgatcatggttatggtggagatagcattggtgatcgcaataaagttgaacgcattgttatgagtagtgggaaattagtgttattggacaagctgttggtaagactgcgggagactaatcatcgtgtgcttatcttctctcaggtttgtatgtttggtttacttgccatttgatgcccattgtgttgcagtctatattagtcgaactaatagtatccaatacattgtctaaacttattttctacaatccattagcaatatgttgcatacgtgcagaaatttgcttcaatttgagaaattagtatggtgagtcaagttaacaacgtggttagttggttgcatagttggttagtgttttgtttgcagaatgaaacttctcttcagggatgataggaagagctggctcagtgtatttgttttgatactttgcagtgttttttctgttcttttatctgacagaacaagcttattcaattggttgcttttgttagttggtaaatgtatttatattttttacaacacaattatggtttccctgcattttgaaagctattgtgttactagagccacatttgtattttacaccaacatcaatatatcggacaacgaatatattatatgtcgcttgaaagcatttgcaccttagataacttatataagtgctttctgaatcaaattgttgcagatggttaggatgttggacatccttgctgagtatctatccctccgaggattccagtttcagaggcttgatggcagtacgagagcagatcttcgtcaccaggccatggagcattttaatgctcctggaagtgatgacttctgttttcttctgtctacacgtgctggtgggcttggtattaatcttgcaacagcagataccgtgatcatttttgattcagactggaatccgcaaaatgatttacaggttcccctctctctctctctctctcatatatgggttttcaatttttgtcttgaaagagtttctcatatttcgggtttttgaatgtgtgatgtcatgctaggcaatgagtagggcacacaggattgggcaacaagaaactgttaacatatatcgtttcgtgacatgcaaaagtgttgaagaggatatattggaacgtgcaaagaaaaaaatggtgatgagcctgatttgtttcatatattgttttaataaatataaacgaataacctctgacttgttctttttctatatatgtcaggttcttgatcacctagtgattcagaagctaaatgctgagggcaggctcgagaagaaagaatcaaaaaaaggtggttccatgtttgacaaggtaagtttctgcaccagttatttagtttacttaggtatttgggttgatttggatgtcatattggtttggtacaacaatattacttaggtagttttaacaatcttttgtatataagatagatttgtatatttgaaatctatctattgtataattgtattacaaaagattgttaaaactaccagtaacttatcaactaagcgattgttagtgatacaggctgtaagtctagtgtggtatatatatgctcatgtgactagaccagccttctttcaagatacccaagctataattctctctacaacacaagagcatttactgataattaaaattctgagagaaatgcattaaatagaatctggcttgtcacctcacttgtattttctgt

SEQ ID NO: 9818 - DNA, 1229 bp, Oryza sativa
cggcgacggcgcccctcctcccgcgagcggcggcggcagcaccctcccccaccaccggcggcggatctagcgggtggggaggcgccccgcgagcggcggtgacggtgcccctcctccctcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacagcgacggcggcggttcggcaacgacggcgacggcgacggcaacggcggcagcggcggcgacccccttcgatctaattttttgtttttatttggatatatgtgtgctggcggcgacccccttggatctaattttttgtttttttgcaaagtgctataaggctgcatgtgattctttgttatgtgctatgatttttttatactatgtaaatatgcacttgttctcctggtgatgctaaccgaataggacttggtataattcaaaccaagtcctattcgcccaaacagaaacaaagtcctaatcagctcaaacgaaaacagatgggagtttgttttctatttttgtggaatcggacatattcttttaccgcgttgatgaatcggattcgttccggttttttttcacccggtttttttgacggacgatggaagcacctcttattttttaagtactagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttagtatttttaagtaggtatgtgtataattaaataaatttacaagtaaaattctccattctccatggttaaataaaatgacatggttaaatttaattttattaaattctccataattagttatgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctttttttcggctcgagggaccaacaata

SEQ ID NO: 9819 - DNA, 671 bp, Oryza sativa
agcggaggaagtagagaagactgtcacaaaaaggtaatgcaaatgttcacaaacacacagctactataagcctatcaagttcaaggagggactggtgtgttacataagcttttgctagtccaatactgataattaattgagcaagaatattcttgttgaggaaatacaatgaactaaaaatgtgagtgaaagataaatgaatggtttcaacatacctgatctttacttctttgtcacaatggccacaaagcccaaggacttgcttttttgctttttctaggagatcatcaaatcctgatttttttggctttgggggtttcaagtcaatcatcttctttggaaggtgatcaatatctttctttttcagtaagcgagttaatgctttagcttcatatgccttcaaaagactcagagggagatgtccttcacttaaccagtatctgttcctctcattagagggttcgtcaagtttttttccatgtttagcaataactggaggaatattctccctcttcccaaaatcaagtaaatattccacatttgttccatctacacgctttctgcgaactatactttcttgaaaagacgtgctattttctgggtttcctttgttgcaaggctagcagggagagtgctcaatatctcagtccacctgatattgaatccaagct

SEQ ID NO: 9820 - DNA, 1519 bp, Oryza sativa
catcttctgaaaattcagattgtgattttacctgttaatgtaacaggaagcatatgagtatgcaaaatagcatatgatagtatacacaaaatcatataaccaactagaattcaataaactggaacaacattgatatactataaagcaactcactttattcctacgaagattgctgacagataaagtcccgtcgccactgcaaacaacccaagtagttagttctgattaccaaacatcaaggcaacgaagacttctgcttagaattgaacgagcaaaagtaacacaaaggaaaaataaattcagtgagacaacaaaacattagcatcattaatacaacaccattgcactaagaaacaaatgagtagtttctgaaccagtatgaagtaaattatataaggttcaaatcctggtatccacaaatatggctttgagcatccttagttggtgcagaagccagaaattatagttcctttgttaaaaaaaggaacgtggaaattttactgaattcgtgctggaatgtaaaagtttcctttcaaatccatgtgttccaagtagggcctaaatggctggagctgcttcatgaataattacataaaatggtgtataagccaagcaatgctgatctctttccaacaaaaaagcagatttcgcatgcatactgaatgacatgcatattgatcagggcttgaaggcgaataaaattatttaccttgttgccagtatttgagttgagtcagatacatatgtcatatctgatatgtaatcttcgtggcagtgaaaggtgttacagcaggaacgttcccgagtatcccatacctaaaattgcacagctattttacttcaaattgactttaccaaagaggcaaactatagtcaataacacacaatacaatgcaggtgtcagtccaaaaacaaatgtacatggaattttggccaggatggtcttttctgcttattacccaatcatgtgctgatgtgcatatatgtatactcacgaacaagacatccttgggtaaataagcttatcaataatatatatttgcacaccttttaaatatacaggttttaagagtcaatgataaagctggcctacactcaacaaccatgcacggttaaaccagattgactacttataataccttaatgcaaccttcatcatcacctgaagcaacagtagtttcagtaagacacacaaggcgatttatgccattcctataatattttaagaagaagatatttagttccacaagcaaaattcaaagaaagaactgcaagtctgcaaactgacaaaacttactcatgtgcatcctccaagcgagcaatgggtttgccagtttccacatcagaggcaagaattgagcaatcagcagatcctgtcaaaatcactgaaacatggcacaaagtcaagatagcccgcacaacatggttagaggagctaacagatgaatgtatgtgtcttccttcccatccaagttagttttacaattccattgtgaacacgaatctgctaatgttgcag

SEQ ID NO: 9821 - DNA, 1259 bp, Oryza sativa
tgaaatacagccgataatccaaacatttagcatttactttctaccataagctgctgaaacaggcacctagtagtacacaaaatcctgaagtatacataaattccagggaaatctcaaaataagcattagcagcacgaacatctgtagctcaaaaggtggtaattgtaaagttgttgaatccaaggagcgagagactaaaactaacacctaaaaactaaaccctaaacacctgatacaatgataggatcatcaatgcaaaccacaaactaacagagcgcgatgaacagcagcgttggtcgtgagtacctctcaggctgcgactccgcggcgtaccggaacctgcgaaaccagctcgataagaagagaagattaccaaggtcgcgataagaacaaactaaaatcagaggagggggatgaagaagtagtggggcgcgcccgtggatcgtacaggtagagctcgccggtgatgagggaggttgcgacgaggggggaggacgggtggaaggcgaggtcgaagggcatctcctcgtggagggcctccatggcggcggcggcggcggtggcggcagacagaggtggcggcggcggcggcggtggcggcagacagaggaggcggcggcgcgacggggaagaagcctaggagacgggagcaatgcgcttgtagcctcacgtaaagcttccttggctgggctgtgtacgagcaaatgggcctcaaacaaggcccaaaaacttttttttccacatttttatttgcaaaaagtacaccaaaggttcctcaacttgtcattgaccccaaccacaaaaccagatatatgacatccctcaacttatgaaatctgtggttttaatcccagttttatccgacgtgacatcagcgtgggactccatgtgggtcccacatgtcaggatgccacgtcagcactctttcttccccctcctctcccagtctcccttcctcctctctctctctctctctctctcattttctcctctcagggcaagccggccggcgggtgggaagaaggtcgccgggacgaggcgggagaggaggtccggcggtcggcgacgcggcggcggtggcgaagcagggtgggggagtcgcgcagcatggagagtgtggcagccaccgtctgtacatggccctcacggatgtcgagctggacgcggttcccgccgtccgtggtggacatggcaccaacgtcggcgtcctccggcgacggctgccgcggcgccattccctgccttcacctccccctgcc

SEQ ID NO: 9822 - DNA, 12554 bp, Oryza sativa
agtgacattttagtaccatatgcttctcaccttgtaagttttatgttattgttatttgagtaaatttcgcaaaactatatgttttatggtcaagttacagaaagtcacgcatattttgacacttggcatttaactacatatattttggcagtgtcgtttcataaaccacactatcaataaatggattcacctgtgagatgatgtgactgttccaccaaagatgagggtcaagattcaccaaatcgcttttagtcgagttaccgtcaccacatggtaagacggttatcccgtaaccgtgcggttaccatgacatacggttatcacgagaattaccgtggtttcaaacctaagaaggttgccacgtgttataacagtggttctgtaaaccctggtgagggcattatcaaggcaagcaactcatattgtgagtggcctcaagtgctatataagctggacacacatattccagtacgatgcatgttagctgtaggttagtatctttgattttgtatattagccccttaaatattttttatttaaacataagcccaaaaattcaaactttatacactcaaaaccagaaactattaaaatgtcaccgttctcccccttcctccttttggcaggctagagttcatcagccggccgttggagagttgagacctcaaccctatttgttgtctcctctctccttccttttatcgtcgggtgttgtattcgagcaagaggcgaacgatgagcattttgtctccatgcagttgaaacctcacctctaccatcgatccacatcttttggctcatgcaaaaggagctgcgcgacctcgtcttcctctcggaggtactgccaagaagaatcgcgagacctcgtcttccttgcctctcccctccattctccaacaacgagatcggagcaacacaatcgtaatctagttgctcctccccttttccccaacaccaccatttctttcttcaatccggtgctgatgcatatcaatctagcattgccggtcaacgttctcgagcaaaataatggttagagttgggggacaagcagatccaaccagatgtttcatcttcttcttgttgttggttcttgacgacagtagatgcatcgtcctcgtaccacttcctcatgtcggttattttcttccttctttctcctgcttcacgggcccgacctatgtggcttggtttttctttacgagactatccttgcatgtagaagctttgtgaagtcacttcaccagctaatgatgttactcatccgtaggtgtattgtaaatgaaagaactactctcacatgggtcgctgtcttgctgaaatatgggctaacaagctgtgggggttcatatgtcaaccaccggtaagttatatgatccgtttccattgtgaatgtcgtaaagtacaatcatgctaaatgtcaatcttttgaaaactgaatcccctagcactaaagactactaaaggaaggggcgtacataaatcaagtctaaaaatacagcaatctatagtttctatattgggaatgccatggctaacagtacaaatacggtacgaattggctgtccgctgcaaattggagtctcgtacataaaatctgtcaacagatttataattagtccctaaaataagtccaaaactctccgaaaaagtcatcggatcctaatccattatttagtacagtggaaccaaattgtcacatgccatttcaccatttttttctataaaaggagaactcgtacttttggtaacaaaaaaaaaatcaaggacaaatcattctctcccatctctagccgccgcgacgcgagcgagcaaagcaatggaggactccgccgccgccgctgccgtcgccgtcgtgacggtgccgttcccgacgcagggtcacctgaaccagctcctccacctgtccatgctgctcgcgtcgcgcggcctcgccgtgcactacgccgcgccggagccgcacctccgggaggcccgcgcgcgggtgcacggctgggacgccgcgggcgcgctccgcctcgccgccgtccgcttccgcgcactcgacatccccggcgggtacgcatcccctccccccgacccctcgtccccgttcccgggccacatgatgcccctcctcgaggccttctgcgacggcgcccgcacgccgctcgccgcgctcctccgcgagctctcggcgtgccaccgccgcgtcgtcgtgctgcacgaccggatggcggcgttcgcggcggtggaggccgcgcgaatccccaacggcgaggcactcggggtgcactgcctcgccgcgtcgtacaatgtcgggtgggtgtaccccgcccaccgcctgctggtggagcacggcctcgtcttccacccgcccgacgcctgtacgaccaaggagttcgtggcgctcgccaagcggatgggccaggagcgcaggcgcgcggccgtcgccggcatggtcgtcaacacctgccgcgcgctggagggggagttcctcgacgtgctcgcgcagatcccgtcctccgatggcgacaagctgttcgccgttgggcctctgagcccggtgctccccgacacgcgcgcgcggggctcgccggaggagagcgcgcgcccgcggcacgagtgcctgagctggctcgacaagcagccgccgtcgtcggtgctgtacatatcgttcggcacgacgtcgacgctccgtggcgagcagatcagggagctcgccgcggcggtgcgcggcagcggccagcggttcatctgggcgctgcgggacgccgaccgcgcggacatggacacgcgcgaggccgaggcggccgtgcacggcgcgcgcctcgcggaggcggcgggcgggctccgggaggagatcgcccggggcgtgggcgtggtggtcaccgggtgggcgccgcagctggagatcctggcgcacggcgcgacggcggcgttcatgagccactgcgggtggaactccgtcgtggagagcatgagccacgggaagcccgtgctggcgtggccgatgcacagcgaccagccgtgggatgccgagctcgtgtgcaagtacctcggcgccggcgtcctcgtgcggccgtgggaggagcgccacgacgtcacgccggcggccgcgatacgcgaggcgatcgagagggcgatggcgtcgggggacggcgcggcgctgcgcgcgagggcggcggcgatcggggaggccgtccgcgccgccgtggccgagggcgggtcgttgcgccaggacatggacgacctcgtcgcctacctgacgaggtgatcgtctcgtcgccggcgcggcggctgagctgcactccatgccgctgttcgcgccaaaagatcactgcttgcttagaaccactcttttgaatcttataattgggataatttcgtccaggatttaagctactactgtaataagtttgggactgtgctggttgtcctcgatcctgggcacctggctctctattggacaatttagtactgcgtatatctcattttcttttggctcccagcacacaataagcagattttgctggagacaatgataatttgctcctgtaataataagacaacaagtctataaacatatgcaattttaattcaacaattttagaatatagacttttccatttaaaaacacgtaagggcttgtttgaaagggtccatggatgatagacaaaactgagtttatgacaattattcgagagcacaaacaacttaattaaatattactagctgataaattgattttaaaaaattataagaaatgcaaatgaagattgttttaaaaaagttatacggtttagtagttcagaaagtgtgcccgcaataattccgtgactataattagaaaataatgggccttaagcatcaggaagtcactgaattgacagatttgcataaactcagtaattatatcacattgcttttagattcaaacagcaacactcacacggtcccccttgattccttgttcaatgttcattggaggactgatgtatacagtctattgccctttttacagtaggcagatatggttaaattttgcactaaaaatattagcatatggtcatgctctaacaattaacattgacatatatgcttttttttaaaaaaaaattgaagtataattgatgaatttcccccaatttcatcgcgttatcttctgaacccgccaaaccagcaacagcgcggcagaagaaaaaccccacccaaaaccgccgaacccaatcccgactcctccctccgccgccgccgccgccgccgcgatgccgaaggcggcggcctccctcgcgtccctcctcccgcagctatggcaccgccccgtccagccccctcccttcctccaccgcgccctctcctcctcctctcccctcctccgacgccaccgcgccgccctccactcgccggcggcgcccctctccgccgctgcggtgtccacctccgccgcaaccgtcgaagccccagcgaccgcagcgtaagctgccctcttaccctcagaccaagctgctcttctccgagcgatgaactgactggtggtggtatatatgggttcttgcaggtatccagtttatggcaggctcttgccttgccctctgcaagatgaccctccaaggatcgagcacctcgtcgcgcgggaagacgaggtcgccgtcgatttcatctccaggtcactcaccctccctccactgtaagcaagcacccctatgctctcttttgtttattgcatcgttcatgtgaaattagtagtggtataagagtaaatgagtaacattgtgggtgtgaaggtacgttgcagatctcatcaagtttggggctgtttactatgcgcttgtcgcgccgcagccgcctcctcacgcggctccggagcatgttaggatttttagagaggtgaccgagccttcggtcctgtgccgtaggaaatccattaaagggaagacggtgagggaggcgcagaagacatttagggtgacagaccccaaccagcgcctcgaggccggcacgtatctgcgggttcatgtgcatcccaaacgttttcctaggtaaagatttgaactttgtaatgtagaaaccttctatatattgtgatggtctatgtttgagctttgtttttaacttcccaccgtgaaatctttccggcggtcagtcagttatcaaatcatctcagatgcttatgtgtctgtgttttatctgatactgtcaggtgttatgaaattgactggaaatccagggtaatagcagtaactgataactatgtcgtacttgacaaaccagctgcaacatcagtatgtttctcttctctttcccttttctagttggcatctacaacaacctcatagatttggatttccaaggccacatatatgagaatattggatatgttttttgcaagtaattatctggtttattagtttcacttagtgtgtgttgcaagaatgttggatatgactttcagattgtcgtcgagtaggttacccatttggattttactgattattggttcacacatttaatgtgcaaatatgccactaatgtaagataaaacatgaacacaaataccaagagtgttacttaagagattataattggaagttcttggagttgatgatttaagaaacagcccaattgatgcatctaggcttatgattaaacttttttgaggctcacgtatttttttttcatgatttttttacatgtaggtgggaggagcaactgataacattgaggaatcctgtgtggtttttacttcacgcgcactaggattagaaacacctttaatgacaactcatcaaattgataactgttctgaaggctggtttgtctcttaccattttacttctacaaactaggtatacataagtgtacaatgtaattaagtaatgtcatgattgtttgcagtgtggtattatctaaaactaaggagttttgctcagttttccatggaatgataagggtaagctactttatcgattactatgatatataacatggtattgagcctctagtaatgttgttaaacttttaattttgtgacaggaaaaacaggtcaataaacgttaccttgcacttactacagcacctgtgtctacaggaataatcacacattacatgcgtcctattaatcgtgctcctagattagtttcagaaggtaatccttgaattgcagtttattattgcttctaaaagttttggcgacagttcattcgtggctaggtgctaaaacattgttggctcttagtgtgcaaggtcaaaaacattgttggctcttagtactttaacagctcctagattagtttctactatgcatatgttttggttacaatttacacacatattagagtttgggtgagattcttgtgtactgttatttaaatatatatgcagtcacacagcattgtaaattgtaaccgttcatcaaaggtattgaattaactgtttacgcattttatactcacctattttacgttgtgtcatttgtcatttggcttgcgccattacttactggattttaaacaatggtaaagataccttgatatgattagatttagaactaggatcctacatactacgtacacgtgggcctgactggtaccactaagaattctgaattagtccgtggtcggctcgttgtattctgacctcggatgttttaccatgcatgcatatatcataaatttcctgtctctgttagtagattaatattcttgtcacacttaacagatcatattaaaggatggcatgtttgtcaaatggagatattggactgtaagaaggtcccatggccaagctctctgatcagaaaagtccataaagtagacaactgtggttggccccaacacgaagctgcctatgaatgtaaaatcaatctcttgacaggaaaaactcatcaggtatcagtactattgtattttttgagatgtcaggcttaaatgctaattatctttttgtggagaaggctttttttggggggctcagagaaaagatccatgactaacaaactctcacttagaataggaaactctgatttaaagtttgctttattctagttcaatttgatcataaacatggaccatgtgggtcagtgggccgtagtttcctgggttaggtaggctagcacacacacatttctgatgcttcttttgatagtttatactccaaagtccaaactagtatttgaagctccaccattgatgtactgaaaaaaggaaaatgagggggcaacaacaccattacataagctaaacctgcaactatttccttgggttgaatcatagcccagcgctaattatgttgttgcattgaatgagttgtcaatatgtttttgtttcgttgagtggtatggtcattgccaacattgtgtttatatagagtaacgggtagatgatatggtatgcagatacgagcacaacttgctgctataggcactccaattgtaggggattctgcctacatgacggcagcaatggcagcaatagttaatccaagcataaatccatttggtcgatggggacagaactatgatagtgaagatgaaaaggcagctgctgttgaagcttggatttcttgtcatggcaaagaaccaaaatcagtaattggcctacaagcatctgagatctcatgggattatgaaggtgaacaccattcttataaggcaggagttccatggtggcggcaagatgcagttgaatctgacttgatctgaagaagaacaggagtatatgagaattttagccctgaacctcagcctggggtggctcattttgtgtgttctggcagaggtcggatctccaaggttatttggccgccaaagagaaacataaaaaaaaatgccaaatatgaaaaccacagaatgcgtggtgccaccgatgaaaagcttacacgccaaaaatcttcccacatccttccaaaatatcttgctacagattattctacatctcagatgaaacttactgacagagttgagttgtacacttctagctgttatatctggggtggagtagctcatttgcattgccacacatgcaacattttacttctagagtgtaattttgtcagagttttgcccaaggtgctgtacatcttcgaaatttacatcttttgtcagtaacttgttctggtattttgtactgtcccgagatttgctttcctgcttcacatggcactgtttataaattgaattgaatttgaggtttcaccttttgttctgagctgtggtacacgggccaggcccaagctgaatgtcgacccagacttgaaagctatcctggtgtttttgtgggcctgtgctgaacagcggatgggttcgcgaatgctggcggcttctgctgccactttgtgacgagttgcgattcgtgcagggggcaatgacgtgattgctataggccaacgacacgagttatgacgtatctgaccagacaaatctaggctcccctggggccagtattggttgaggtaaggtttgtactgaacagttaggcgaggagataaagtgaagatgaaaagacgccacaaatccatccctaaaagggagatgattactatacttccgtttgttttgtttgatccgaatatgatacagccatacaggcatggtggggaacagggacagagctagaacgaaatggagggtggtaccactaatttactctattttagatcgagtttaagctcatacgggtgcctaagtttgtattaagggggtatatatatggtgaaaatagatgaggtatagctaaaaaattttcttaaccagtttctgggcacccccttaatatatactagcttcgcccctggagagaaagaacaatgaattacattcaacgtagacatgtaaaccttaaatatcaataagcaattattcacaccaaagttatcacataatttcgataatcctttctacattttcatacacttttcgtcaaaatttaatgattactaatagtaactatatcgaccctatttgtttatgattataagttgcctcgaatttaaaattctaggttggagaatttcttttttatgtgaagtccaccgttaaatttgaagcggaggaagtgtctatttatggattaaatcaaatatacaatatataaacctataaataaaaaatcggcttaaaagcttaaaccaataaagttaagcacaaacaaaaagggccataggctcgcccacacaaaacaccagatgaatggacaacgaaaagcatgcagctacaatagcctaacccagtgaaaaacgaactaccacaagaaccataaagccaagccaaccctctccgggaagaaagccaaacccaaagcgtaaatagagcgtagatacagcactacacaccgacacacggaccccacccccatcccgggccccacttgtcatccactgacccccacccccgtggcgcctcctcacgcgaagaaaaaaaaaattaggggttgtccagagacgaggcgagcctcccgaataccgcaaggcccagcaatacccgcatacaaaaacgcgaccaaaaaggagaagaaaaaaacttatctctgcccccctaatctccccttacccttctctctctctctctctcatagataaccacccccctccccgccgccgccgccgccgccgcgggaggcatcgcgtcgccgtccaccgggtcccctctcccccgcctgtctccggcgatcgccgctttcctccgccacccccgatccgaattttcgaaaaaaaacccccgcggaaatacggagaaaaatcgcggaaattcgttttttagagtgaatcgcacctcctccccacccctgagcccgcctccaccccccgccctcgtgctcgtcggcgacggcgatcgcatcggggaatagtcatcgccccccttgacgggcaatccccccccgcgccttctcttcgcggtccaaacctgagggagacagaggtggggggagcgagcgagcggcgtcatccttcctcctcgccggcggccgcaagaggtgcgtctcctcgccgcctcgcgggtttgtttcttcgcgggaatttgtgggtgaggggcgtggttgctgggtctagggagttgggggaagcctccgccgcgccgatttggaccgccgcgcgcccgatccgcgccccgggaggctcgatctggccgccgcgcgcgctgatctgcgcggcgtcgcgcgaatcggtcgggatttagggtttcggaatcctattcgaattcctcgcgcccgaggctgcgcggcgccatggttgccctcctcctcccactcgtcgattttgaatagagttggggtagagttatttcttcccttgggagagttcaatccatgtagcaccgaaatgatcaagccataacaaaaagcatgacaaaacaataggattagactttgatcgccccatttgaggcgctaaatgttgtcctaagagctactcgagtgggcttctaaactagcttcgtttgatgaactgcagggagtgatagactgctgaggccgtgagagtttttcatgtgtcgtcatggcattcttcagcaactctggaagcagggctgattcaggagggtacaacctgaatgagaaggctgaggatgaagctgcctatgagtcagttggggacagggatgtcgacttgaactctaggcaatggaacttaaatgagaaggctgaggatgcctatcatagtgatgaggagcaatatgatggtggccggtcaggtccgaactcctcggagaataaatctgtgcagaatgcccggaaaataaatgggccttctggcccatggggtacaaactttttgaaggattgtggacccacacagacggctaaggaagagcaattgaccagtaacaggggaatggaatatgggtcggcggctagttcacatgacgacatggatgctagtggagaggatgatgagctgaaccgagggcatggggaggtgcctgctgaggaaatgctctctgatgactactatgagcaggatggagaggagcagagtgattcattgcttcgtggtgggatgcgccgcccaagctgttctacttctggggctgcagcagaatctgtctcctctagacaaaagaagaagccgacaaaatacaatgcttatgaggatgaagatgatgacgagtacaatgatgagaatgatgatgaagacgatgatgacgcagacggtatacttatatctggaaacttgagttagcaaagcagatcagttactgttttaacccgctgctttcttggcagctgcaaagaatacagctcatcattgatcaacaactttctttcttccctattttgcagaagatgatccagacgatgtggattttgagccagaaagtgatactgaaaaggctgccgataaggttatttattgactcaagttcatgccaccccatgccataatattgtcctatgtattaagttacatcgtcatcttattatttaagctaggtggtttagtagtaattctagttataaaagattctggttggtatcttctttcttgaaataaagatagaaaactgccttagtcattgaaaagaatccactctaattgaactctatgttgcttaatactgaatgtttcttaaaagaataacacgctaaatatcactaactgccccttgaagcatctgaaaagcaatcaatgagaaatctgtagataggatgagacacacagaaacaagcaaggagtgaggctcgaagcttggaagattgatgaacctgtgttctttggtgtcttgaagaaggtcatttaatgcattaaatagttcccctgtgaactacctctgtcaactactgtaatgcagctataaactcttaatccgtgagctgtaggattttgtttattttcttaattgaacgatttgatcgcatttgcatgtatactgcattttattgggtgatattatggagaactgcacaccattagcacctgcattgcttattttataaattacgccagacatctaataacaagtgatatgcattcttttgctccttttctaatctataagtttcaatcagtttattatcataacttttattgagttattttcttctgaaatgctgatgatattgagttattttgttattgaattttaggtatttcagcactcttgatcatcaaatattaattaagttcactttcttttgtaacattaaaattttaggataagtttgtggatagtgagaactccgacgaagaagaagatgatgagcttgagctctcagatgatgatgaagatgattttgttgagaataagaggcaatgtaagcgacttaaggttggtggaactaaaacctccaagggaagaaagcttcctgtacaggttcaacgcaaacgaggggtgtcttttacagatgaagattcttcaggaaaagactctgatgctcccagtgatactgatatcagtcaccgagcaaaaaaacccgacaagttgcatcagaaaactgtaggccgcaaggatgttttctcaaatgttgattctcatgaggttcgaacttctggaaggaggaggacagctagaaatatttcatatgctgaaagtgaagaaagtgatgatagtgaggaaaagttagctaagcaacaaaagg

SEQ ID NO: 9823 - DNA, 2221 bp, Oryza sativa
ctggaaattgaggctatacgttctgaagttgtttcaaggatgtctgagttggatgggaatgatgagctttgtaaaagcactcgtacaagaagaaaaaggagggcttctgctgtcaagaacctactgaattcttctcgggctcctgaagattccagtgacactgaagatggtaacagcgatgagtgttatctttgtggcatggatggtaatttgttatgttgtgatggctgtcctgctgcatttcactctaaatgtgtgggggtagtggaagatttattgcctgaaggtaattggttttgcccggagtgtttgatacagaagaatgatggattcaaaaatatggtaaagcctggaagaggagctgaggttctgggaatggatccacatgaccgactatactttggcacctgtggctatattttggtgtaagtcaatatattttgtggtatgcgcaaatttgggtcttttggctatgtagtgaatgggaataatcctctgccatattgtctattggttattagtagcttgcgtgattccaaacctcagtataatgcaaaaattaaattcacaattttactgttctgatcattgagttgccttaggatttaagaaaaatgatgtagcactttctcctgtctatgtactgcaccaaggacgtggtgccacctgtccatagaacaacacgtaagcttcagtcaagatttgtatgtgtgtactagctacgtgtgtcatacgagtctagatatacgcaatggacctatatacctagaaatgcatttaatttcatcatgcaatgcagctcgtgaaatatttcttattttctaagctagaggttttggaagagtaaatttaccaacttagcttatcctgttaaaactaaaacctatatatactttctcattttataacattctactgtgttttgtttggttataacaaccggaagatgatgttataagtgactagtcgaaatatttttcaaactgtattgctttttaatgactatctgccaattgttacacttattaaatatcccaatgcagtatttatgccattttttcatttatgcattcaggtgcatgcttgttcatgagtatttcctcacggcaaaatctagttcttattccttgcaattcatatgttatatttatatacatatttatatttatatatattgcagtgcagtacgagatgtttaccttgggaaattgaacctctctgtatgtactatagtataattgttacgttttgctacatcaaaagcataacatcattttgaatttgcagggttgagtcaactgctgaggattctctggactcgacatgtcattactatggcatttttgatcaccattcgcttttcaatgtgctaagaacatgccatccctcgtacagttcaatcactaacatgatatctttgttttggggcactgcaattgattcttttgattccaatggtcgatgtgaaaataacaaggaattcagtatctttgatgccaagatagactgtagtcatttattgccatcgaagcaacacacagaacatgagcagcttaagtcagataagaatggctcctgtgaacaattggcctgtgggaaagctcatgcctcggatccagatcggctggatcatgacacctctcaccacaagttctccttgagatctgcggttatttctgaaaatggaaatgcaactagtgccaagactcagcaagatgtttgttcttatgctaatggattgcctgctgagaataagatagaccaatcacctcacaaaaagataagtgattgttatatccattcgaaccctgctatgtacgtaaactactacagttttggtcaaatagcagcatcagctgctgaagagttgaaggacaagctatcggaaaacaaagaaggaaagaaagttggtcaggatgcagcttcattccagctaaaaacaatatgtaagaaatatgccaatatttttgctctgacagatcaaaagttgtctgtagagctgcgaaaggaaaaatgtggttggtgtaattcctgccaaatcagtggcggtgttgattgcattttcagagtcaccgatggcaaatgcatggagggtcttcagtcagaaaagaatatgaacagccatattattcttgccatacatatcatcttgtccattgaagaacggctaaatggtctactgattggtccatggaaaaatccccaatttagcagttattgg

SEQ ID NO: 9824 - DNA, 8555 bp, Oryza sativa
  unsure (1)..(8555): unsure at all n locations
cgtgggatggtgtaacttgcatctataggtgaaatatctgtcaggagatagcatttctctaggcgtctagtgtttctagtttgtacaggtgctcagattttgtagttaaaggtggcattgtggtgcgattcattttttctccgtgcaagtggcaactcatcaggtaatttttcgatgagctgcagtggtgtcttttgatcatgaagatacaaaggagaacgtcattagctaacgccatatttgtacatagttttcaccagcaatcttaactcatcttgagcttcgcatttcagccgtatggttgtacatcataaaccatgtaaaagattaagctgaacttgtcttcgacaatttttttcagttgatcaaacatgatagtttatggggaatgaaatttgctcaaaagttctaatgaatgtgtggcatagctcatcactgatgtgtgtatgtaggccaagacgtgtgcattcttttgttctttcaagtccctagtcatccttgtacagtttattttagggggaaggggggatgttggtggtgagggttgagatgaggaagtcggtgaagttatattttgagattaattttgagtatttacaggtggaactttaaagtaagtatggttcctgcgctgcataaagctcagttggcttcctacactgtttgggggcaacaaaagtgatgatttggcaaaatggctcacggacactttggctgtgtccagttccttttaaattttcaacttttccgtcacatcaaatgtttaaacatatgtatagaacattaaatgtgaatgaaaaaaaaaatcaattgcacattttgcatgtaaattgcgagatgaatcttttgagcctaattacgttatgatttgacaatgtggtgctacagtaaacatttgctaatgacagattaattaggtttaatatattcgtctcgcagtttacatgcggaatctataatttgttttgttattagtctatatttaatacttcaaatatatgtccgtatggatcaaattctttttaccaaaacaacttacggcctttgtaactgcagtccgatggaataagaaacaaccgctcgtttttgttgcgtgataaggttgtaacttgtaagggctgcagccgctgactattctcgcagcgcataattgcgtatcagagctccagatgacttagcacaagagcacaatgcatttctcgctatccccaactttgaatcaacgatttttttacttctcccatctcacaatatagcaacctaatatttaggataaaacatattgtactgtttaaatttatgtttaaatttatattattaggatacgtcccatcgctatatcgtgggatgggagtacattttgatcatgcacatgtcaaagtgtcaaaaactacaccatacaatctgccacttctgtatgccgtgaagctaagcctgaaaaatcagacacaaaaagggaaaaaaaaaagagaaaaccttttggcatagctacagttgatgaattgagccccaaaaaaatcttgctcatggatcgagaagcctatcattgatccccgatcctcctccggcattggacccagacgatccacactcactgacgcctgggccatcggtgctcgacgtgccttcgacggacaccggagcgaccaagtccggcggcgggaagtacgacggcaccggcatcttgggcggcagcgacggcagcggcgcctcgaacttgagcacgttcagcgcctgcctgatgctcggccggtgcgcgtggtcggggtgcgcgcaccacaatcctaccaccatgagccgctccatctgctcgaggtcgaacttgccattgagcctctggtccgcggcttcgaggatggctctcttgccgtagagctcccacacccacggcaccagcctcgccttgctcgggtcctcctcgtcgagctccgcggggcggcggccgcacgcgatctccagcgccacgacgccgaagctgtacacgtccgactcccggctggccctgcccgtgatgacgcactccggcgccaggtagcccagcgtgccggccagcacggtggtgtgcggtggctgccgtgctcgacgagcttggcgaggccgaagtcgccgagcttggcgctgaaggtggcgtcgagcatgacgttgctcggcttgatgtcgcggtgcaccacgcactgcgggcactcctcgtggaggtagagcagcgccgacgcgaggcccagcgcgacgttgtaccgcgtcggccaggagaggggcggcgccgcgccgccggccttcttgctgccgccgccgccgccgtagaggtggcggtcgacgctgccgttgggcatgagctcgtacaccagcaggaagtcgccgcggtgctcgtggcaccagccgacgaggcggacgaggtggcggtggcgcagctggctgatgatgcgcacctccgccgcgtactccttgcgcccctgcgtcgagcccttggacaccctcttgatcgccaccgccaaaccgagctccttcaagaagcccctgtacacggcgccgaagccgccctgcccgagcttcctctcgtcggagaaattcttggtcgccgccgcaaggtcgctgtaccggaaccgcctcggcccgctctccacgaagaactcctcgtcggcgagctcgtcgtaccccatctcctcgtcgatgtcgccatcggcgagctctccggctttcctccattgcgacacgaaccagagcacgccagcggcgacgagcacgagaagcaaaccgcagagccccaacacaacccacaggattaccgtctcctccttggtgtcgatgctggaggtgaactcccagtacagcacctggtgcagctcggcggcctcgcccgtggcggcggagaagccgacggcgacggcgtcggggaggtactccatcagatcgacggcgtaccagagcacggggtccgtcagggccgccgccgccgccgcgtcgccgtaggagagcgcgacggtgaggttcttggcctggccgtcgtacgcgacgcgcgcgtgcgccctccggccgtccttcatgctggtgggccagtcgacggtggcggcggagacaatcccgccgaggtcaacgccgacgtggtcgtcgctggggtcccactcgttcttgtaggtgtcgaattcgacggcgacgagcgggcgcgggtgcgccgccgctgcgcccccgcgtgagaaggagttgaagaggccgaggaggccgccggcggagctgttggggaggacggaggggaagggggagaggaagaaggcgaggccatcgccggaggcggcggaggggtcgggggcggcgatggagaaggagaaggcggtggagaaggaggcgcggcggcgggagacggggtcgcagagcgggacggggcgcgagaagaaggccctcccggcgctgctggtgatggggccgatgcgctcgtcgcgggtaaggcggatgaacttgttgaagaaggcgtcgccctggaacgcgatgcccgacggcgccgtgtccgccgaggtgaagttgtaggtgaaggagaaggccgcggcgggggacggcagcagcagcagcagggcgacgaggagaaggaagggggcggcggcggcggcggcggagatccccatggcggagaagctcgggttctcctgccccaggccaggcgagccttggaaaagagatacaaaagcttactacatttgggttgaccaccaacgagaaggctcgagctggccagctggtatctgcttggttgtgtcgtactgtaccgttcttctatacgtgactacgtgctgtgcatactgcccgcatttgcagctgccaagttactgtcatgtatgtgtgcgtgccttgtgttggaatgttggatgagggcaggatgcgagcagagaatcgatttcgagagcgttgtctcccaactccgcagggatgggaacactggacgcgcggggcgccgcggtggcagtagcgagagagtgggagacggcgacatgaatcatgatgcatccagcgttcacaattccaacaaaaactggtcgaattctgtgaaatttcgacgttttggcatgactcaaaattaagttctgattagaatttcgaaggttaaacagtagatttggtcgaaatttatcgaaaaccgtgatacgatatagctcgaaatttagtggtcaaccggtaatgtaaaccctggatgcatctctacgaggcgacgagccgacgacggccaaacaactaccatttggagtcttccctgaggaatacaaagaagcctactccctctgtcctggaaagccagcctttttaagattggttggacaaattaacagaaagtaaaatttactatattggccatatttaatagttgcatttgtcacattagattgtaaaaaaaaaatacaacaagtaattaagtaatcactactagtagtattgaagatctatttaatactcccaccatcccaaaataagtacagttctacacatctcatatctaacgtttaccttccgaaccattgtcacctcccctcttttatcggatgggttgaggagattcacatcaaaacaaagcttcagccacgctaggtctggtggtggattctatctgcgctccatcttcccaactgcttcccggttgcggatgaccatttcccagcctggtggctccacactagaagcctaatccctgcagcaagaagatgcttcgacacaattgttatcctagtagcctaggtgatctagaaggaacaaaacaaccgggtcatcaacaatcaaccctttccttagttgatcgtcttcgataagattgcaaaagaagctgctcttcggtgcacggtcaggagagccaacgcctagaccaacgtatagcaatggtagtcttttttcatgagatttcccctagtatttttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaagccggacgctcaaagcaatccgttagcgttcaggcacagcattctcctggacgagggtaatacaagaccagaagtggccgccgcaaagaagtctccggacgaaggatatccttgtcctgacccgccgcgcactccaattctaaccggctgcctggagtgcaccgaaaggaagctataaaaccaaatcaaaccccatccacccgcggaagcatgcgcgccaacgcactccccacgcgatcccacagccctccgcttcctctcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgccggagcatgtgccatcctgggctgccgcctctgccgccggggtgcgaggtcaagcggcggagggcgccgccggtggcgcgagtgggttccccgccgcccgtgccgcggcgggagcagcctcatcaggctcagccgcaccactactgcgtgtgctcgcccacggcgcaccgcgggtcgttccgctgtcgctggcaccgccgcggctactacgagtggggcgcctcccgccgcaggtagggcaaagcccgttcggtgggtgacgcgtgcgcgcatggtggaaactgctcgacgcatcgccggccagctgcgtacaactcatggcgtcttcttgcgcatcatgttcggttgctcatgtgtttgtacacagacacacagtgtacagttgttcgaactcggaaggaaacacaaaacaattaaataagcgtacattactctatagtttctttcatccggaagtgcgtcattagtggattataattcataccagaagaatagcaaatcgtgtataagactacaagagcgtctgagagtgtaacgaattctagctgactagctgtcagtccattgtgatccggcctggccctcccttcagtgagcggtacagaggcctggatcgcttgaagccgaatatgtcagtgattcggtaagttttgggtgcatcagcttcggcaatagccttcttgaattctgccaaatgtttgccgccgaagacttgtacgcttaatgtcttccgttgaggtgcaccaattcttatgtactgatcaaaaaattcgatgaattcttctttcttgagctctcttaggagagatacctgcaaaagaggtatatcgcacaactcttttcttttctttgagaagttatcctgtgcttaataacctgttttcattatattcgataccatcaaacaattaactatttgctgaaaacagagcacttacctcagaccttcctctatcaaactggagagttcctgcctcaatctctgcccaatagaagtcggattcctcccacaaatttttggacttctccagtttcgaatcaataagtgattttacatacctctgcaaaaagaatgtcatattaagtgattttacattgatgtgcaaagaacaaatttagataaattcaactataatgcatcatatatccctgttcttttatcgattacaacccctccaaattttgtatacaattatgcatgtggaagtttaccccaaaatgaagaagaattgaaagaacatgatgtgagcacttcaggaagagaaaagaaaggaagtgtcatgtaaatttgaaaacacgaaagcttgattcaatggaagctaagaaccttaaaatccttgtctgacaattcatggattttgttttcaaacatcttgaagaattcatcaactctagcatcaagatatgaaggatcctaggcgttcaacataagatcagttagagagaaataaacaactatcatgccaatcattctagccttgaacatgtacctttactgtggactgaataacaatctcgagtgccctgactcccctatcagatctggtaaacaaggatattcattgtaagctaggatttaaatggtcaatatctcctcaaaaggcaaagtaagaagcagcaagtctaagacaaaacatctgctacgtaccttacataaagatctgctatatagccaagctgctcaatagttcgtagctggttggcggcaggctgcctcgcaattaaagcgaacagttgaagtttgatatttgaaagagcatcatccagatgaacctgaatataaatatcaaactatgattggcatcctcacatgcttctttctacatatcatcatgttttctacttttcaaacttcaaattcgtgagacatcacactagtaaaataatagccctcatttcaagttaaaattttccgctcaaaaagatattgaaaattaggccccaaaaatgagctataaactttatacatcttaaacttgatcaaaattctcgcattgtcactcttttttcacgtcaaatgttgttgagtagctagaacatcagttggtggctcaagtatgtccccagttctccaaaaaagtcaatagaacataatcgaacatgtcactgaaggaaactatgcgttatgtcccttgtgctggttcagtcacaagcaaccatttcaataagctatagttactgacgaattccttttcattcttggctacattgttcaggaatttcacattaagaaattattttgatcatgtaattgtacttcaaattttgttgtggttgaatgagtatttcatattactttgcatgccagtacgatatgtaataataattttagcaaatagaagtaggtaaagcctcaagtccactgaattttaggaacaagatcaacaatttgtaatcagtttggtgaacattagttcagaagttagcgatcatggatcagtaatgtcttttgttaatagtagttgcatcccttgcacgaaagatgaggcctcagggacatttacctgaatatgttggactactgatgaattctcattcttctgatttaagccctcaatttggtggtagcactttaactcattttcaagggtgataacccttctaatcagatattgtgatggagacattgatttgaacacagacttaggggtattgaatatagtatcttcaatctcctggacaatagatgtagcatcatttggttcaatgttccctagaaggagaaaagttaatcgataagtacgactggaaattcatcctgttacagtccttagcaaatataaatacatgatgaatcgactaacaataacttccacctaaccttgaatatagcattccaaaaatgtcttcgatagcaaatgtggtatgaactttgcaagagaatctggttcaagcttagaaagagcttcaagtttctcaacccaaggccaattttgatcctccaatatcaaggagagatagtttgnnnnnnnnnnnnnnnnnnnnnnnnnnnnnnnnnnnnnnnnnnnnnnnnnnnnnnnn

SEQ ID NO: 9825 - DNA, 1104 bp, Oryza sativa
tcctgcaccccataacagaatggaagatattggcagagattatttcaatgagatggtgtctggatctttctttcaaccagtttctaaaacatatgtgggtacacggtatattatgcacgatctcctccatgatttggcagaggcactatctaaagaagattgcttcaggttagacgatgataaggtgaaagaaatgccatccactgttcggcatctgtctgtctgtgttcagagtatgacactgcataagcaaagtatctgcaagctacatcatttgcgcactgttatctgtattgacccactcacggatgatggaaccgatattttcaatgaggtagtgcggaaactgaagaagttgcgtgtactatatttgtcattttacaacactaccaatttgcctgaatccattgcagagctcaatcaccttcggtatttgaatatcatcaaaacgtttatttctgaactaccaagatcattgtgtactctgtaccacttacagctacttcagttaaacaataaagttaagagcttgccccacagactctgcaatttaagcaagttacggcaccttgaagcatacgacaatagaatagatatattgatcaaagcagatttgcctcaaattcctgacattggcaagctaagttcgctccaacatatgaatgacttttacgtgcaaaagcagaagggatacgagttacgacaaatgagggacatgaatgagcttggtggcaatttgagagtcagaaatcttgagaatgtctatgggaaaaatgaagccttagaggcgaagctgcatcagaaaactcgacttaaaggcctgcatctttcctggaaacatatgggtgacatggatatagaaggtgtttcacatttcgagattctagaaggcctgatgccgccacctcaattggagcgccttacaatcgaaggttacaaatccgccatgtatccaagctggttacttgatggctcctattttgaaaatctagaatcttttaggcttgttaattgcagtgagctcggaagcctaccttccaatacggagctctttgggcgctgcatggcactaaccctttgggatgtcccaaatgtgaagacatt

SEQ ID NO: 9826 - DNA, 18587 bp, Oryza sativa
gatgatttgaaagaagaatcaggtcttcgaggagttgcaccactcttatctctcttggttttatccatacttgctggagtcaaatttgagccacgaattccactttcagctactaccagaaagagagagagagagagagagagagagagcatcagtgtgaagtatcgaagtaaaggtacttcaatacattatacataatgagagacaaatgggtgtttgaagcagtaccagtccctgtttccttgaccttgtacagattttttggatgtgtcgttgctagagcaggaatggacttggcagtggtatcaatcgttttcgaaggattgtcgtctaaagaatgtaccagctcagcaaagaaatttgctttgggcaaaacaccaagagcatagggcccaatgagctggatgaaagatattgattagaccatagaagaaatacatcctatgagacaaaaagtaaaactcaccgatatatcagcaacccaaacaccaactcggcattcgtggtaggagcatcccaagagttttccttcataaatactaaggtcagccaaattgctccatcccatgtcaacaacgtcatgacatcttactggctcccaagagaatacctaacaaagtgctcatatagttgaacagggaccaaaatattgtacatcaacaacccacataacaaaatcagatttacctttaggctttggtctaacccacagaatagggtttttccatctgggtgaaagaccgtagagcgaacaccagtagcctggaagagaagaatgtaaagaatatcataacagaaagatgcatttacccgtcatgcatgtttgaatacaggaacaacagggaacagggtaagaaagtttaaactagatgtaaaagcatccattaaaaatctctaaaagaaccaacccattgaaaaatgtgacaagggaggtcataaaccattttaaggattggaaacaaaatttatccctagcacatctttcgtgaagttacagtggtgctaaatagaaaggagacaatggatgtaaaacatgggcaccaacgaaatcaaatgcatgcgtacaaaataatgattgttataatttgtctctatggtttaccaaaatattgtgttaaacatacgcaacaattagcctggtattacaaaaatgtgtaaagcaagtacctcgggtccagcagaaccaatcaattcaaaagtttcaagatcccaaaacttaactgttcgatcagctgagcctggaaaatattaatgaattcaatgagtatacccttaaacttcttaaaacttcacttactgcacatagaaaagcaataacacattatatttatttagatcatatatcctgtgtattctcaaaaaattcatagtatcatactaaaccagaaacaatttggtataacaaacttcagcattagctttatcaatgattatactgcaaagaaaataaagatgctgtctccaaaagtctctgttttacaaataactgccaaacgagtaggtacctgttgcaagcaaaaattcttgcggatgaaaatcaatacaccggatttgcccactatggaacttgaagtcatgtagaagctttccagctgtcaagtcccacacttttacaatattatcttctccgccggtgacaacccatcgtccatcaggtgtaaatctgattgttctaattgctcctctgtgacccttatatgtgtgaatgcatccttttttctttatatcccagatcttaagatctgtatctgaagaaccagatgcaaaaaactcgccaaatggatggaattcaacagaggtgcaacttgatctgtgcccagtaagagaccgcacaactgcatatcaagacaaaacattaataacatatctagcttactaaattactaagaagcacagttgttatgatctatgggaacactattaagttatgctttcaatggttatccacattagccaagcacacttcttttatccaaatacagaagcgtagagcatagacattttgacgaagatttgtgagtttcctaaaatcgcagccactgaaaatcagaaaaagaacctaatacagcggataccaagcatttgtatcaaaatataaaataagtttgtactaacaactaacaagtacattgatagtaccactatcacggaatgtaatggctatgttttctataattgtttagaaatgaacagacagttacaacaaagcaaaaggcaagtcattaaggtagcacaatttctaggacttataaagcaataagccaccaaccacacccatggttcaaggcgctaggcactagagggttagcagggctgacgcctagctagcaggtgcctaggacaaactaactagtaaaacccaagaaattagcaaacatatctctactattataaaaattgaagatgttttttaccggtattttggtacgtcatatgtatttgagtcggtttttaagttcgttcgcttttggaaatacatatccgtgtatgagtcggattttaagtttgtttgcttttggaaatacaaaagaagtcgtataagaaatttcttttaaaaaaacttgcatgctaactttcgatggaagtcagactcctaattgcagctcacgatttactaaaaataagccgtataacaataataaaattaaaatagcattcactcgttgcaacacacaggcattttttctagttacataaaagttggataatataacactaaaatagccacctaatgcaccacctagtgcctaattgcagttgctacacggtgcctagcgctgattttagaacactgaccacacctttagcctcttccaagtcccagagcttgatggaaccatttgaagaaccagcaagcacaagcacctctgctgtatcaaactcaacagcctcaactgagccagtgtggcctgataagctctgcacaaacaataagccagaaacacggcatgagtcaaattcaacataaccaatagaagtgtccatcactgtgataggggcacaaaccagaagtggtgtctgtttgccaatggcccacaggttaaccttgcggtcgctgccgccagtgataaacacacggcttgacttcttgccgatagacaaggacctcacttcagcatcatgtgcgacaaattcctctaatttgggtttccatgttaaggagttataaacttgagcaatgcatgcttccaaaaagtagccagtaacagcttccacagctatgatttgtagtcaactaaaaaaggtgaataactgatcaaaccgtatcaatacatagctgtttttttcccggatgaacttcacaatttagttatagttgcttcggaagcaaattagacttggtgattcggaattggcgcattgctaacctaaactgggcactaaaggaaactatttgctgaacctgttgaaacatttagtggtagttcagttccttcttgaaatcagaaacgacttcaaccttggcgcagattgccaagaaagaaaaaggtggcgaaaattttctcgagaccaccactgtcgctccaagaaactacccacaacaacacaagactagaatttgagggaggggaaataatactccccctcaaccgctcgagcaaatgcctacccagattgctccggcaaaccacgattccttcctcctccgagccaaatcggatcaagaaccgggcaaacagaagggcaacccaacgacgcagtagcagcaaaaaaaaaaaaaaaaggatacggagcctgtagccgcgcttctcggggtccatcctcccgtctctccgcccctgctccgagccgctggggcaggccgacgcgctggcagcggagtcgtcgtgtcgccgtcgacgacgagaggggggagagggttcgggatccgagtacttggtattctgagcaggagaagggaagggagcgggggcgagagagatgacagccgcgtcgccttcctttttcctcttcctctctctctctctctctctctctctcgcagcaagcagtgaaaacgagaggtgtggagcggcgtgggtaggtgggtggggggagtgctgtgccggagtgagagagtggagtttttgtcgcctccctttctcccccttcgcctccctttgcttcgcttttgttctcgtttcttttcttttgtaccagagctggctaaagtaaggttctcttctctcgcgttccttgagaatgaaataaaggaaagtccccacatgaatctggacctttctctttttttctacattttgatactactagtagttcgtagtagaatggaatttttggtacacaggccattttgcaatatatataggttttgcaatgaatactcgctatggctttgagaagaaagttagcagcctcaccagcactccaacagttgtaaggtggtgtttgaatacagaaacttaactttagcctatgtatttagacactaatttaaagtattaaatataaactacttacaaaactaattatataaataaaagctaaattgcgagataaattttttaagcctaattaatccataattagaaaatatttactgtagcatcacataggataatcatggattaattaggttcaatagattcgtctcgcgaattagtccaagattatggatgggttttattaatagtctacacttaatatttataattagtatccaaacatctgatgtgatagggacttaaaagttttagtcccatctaaacagctataagatgattggcaagagtcaggaggtatgtggtagatgtaaaccattagtatcacattgagtatatgggatatgacaaatagagaatatgttgaaaagaagcttacccaatacccatctttacaagagatttagggcgtttttttttgggggggggaggggtggagagttgggagtacgattcactaccaaataaatatgcatggcacgaagtggtgaagataaaaccatacttcaatagttggaggacacaaccgttaacctagagagtcggctagcaatcatcaaagtagtccttcctacatcggtttcttcctctctttttctctcgggggaaattgatatgtgttaggctactttgaaaagaaaaacttctcatacatatcataatctcgcatataccctcgaacaaccttacgtatagtttatacaaaagcccaccatactattatagcaggatctaatggttgcttctcatatttatatttatagtcccaaaaaagacaaaaacatgttagaagagaaaagaaaaatatatctttcatgcatgagtaaatacaagatgatgtgttttgtaaacaatctagacatatgctcagaccatcttaaaatacttgcatgagtacactcaaagcatacacctagtagaaataaaaataatgatgagtagtaattttacagtagggtaacttggacttcattcgttcctgggagatccgggagattgagagagaaaaacatctcgttttccgcgcgcgcgcttccgttttttgcaaaaaaaatttctataggaaagttggtttaaaaaaaccatattaatctatttttgaaatttaaaatagttaatacgcaattaatcatgagctaatgactcacctcgttttgcgtatattcccaatctcctcaatcactttctcctcaaactcaccttggtataaggtgtgtttgcaagagcaagttcccaatactctcctctcgttttccgcgtgcatgcttttcaaactgctaaatggtgtgttttttgaaaaaagtttctatacaaaagttgttttaaaaaatcatattgatctatttttgaaaaaaaaagctagtacttaattaatcacgtgttaattgaccgcttttttcgtggataggagatgggttcccaaacacccacctccaaacacagccataagcacggaccaaaataagcgaaagcacatatatgatggtgtgaatgggcacttgcatccctccttgataacggaaacatcaaaacggttggtattcggtactcccaacccaccacccttaatctccataaatacggtgttactcgagagttggcatgagctggcccatagatgccaccgcaaccggtatgaacagtggcagtgtgcaaacaccataaaacctcagcttggcctaccggccgccgcccgccccatggacagggcctacgacaagcacaaattgattactctatccgacttgtttggtaggtcgaggagtcaatgtgccgtccggtgggaggtcgctcgcgttcgcgggcatcatcaggcagcgaaaaaaacgactttcccgatcccaaatcctcctttccccttccgtcttcaggcgagcccacacgagcatcacgccgcggtgcgctgcaagcctgcaacggaataatgcaaagcgaagggaagcggacgcgcgccgcgtacgggccgcggggcgtggcacggcacgatttctcgaaagaggcgtgcgaggcagcgaggcgcgacgttgcgggcgaagtttacagcaggctgcagcgacacgagccggcccggcgccgcggtgcattggcacgcgggcacatgacgtgccggtatcttgtgcgggggaggtgggccgcgcgcgcgggggggtggggtgtgtgtgggggtggtggtggtgtcccgagcaccccgagcgtgggggcgtgggggaagaggtgcttccagccttccaccgcggcatgtggcgcggacgccgctggctccaaggccgacagatggccgtggcgcacacgtggggaatcagcatagatgacagtgattgtgcttggggggacgttcttagttggagcttaatgacagctttcgtcttaaaaatctctctgggttgatgacttgatggctctgttttctgtcagatcaatggatcatcaactggatccaaatgccaaactccagtctcagaaagacaaggggaacatgtccaatctcgatttctcgaaagaacacgtgttcagatagttgaaacatatgctcgtgttccttcaatcccgcggtctagtacaattcatgggcctaattgggccttaaagttgatggaccggactttgtgttaaagtttgtggaccagcccgaagaacgccgagcaacacagaaaggaataagttcactttaactcccttaactagaggccgaatctaactcatattcctaaaccacaataccggatatctcgaccccaactattaaaactggtacaatttaactttctgattggttttgaagagcggtttcgctggcgtgacgcctacggtggcggtattgacccaatcttactttcacgtgaggttgacatggcgcttacgtggcattatagttttaaaaatatgtgtgcgacccaattgcattaacacaaaaaaaaaggtgggccccactaacatgtgggcccacatgttagcctctctctgttcccttcccttattcctcctcctccctctctctctctttctatcagcgcactcttccccctcggccattgaagggcggcgtcaggtgagaggacaggcgatggcgccctgtgtcaacaagcagtggcgcgtcgtcgtgcaggcggagccacgcccctaccacttggatgtcgctgccatcgctccggccgtcgcggagtttcggtgcaccagcttctaccgcctcagagcatgtggtagcaacttggcttcggcgttgatgatgcccacaccttcaccgccaattcgcccaaccccaccacccgcgccctcctccacctcactatgcctccccctctgactccacctcctccgccaccgctcatctcatccatcccccgccgctgatccccaccgttgtccccactaccagatgccaccgccgccgctcatctcatccgtcccccaccgctgatccccaccgttgtgcccaccgcccgatgctgctgccgccgctccgactgtcgtggagttccggcacaccggcttctcctgcctcggagcatgcggcagtggcttggcgtcgacgtcgacgacgcccgcacctccacggcccactcccatcttcccgtcgcccatccccaccacccgcgccctcctccacctcactctgcctccccttccgacttcgcctcctcttccgccactcatctcattcatcccccaccgctaccgtcaagtgcgacgacggcgtgtcactctctaccgagaaagagaaagagaggaaggaagaagaaatagatggaggctgacatgtggggcccacatgtcagcgggctccataattttttttgtgtgaatgacaaatgagtcctacatacatgtttttaactctaatgccgcctaagcgccacatcaacgttatagaccaggtcaacactgccatgtggacgccacgtcaacgaaaccaccatccaaaaccaccgagggagtcaaattacaccggttttatgggccgcgatatccggtattgcagttcaaggatacaaatcagattcggacgccagttaagggagtcaaagtgaacttattccacacaaaaaaaaatcagctcagactgctagaccttgggcgaatgggccaataaggcaataacacactttccaggcaacacagacatcgcaaagagtccccagttcccgcacaacacaggagctgcctgctaaatactacctctgtcatatccaacgtttgaccatccgtcttatttgaaaaatttatgaaaaaattaaaaaaagttagtcacttataaaatattattcatgttttatcatctaataataataaatgtactaatcattaaaaaattttgcggaaaattggtagtgtcaggattagagccggactcccaatcttctggaaatcgatttgcgacaaatgtatttttttcagaagttaccagtaagattctacgaaaaaaaaacgcgtctttacccttaaaaagagcaagagacaataaacactcattttgcaaggattgatagatccgaactaatcaaacactcatttgcaaggatcggagtatctttctgtgatttgattgctgaggtagaggtagacttagggggtatttgggagacaggggctaaactttagcccctctctcaaaaccataagtccctaggagcttagcccctctattctaaatacccccttacccaaggcacccaagacggaggaagaggagaaatcggtggagtagctcgggagggtggagagatggggagaggaagaggataaatcagtggagtaagctctttcagtctctcttgctcctgtaatcctgtccggagaggcggagaggcggacgacaatggaattttttttattttccattttttttattaaaagttttacaaaaataattttccatttttaaaaatcgccatcccagagggcggcgaaaatgacgtggcagacggccgttcgctctcgggcgacggccgtcaacgaaatttgcaggcggcccccttgccgccctccgctagggcgattatgtactgtgcggggggccgcctgcaaatgggcggcgagggggcatggaattttgcaggcggcccccttgccgccctgggggagggcgatttttgcctcccccctataaagcacagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagtatatctgtagcacacaacacatatgtgtagatccagagcatagaatataatagtatgaattgagacatagacagtagtgttaattgtaagatgtagtttagtttgatctggagaatataacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcaatcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgatataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcgaggcaggagattcttccaatgcgcgaactttgatcaggtatgcttcatctattcgaagttcaaatggataaaaaaaactaacttcttcgtacacaattgtaacatcttacgcagacatatcgtccaatgtgcaacttcatcgagtgggtagacatggagaacccacaaaacgatggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaagtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatgatccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtacagtgtatcgatggcacttcttatctatcttatcattacaatgtttaattatggtggtgatttttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattatattttaccagtcttggagattttaatcttgtatagttttcaatataaaaagatttgataactattgatatttatacaaaaatataaagcacaatataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggtcgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcgacgacaatgtgctctggttatgtgggcttgtttacaactgggccagcgtgggagaaacggaggcctttaacgtagcagcgcggatcttatggcatctgaaatttgccacattgctttctgttcaaagacagacagaactcagtacaagtgttgaggaagaaatggtcgccgcctgatacagatgttctgaaactcaacattgatggagctttccgtgcttcagagaagactgggggtttttggcttcttggttcgagatcatctgggatgtggagttcttgcggaagctgcacgtctgacttatgtacatgatgctatttcagttgaagcggaggcttgcctggcagcccttccagctgttgtagcgcatggtatcacatctatcctggtggaatctgatttatctgtgctaatttcggctcttcagactaatgagtatgcctctgctcctggtgggtccatcttcagggagatcaaagtccttgttcaggtagattttgccaatgttgagtctgtttttgctcctcgtgcttgtagtacggcggcccatgaactagcccaacgtggtgtgaattgacacccgggtcatgcaatggtgtggactgaccccctccctgattttgtacaaattctagtggattgtgataccactgatccagcttggtaataaaatgtcagtgttgaagatcaaaaaagatgatcgatcgacctttacccctcctcctgttccaacttccaacccatcctcgcatgagacagtgcaggccgacgcgaggagattcgccgggttcatccaaccagcacgtgagacgccggtgtttgctggaactttccgtcgccgtgaagcacacgcgtgtcgattcgcgtcgatccgcccgctgccgaagcgacgtccggtcgctgcggcgcgcgattcgctcggtagtcactcacaagatcagagctgttgcggtgcggagcttttgcttggaccaaagataaaaaggcaaaatcttctcttgctctaaacggtactccactcgggaaaacttaaatcatccctataagagatatccctttatttttcatgttacttaaaaagtcatcaaaaaaattataaaaaatagtagaatagatcaatatgtgatatgttactttacaaacatgcaaattcaaattcaacttatacaagtagaaacaaaaaataacaaatttgactatgaagtgaacgcgtaattcacggtcaaatttattatttttgttttgaattgtataactcgaattttgactcacatgtttgcgaaaagatatatcatatattgatctatcttgataaattttaaaaatatttgataattttataaatgacatgcacaaaatgaggggatgtctcctcgaggaaaaaaaatccgcttccactccactcaatcttgtagctaggagttgacgaaaagctcgtaactcgttaactcggctcataacaagctcggttcaactcagctcggcttgtttcattttcctaacgagtcgagctggtattttagctcgttagaaataacgagccaactcgagctggatcgcgagccgtcgagcctaaacgagctaggatgacatcaagtcggatggccaacatggacatcctttcggcccaactaggcccatctcggccatgatacaacggtgttatcatatgatgcgcgtggccagcctaactctcgttatctcatatacataaaccgatagatggataaaacaaaagccaccaacaagaaaaagagaaaaaaatggaaacgtagaggagatcgagacgactccggcgaggagctcgctacagctaatttcgctggcccggaagggtgggggcccctcgaaggggaggaggagcccgccctcacggaggcagaagtcggtagccccgtgccgggtcgtggcggtaggggcggtcaggggcggagctagagcgaaacaacgggtggcactactaggaaaagcattatcgcaagcggccgaaaagggtcttcgcagcggggcgcccgtccgcctgtaagccaacgactgtgaatatcgccgatcttcgcaggcggggcgcccgtccgcctgcgaagataattttcacaggcgtacgttggctagtccggtccgcctgtgaaaataggaatcgtccgcttgcaaaaaaaaaaaaaaaacttccgcctgcaaagataggtagaaaatattgaaatttaattataatttggccgtaaattacttttaaattatttaatagaaattcttgcaggtagatttttatgtacatatattggaagattatcaagcatttggtactgagaaatctacatatattgcataaatcaaaagtgttgccaaaatatatatattacaatatttttttacattgtcacttcaaataacgtcatctagttacattatggcatagcagtgttccactcccgaagatccttgaattcgtcacttgccgctaggacaccctctgggtcgaagaaatctcttttgacatgacaacactcgtggtggatgaagtggcacagatcacgctgcacatttgtgatacctgtatcgtcaaaacttgttcgacattctaatcttggcaactgcatgcattaaaattaatcaatatattagtatcataaatatcaagagctgtctagtacatagcatagagacttacatcctccgcgttagtcctgtatcgtccattaaccctaaggaattagcacgcataatacccgcaaaggaccgttcatcgcggttgcttgtgacacttcaggacatatcatagaaaaaagtagttaaaatttgcaattagtgaaacaattggaatacataaagtgagtggagtattaccagccaataggtacgtactagcagcttctcccgtgtttgggtctgttctccacccttgaacttgtagtattggtatgcactgtatggatgtcgtaccgtttcagagtaaggaggatatttatttgtaatacattcatatacaaatgcaagagtcataataacttactactgtaagattgttagaaattctttgtattgcttgtgattgtaatcgagaggatccaagactaccacgattccgtctttagggtggatgagtaaacagatataatgatcgctacatattaacaacattatagttagttagtaacagctaaaataagacatatgtgtacaagataaatgtaccggacttacttaaaatgataagcggccatgacgactctcttattttgaaagtgcaagaaggctcgtccaatgtactgtgcgacagtaatcaatttctccttgtgcaagcccttcttgtattctgctatctcttttggattcttacccttcagctggtctgaccctggtgctagcgtcacggtatgctgtgtttggcagatccgagttggatccaagaagtcgatgggttcttttttcttcttagcatccatgtattgcatcctatagaagaagtttgttagtaacaatcacatggatttgtattgtacatatttttcatctaattaattaaaactcatactcacatgcaccaaacaccgacgtagttgacatccatcttatcccgacgatatatggcgtagagatatgagaaatctagccatacgtaaccttcttcgccgaaacaatctgccggtgatcgagctgttatattgcccaagcctttcttgctggcctccatgtagaagttatgtaaccttctcatctcccatggtgcttctttcagtgcccattccggcaagagtgctttcccatgttcgtacttttccgggcaatcatcggttgcgaagtatgttggcccggctagttcagaagccttctgggggtcgtcatctctgagcttggcacgttccttaccccctctgaagacggttagcatgaacttctccttgctcgcatctttggacttggagtcgtggctcctaagcactcgtggcacctcggggtctttcgcaggagaagggtcttcaaatatctctggctctgtaccgtcccattccaatcctggtacttcttctttgtctgacccgaccgatgccacaaattccacctctggttctgccactgtaatctccatgggcacatccggcactgaaatctccatggctgtctccggcggtgcaatctccatggctgcctccggcaatgcaatatccggtggcacttccagcactggattttccttttgcatctctagatcatccgccttatcagtcaccttcctcttaggaggcctcggaggttttcccaaccccggtttaggcaacacaggtttttccccagcgtcagtgcccaatccaaaggatatgtcattcttgtgccagagaattacaagatcgaccgcatccccaagtacggatacaccatctgcagtcgggtagtcaatgttgtccacattttaaattactcaaattagtacaaactaattagtacaaaaataaactgtgtattaacaatatatcgtatgaacaaatttaaattctctgagatttccaaatttaactagtacttactattatgctaaattaattagtacaaacaaatttaaatagcgaaactaatgactacttactattatgctaaattaattactaaaaaacaaatttgtacaaaatttgatatgttattatcaagtagtgcactaattgacttacttatttcatcgacatgttgactaaaaaaaatggaaaaggcaaacatatcctctacatttttttaaaaaaaattgttaacataccctccaacatgttatctaaaaaatttgacaaattcacatatcctgcaaaattgaacataccctcccaatttcattcacatatcacccacattcccaaattcacattcacaatcaacatataaccccttattcacatatcacccacccctcatgcccattcacacccacatgcacacacatatataccccctcacacccacatgcacacacatataaaaggaaacacccacatgcacgcacgtccgtgttggacgaacggccggtgacgagcttcggtcgtggacgacgaaggaagggctggcgacgaggttcggccgtggacgacgaccggcgtcggccgtggacgacgaacggccgacgacgaggttcggccgtggacgacgaccggccgaagacgtcgttcggccgaggaagtcttcgctcgtggacgacgatcggccgatgaagccgttcggccgcgagcggaggggtggccgacagcggtggaggggccgacggccggcgccggtggaggggtggccgacggcggtggaggggctggcggcggtggaggggccaccgacggccgcgctcgcggtggaggagccggtggcggtggcagagaccggtggcggtggaggagcctgtggcggtggatgagccggcggcggtggaggagccggcggcggtggagcgggcgcgcggtggaggggtcggcggcggcggtggcagagagctcgacgacggtggcggcggccgaggacgtcggtctcggtggtggacgacgacggttggcggcggcggaggacgacgatcggagagcgaaggtcacaggcggggcggcggtggaggacggcggaggcgtgcggcggtgaaaaatttcggcagcctgacggcgccaaaatttctagggttcccgcctggacttagaaatttt

SEQ ID NO: 9827 - DNA, 3191 bp, Oryza sativa
caatttgcgatatgatcacacatcaccttacatacgaccattacataactaattacttcttagatgcttacatgccactccacaatcattaccctttaacatttttgcccacactgtccgtgcgcatgtacggcttcacggtcttctgagtagatgtctcgacattcttaatcttctatacaaactgactataaagtggcatactatcgtattggttgtaatcttcgacatcttcaactccatccactcccaatatcttttgtttccctggtagcactatatctttcttcaaatttgaagggtctttcacataaaacacttgtgccacgcgattggcgagtacccaagggtcatccttgtgacccatactcgcaaggtcaacaaaagtaagaccgaacttatcaacattgaccccgttcgggtattttacccactggcacttaaatatggggaattgcattgtgtgcccatagtcgatttcccatatttcttcaataaacccgaagtatgattgtttttccccggcttcatcaattgtctccacacggacactgctgttttgcatacaggtcttattatctcgggctcttgtgctaaacgaatatccattaatgtcatatccctgccaagaatttactgtagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgagcttcttggaatgatttgtgatcatgggtgacgaatctcttctttcctatcgttcccctgccctcaatctgccctcgtgtcggggcacaggtactccaattgcatatccatctttgaggtaatcgataaaacactcgacaacctcttcagtactataaccctcaaccattgatccctctggatgtgcacgatttcggacgtaacccttcagaaccgccatgtaacgctcgtatgaccacatttgatggaggtacaatgggccaagcgcaaccatctacggcacaatgtgaacaatgaggtgctccatcatatcaaaaaatgacggagggaaacacatctcaagttggcactgggtctcatgtgcgaatgtacggagatttcctaactcttcgagactaatgaccttctatgacactgcgttgaaaaagtagcacaaccttgtgatagcaacctttaaatgctcgcccttcttcatgccagcgcattagttccgcatctcgcgggtttgagtatatttgtttaatgcggtctttgacaggaaggtaccacattacaagctgcgggatttttctctgtcgtccctcaattgcttcagagggttctaggccagtattgctatttgacttgtaccggcttgcaccgcatgttggacattcatccaaagaagcgtactctttcctgtacagtatgcagtgatttacgcacgcatgaatcttttccacaccaagtaaaagggggcatatgagtttctttgcttgatatgtgctggatggtagtgagttaggcctcggtagcattttctgcagaagttctaacagactgtcgaaactggtatcagaccatccatgtctcacctttaacttcataagttcaagaactgaccggagtgttgtgaactcactgtcacagcccttcgactcatcgtacaaaacttcctttgctgccttctgtaaagcttcaaagttatttagccctctagccaaccccatcagcacctcgagttctgcatgacgtaacatttcctctaggtcgattttgtcctcaacagaaccatcgttatgcaccatgtcttcaacttgtgtcggaactacattttcaggcccgtccacttgttcttcgccatgaagtgtccatatttcgtacttgtccataaatccacgagttactaagtgctcattcactttaaaagcatcgtcaaagtcccaggctatttcattcttacagtcagcacatggacaaattatcttcctcatattgttcttctcagcgtgaaccttggcaataccaataaatttagccacttcgtttctatatggagacaaaaacctcggccaatgatacatccattcccgactttccatatctctaaaagttacacgtaaaatatttgcacaattaataccaaatttgtagggttcattgaaaaacttatcgctattcaaaactaattaactaaaggttaagtgtaaagtaataaaaaatcatagtttatttcaattttttttacacagacatgccaaattagtacattaggaaaatctaacaaaatcaaatcatcggcatattacaaaatactataactattttttgattgcaccgaataaatagacatttaaaattttattctctctctatacatgacaagatctagatctagatctagaactaggtggtggatatgatagcaaaaataaaaaaaaaatgagaatttatgttaccatattaaaccactacaacaagaggcatcaagtattacacatacatctaacatcaacatatgaaaagaaataaaattaaaaaacatggagctcttccttcacaattttggatgcatcgagctattttgccgtaggacctcccctacagtatcgtcaccgcagtagagtttaaccaccaaattcgggatggattggtgaatagacaagtaggacagtgctaccagctagttaactcagttcattcttgactttcggcttgtagctttgctacgcaacctcgcattcgaaattagcactatgaccgtcggtgaaaaagaatcaaagagaatggtccatgaattggctgggtttatcaaaagcactgcaatggatggcagagggtccatagtacccgaagcactagagtgatccagtagctgggaagggcgattttctattcactcatgatcggccctgacctagtcgacgtttataaaaagaacatcacctccctttttggttagataccgctccgttaggtactaatgcttctacctatcacccatccatcacaaattaaggtctaaaagcttaaaaaaaatgcatacctagtgtgaaatgagtagatctaagtaccgta

SEQ ID NO: 9828 - DNA, 16939 bp, Oryza sativa
aaaaaagtacccggggtagagggtgcggaccgcctgcaaagatcaatcttcgcaggcggaccgccccctccaccccgggtactttttttgccggcggggttttggctctgaattacatgcccgcctgcgaaaatcgatcccctacgacgccgaaaatgagttttctagtagtgtggtgtcccttgcttaatttactctattttagatcgagtttaagctaatacgagtgtctaagtttgtattgagggggtgcatacatggtgaaaatagatgaggtatagctaaaaaaatttcttgactgggttcctgggcacccccctaatatatactagctccgcccctagtggcggtggtcaacgtcgggtgctttcaccggcggtgcatgctggcgagtgaaggtgcaactataaggggaatccagcggcaggcgacgatggagataaaggtgcggtgggagacgttcctcgagctttgtccagcctctcttcgctggacgtcgtctctcactctcgtcgccaccatctcccatcggcgccgccgtatggggtcgtgggctcactacgcgccgccactagagctcgccgtcatctagctggcaaccgtagaagcaccagcaccaggtcaaaacaagctcttcttgcccgtctccaagtcgaattgttcccaactccaacgccaagccgctaataccgtcgtgctagccatcttctctccatctactactttgatttgctagctgagccaaacaagttggctcgagctttcaaatgagacgagcctcatcagctcattatcctaacgatttagaccgaactgagccggggtgactcgctatccacccctacttgcagccacacgagaaaatattgttggccaaccggtcagccatgtggagatcaaaaccaagctaattactgctgctgctgcatgctgaatgcagtaagatgtactccgttgtctcctacgtaataatacatctacatactagagtatagtaatacgttgaaaaatataggaacatttatagtactaaactagtcttattaaatttagcattaaaatatattttaatagttgatttgttttatattgaaactatttttatatttttctataaacttaaacgaagccaaaataattaattttaaaataaaactatgaaacggaggtcgtattacacatgcggcacaggacaaattcaacagcgacaagagaacgaagcggacaggagggagctgcaagcctgcgtcgtgcggcaacagtggagaatccgggcgtgtcgtgccaatccggtttggcagcggctgcgctgcagggagatgtgcacactgtagcagcgtcgtgcagcggtggacggcgaaggaatcctgacaggtgccaaaaccctccttagatccgggggacccccacccaccatacacgcatgcgacccactggcacgcggacgggtaggaataggatgtggtagcatccgaggaacaggggcagtttcgtctcgccggcgttgtatttccacatcaacgtgatatgagtaggcttgctgctacggtacgaagcatgggtgatggcctgatggctacacgactgcgtcggtgactcggtgtggctctagatcgagtcggtacggtattggtttgttgactcgtactctcgtactggtcattgggcggtacacgtgtatctttatctgaaccgataatggtgctatccataacgatcaacggtgccttcacaaaatcacaagcgaatgattttactgccttgctagaacttccaaagatacccgcttcagaaaggctttcaccgtctccactccaccaaacagaaacacagaatgcataatgtgtgattacgatcaggcagagtggtacacaggtactgtagtctgtaccctgtacctattaccaccattttaagcgaacaccatcaaactcataaataacctgccactcactcgctgcacactagtccttcagtttcagtcccctcgcatcgccataaccacctcgcccaaatcgaagcacactagagagccacaagacccctcctcccgacacaaacaaccaaccacactacccttcgcgctggtctcgaccaccggagatggccgcctagctagtgtgccggtggcagctggaaggcatgggctgctgcttcagcaagaagcgcaggaagcagctggccagtgcagctgtgttctcccgccgctgcaagccgccggccgaggcccgcgacccgccgcccccgccgccgttgccggaggaggagaaggtcaaggaggtgctctccgagaccccgagcgctaaggtcagggccgaggcgaagcccgtcgccaatgtggctgtcttggaggagccggaggcggagaagcaggcgccgaagcctagcgccgatgcggatgtcacggtgagcgatcttggtagctgcatgtcgctcgccaccgacgataggtccgaggcggcgtccgagtcgtccgtcgcgaccagctcggtgaccgggccagagcggtcgccggggaagccggccaggaggaagcgcccggtgtccgtctccggcgagctggcccatgccatttcccggcgcgaccgcgccgccgccgccgcctacggcgtccgctcccgcagcgcccgggcctcggcgtcccctccgccgcggcgcgagcaacgggaccgctcagtgcggaggtcgccgtcgccggcagcgaagcgtacaccggagcagcgccgcgccgcgagcccagccccgtccctccagcggaagccgcccgtcccggtgaggccgtcgccgcggcgggtgcaggaagcgcctccttctccgctcgagcccccgcctccaccacctccgcagccagaagaggacgccatgaccgccgacggcgagcccagcattgcggacgccgccagcgccggcggcgacggcgaggggaaggagtcgctggacaacccgctggtgtccttggaatgcttcatcttcctctagtggcgctgcactaccgccgtcgtgtcctccttcgtcaggtggcatcgcgctattttcctttgaaaatgttgcgctaatcttgtttagtttagatgttctgtgttaagctggtgtggtaattagtgggtaaactacttgtggtggtgtaatgctactgtcatattccggttattaacctatgtcgggtggaatgacagcagctttgacttttggcgtaggatgggccctccgattggaattggacggcgcttgaacgttggatgtttctttttggcttttggactagccctcgctgtattttgtagagctctttttcactaatcgtcaattcgtcatgtctaacctctgttcccatgtggagtctaccaacaatgtgcacgccatcacatggcgacctcacattttctgacttgttcggtgcgtgagtcatcggatactttcactttcgccccctgcccatgctgcgccatcgaacaatgtttccgtcagggacatccatccatgcatgcagcttttctgatctcatccccagattcagcacaggatcagatctgccaaaggagcccgtcaacctaggcaaacagatctagcgcccgggatgtgtgcgctggtgttaaacaaaccgccaatgctccgcttaaaattctcatcaaggtgacatgcggcgcatcatggcgctgcacgaggccgcgcgggtcgacagttctcgggatcgcgccttggttttggttcgcccgtagcgcgcaccgtcctgtcgactcggagcagagctgcgctgcgggcctgcggctgcacccgcttgctctcgtccccgtcgtcgttatgctgatctgcgttgcgcgcttgtctcccgtgtaaagatttcgcgccgcatgcgagctcacgggagcaacgtctgtgttggactgatggttgttggttccggtatcaacatctgactgctgttcggatgttcggtggtacgagacctgaaggatggcacagcacatggatgcggttggttgaagccaaaccccattcatgctgtctgtaggcccacgggaattcatcgagcaagtcaagattatctgaatttcttcatggcaaacccgtggtttcctgtaggacagttagcagaatttggcactagtatttgctagtactgtcgcatgctggcagcgaccagaatgatgaacagtggtgctaacacagggtggatttctaatcatcggcgaggactgtcccagtgcgtgcgtgattgattggtctctacctagctgtagcccgtaagagccgagcagaaccggttcaatacatactggccatactgctacgtgggtctgtttgtcatgtgggccacactgtcccgtattagtgtctcacgtaatccaagcttacaaatcaggattccttgtattgcggccgggagaatggagatattattatctccatcctgcttggacctgcggattctagatgtagaacctttcgtcctgagttctgactttttcatcgaaaggggcggaacgttgtcctacttcgccgtctggtttgataaaatacggtgaaattcatgctcgcggcggctagtgccttcacttcagccgtttgtccacggcaagcgtccaacctgtagcctcgtacgatagaggccgtgaatccgttatataaagaggacgcttaattttggggcctcccttaaactgccctgggctgtaacgtcttcttaaatgggctgggttattaattcaagaaaaaagtttacttaaggtccctcaagttgtcgttgaattccaaaatgtccctgaatcagaataacagacataacacattcctaatcttgcaaaatcagatcatattgatcctaggatagtattgctcccagttttgactgacgtggcggctgagtcaacgtgggacccacatggcccccgattttccacctttctctcatctccccatctcgatccaggcctccaacctggaagggggggggggggggataatggggagaggtttgacagtgcgacttacgggagaagaggtgtggtcggcctcctggtctagggctacacccgtgctgtgtgtgccgcctcgcgcatcatgctccctgtggtctcagcgtccctactcgtccgcctcgactaccaacacgtctccacctggtgtgtgtgtcctcccagatttccattgctcttcaccaaagcctcgccatcatcctctctcccgcgacggcaaagcactgcatcgtcatcgggcacaactggtttgccttctacgacgacgaggttgcccgcctcgtgaatgccctcaccgtcgaggagattcccttccattcgttcctcggaaagaatgtggtagtgttgaaggtcgtgttcacgccaaacctgatgccgagcggcttcactgtggcggccatcaccaaccacggttgagtcacttacacgactagtgggaacatcggatgaacctatgtcgagtgttcgcatcttggggatctcagctacggacactactaactcatgggaggcggcaaattgcatgtccttcgcctcaccgtcggctatcgttcccagtgaaaactggcatccttcgaccactgtttgacaagcctagcaatgtgttctatccggtggaataagattgggttgctgacacatagggctagcgtgggttccacgctgaatcaacagtcacgtcagttaaaaccagaagcaatattgtcttgggacataatgtggcccggttttgtacgattagaaatgtgctatatttggtattccggttcaaggacgattttgaaactcaacaacgaggagggatgtgaagtaaactttttccttaattcacaaacccaaagagagggttgggctgtaactcataaaactgaagattgggttgggctgtaagcctgaaactcacaaactgaaatggagatgggccatggccatatgactttttttcggttttagattttttaaaaaaatatttacagaaataatctatcggccaaaaaaattataaaaatagaccctgccacccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggtcgggcggcaggcctcgctgcctataaaaggcctgctgcctagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagatgagtgtaccttctataaaatgatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaatgcgggtggcctctagctttggttccgtttgttcacgcgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtagatgaaatggagaaggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctagtgttcagaaataccacaggaatattacttgtgcatttgttgcatctgagatgtatgcgcatgtcatcgataatctcacatatgaaccaaggtcaataatccgacacatcgaagagacatataagtatactattagctatgccaaggcctggagggccaaacaaaaaataatagagatgagatttggaacttacgaagcctcgtatgacaatttgtcacgcctgcttggtgttatcgaggaaagaaaccctgggagctcttacgaagtgaagaaattccccttaattgaacatcctagcaagagtgtgctgtaaagggcgttcttagctctacatgcatgcaagatggcattcgtgaactctcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgatagttgttggtatgacttaatcgtcctctcgagctcctcggggaaccgttggagagtcccggctatctccgagaggcgctgggcgaggcccccttggttggcggcgtacttcgcagtccgcccgccccagaggcccacttgccggccggcgcggtctagacgggagacggcgtcccgaagcatgctgggccctacctcgcctgccaagcggagggcctcgacctccccggcggacgagtctagcgcgccctgcagatcggcgatggtgtgttcggcagctgcgaggcgagcggttaagtcgctttcgcccgcggccgccccgccaatctgtgccctcgcgtccagctccttctcccgcgcctcgagcacagcggcccgctggttcagcgcggccctctcggcgcgggcatcttccagattacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggttcccctccacggcgcaggcacgctcttccagcgccatggcacgggcctcaagggcttcgtcgcgtcgccgggatgccacctcggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcggcccacttccaccatggcctccaccgagcgtcgcccctcttcgacacgcactcatgcggcgtcgagctctgcccgctctgcttgcagggcctccacctgggcacttaacccgtccaacaccgtcgtgtttgcgacggccaaggcctgcagaaggggttctgcgctcagtggagcaacagaaggcgtggggaagagccgtctcggtgaggatgccgcgcggctcggcccgccgatggacgtgccggactctgggatatcccccggacctagcttgtcctgagcgtcgcccgagggattgggcccaagcgatgcgcccgcggcctcgtcgcaagctgcctcagaagttgtcgccgcctcggcctggcgaagtctggcctcttcccgagcggcttcttcagcttggcgagcttggacggccacctgaacagcttcctcggcttctcgaaggcgatccgcggcctcttgccggtcagtttcacgggtcgcctcggaggatgtcgtcgcttcggcctggcggagtccggcctcctcccgaacggcttcctcggtctggcgagccagggcggcctcccgagcggcctcctcggcttcccgaaggcggtctgcggcttctcgccggtcagattcccgccttcgggcctctgtggtcgccgggtcctcggcctcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagataggggaggggttccttcctgcttcctcttcccccgggcgtcggcagggtggccgctccccgggcccccgtcgcgaggcccagaagcacgaccccctcccggggtagatcgttcccccctgcggctcccacccgcgccatcgtggcctcgaggagcccgctcctccgacgccccgaccgcctgcatgatggtcaagatggaggcacggtctggatcactgcagagggggaggactccttgaggaatgagggatgcctccacggagctgagattcagcacccgttggaccactatcttgaagtcctcaggagcccagtcccatcggaccccctggtgggtcctcatacagtcctcggacccggtgtactcccaggcgtcccgggcgcgccgctggagtggcgcgatccggcgacgaagatagtcgccgaataccatggcccctgtgagcccctgagatcgcaggcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaccgaaacagccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccttcgcccagcgagactatctcctggccggtcgcagattccggcatgaagcggcgcagcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacatgaaacaaggagttagggcgcaagcggcgaagacaaggggaataatggcgagagaaaggaagcaaatctcttcctcggcgactttatacccttgccaacgctgtgcccggctcctcgtttctcgcgcccactatcttgccccctcgattctcgcgcccactcttccacttatcccattcgcccgtttacggtgcatgaggtggatatgcggctgtggcagtcgagatggaacatctcgtgcgcgcgttaattacgctcgccgaccgaagcgccatcaccatatctccaggcaaaacgaaccggcacgtcccgattcgcgcgtaatgtggcagtcttgaagagaccgttcattattgacagccgagtaaccattgccgatgtgcgtgatttgcgactgttgggtttctgcccaactgtggaaaccggtcccacctgtcaccaggccttaggaagtggcgtcacgcccgaccgcttccctcgaggagggtaatcgcctcggcataacgccgggggctactgtcgatgacatgggaccgggagtatcgtgactagaggcttgaggtagacacaatcgcccacgtggcctggcaccctcggggggggggggcgtcgggcccgagggtggtgtgttcgccctcctctttgtctccccgagggggtcggaccgctcccgccttggccccgagggctggggcgccccgaccccttgtggattttgcgccgcgtgtatgggtttggtgagcacagtggcgctcacctaactgcatttattgcggtttggacgaacgcgtcacgccgcgtgtaacgcagtgcagcgcgctcgtttatccggtctgtgaccagtcacagaccggtcagatcgtgggtcaggtggcgacaggcggtctgacgcacgcctcgccccgtccagtcaggacgagagtctccaagcactcgtccctagccggagccggcgtgttagctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggcggaagtggaggtaggtatgggctgtcccgtcagaaggtgattcggatggcagcgatgcaaatctccgtccattaatgaagagaagtcaagttgaaagaaagggagggagagatggtgcatgtgggatccccttgagatataaaaggaggaccttgcccacttagaaaagaggaggaggaaaaaacgatcccaggagaatcgggggctgacttgcactttgtagcttcttcatacgcgaatccgccaaaacacaggagtagggtattacgcttctcagcggcccgaacctgtatacatcgcccgtgtcttgtgtgtttccagtctggcgaaccttccacagattgggagcttagaacctcacccagggtccccggccgaactggcaaaggggggcctgcgcggtctcctggtgaggagcccctcgctccgtcagcgagcgatagaagagttgcagtttgggagtatgaaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttcgacctctcccaatggatagtccaacattggttagaagaactggattggagattcggaaattttctcagtggattctgcatgaaccaaaagagaaatgggccaaggcgtatgacacaggtggtgctagatatggaataatgacaacaaatttggcagaaatttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacgacacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagtttacagagactaacgatgaagtactcaatattcctgacccatcgaagctccgaggcaaggctggaaggaggaggactcgtcgcatccgcaacgatatggacgagtcggaggctggcatggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtactattagtaacgtttgctatatttaaatagcctgtactcttgttgtacataattaatctcatgattttattactattttataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttgggacgttccgagcacgaacgtgcggtgagctactcacggttcacgactcctttgtcgagaggtacgaacagtgttttactataagttagttgcactgtaatattttttataatgacatattaatttgttattgcaggctatgtgaggccggcctcctaccgatgtgtcggctggtggaggctgcggccggcgacgcggacccggccagacgatggactgtggacaggtccctcctagcagctttggtcgatcgatggaggccagagacgcacacttttcacttgccgtgcggtgaggtagcccctaccctacaggacgtatcgtacttgttggggctaccgcttgcaggagacgctgttgggccagtgaccacggctgtggactggcaggacgatctgacggcacgtttcgcactagtacagcgcacaccgcacctcccgctcaagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctatggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctaggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcaatcaggcgtacctaccataccccaccacgttcacatgtcaggggtatcactcgattttttgcgcctatataagtcgccttaacgagtgagacctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatactgatattcgaggaaggcgcttttttaggtgccctaactatgaccgtgaggtattttattatctgcatatgcttattcatttcgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttttactgtcatgcttccttgtcccattactacatcgtcgttgtgttcaactattgcactacctccctcctagttcgaatctaatatcatctatgtaaccgcaatgcaaatagttatatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggt

SEQ ID NO: 9829 - DNA, 8834 bp, Oryza sativa
cccagatgaaaaagtacggccgcaagctctttatgggcggccaaaattgtaattagccccttgccgccctctgtatgggcggcaagggcctaatcgcaattttgaccgacggcggcagacgacgcggtcgacccaccgtctgccacgtcagcttgccgcccaccattagggcggcaggggctatttctgtaatttttttggtcgatagattatttctgtaaatattaaaaaaaaaatctaaaaacgaaaaaaattcgatattttcatggaattgtaaataaagatgtccaagtcaagtcctgcataacgaaagctcagattcgttggaaacttcaccgagttaacaaaaactctgttatgctcgcagaactgcacaaagtgaaacgggggacgataattccagcgaaaacctctctcggtctctccccttatcgaggagagtagaagattacatgcgtgtactgtacaccatacaagctagtggcggttaaaaaaatcgattcgttggtattataatatatctatcagtgttatagtatgctgacggagcgtgaggctcctcaccgggagaccgcgcaggcccccctttgccgattcggccgggggcgctaagtgagattcttcgccctcgatctgaggaacgtcagcgagagaggaaatgcgcaagacacgggcgacgtagacaggttcgggccgctgagaagcgtaacaccctactcctgtgttctggtggatctgtgtgtgaaggaatacagagaggccgagagcgaaagagagttcaggctctagaaaccctttgccagagtcccaactcccctcctttcttctctcctctttcttttttcctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgttgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccagtcgcggaccggataagcgtgcgctgcgccgcattaaatgcggcgtggcgcgctcgtccaatcccgctataaatgcggttaggtgagccccgctgtgctcacctaacccacacgcgtggcgccaaaaccacagggggtcggggcgccccagccctcggggccgaaacgggagcggttcgacccctcggggagacagagggaggggtggccacgtcatcctcgggtccgacccccccgagggggtcaggccacgtgggtgaccgcggctacccaagcctctagtcacgataccctcggccccatgttaccgacatatgctaattataattagatcatgatgttataatatatggataaacaattttgttataggttttgccgaaaattatcggtgtcgtgataccggtccttctactgtgatccgcccctgatacaagcatacataggtgaatcgaggattccacgcgcgtggctgtgggagatgctttgactatgctcaccatgtcttctctcgatacggagaaaccagcaattttcctgtgtcggtgcatctttggctgtgtttagatctaaagtttggatccaaacttcagtccttttccatcatatcaaactgtcatacacatacaacttttcagtcacatcatcttcaatttcaaccaaaatctaaactttgcgctgaactaaacacaacatttaacatttattgcggacacttaacatatcgaacttatcgggaaatttggtgagtggcgactgattcggcccgcatcaacttcgacggcgatgttcttttttctttttccttctttacaaggttggcagccctgaaaagtattcgtgtccttgtgctttcgtcattaacgtcttcttcccctaggggagatggtttgttctggtcaggtcaacttccaaacctaaagggaaggggcatagcatatcactagtgtactcgtataactgtagtattatccagcaatctgttggtttcaagcttctagtaagaaacagtaacagaaaggggttcaaataggatcatcgcccggaaaagtcgttggtaacaaaaatcgtcctaaagatcatcaccacacagccaaatgccaatacactacacactccataaaactcttttgagtttcatagcactgctgcatctgacgcaggaaatttcgctacatatgcttcactgcatcatgtaacatgctgtcatgttaccgggacaccggcgcacctaccctccatactccatgacccatgtttcctcgtctttgacagtgcgagcctgcgtgatgtgcgaagtgtaaacactagacttttgcctctgcacggggtgctcctagtaaattcccggtcgccgtggcgtgaaatccgtgaggattctgagacaccaagcaacgctgcaaacggcctccaccgaatccgaaactcccccaacaacctaggaatcagaaccggcaacgtcaggtcgcacttcctatgcgcacttgcagccggcgcccagcaaaggggacgatgagaagacgagattttctttcacggttcaagctttcacaattttacttgttcacttcttcgtgattttactttggtcgtatgggaagtgaggcaaccattggccggatacttgggtggaatttacgaaacattactgttttctcttttgttttctgacggaaggcagtagtagagagttggagaattattatagaacagtggtcgatactgcttaactatggagtttcatgatctcacaatctcaacttttcttgtaactactttgtttgagaggccggagtgccggacacatatcctctcaagtctcaactaggcttaagcaagctttcataaaaccgttcaggctaagctatcaaggtttgccatttgccaacttgctactatacaatgtaaaaaacgaaaaacaaaatctatttgatctctttaaaatattgggacgtctagtcaaccatctcagactttaagggtgggaaatattttcttgggccgtgtttagttcacaccaaaactcccccaaactctcaactttccatcaaaactttcctatttacataaactcctaactttttttttccaaactaccaactttccccaaacttctccttaatttcagaaactaaacacagccctgatgtcacgtataacaagttttgattcaaatgaaagttttctaattaaggccttgtttagttcgcggaaagaaaatttttaggtatcacatcggatgtttgaccggatgtcggaaggggttttcggatacgaatgaaaaaactaatttcataactcgcctggaaaccacaagacgaatcttttgagcctaattaatctatcattagcacatgtgggctactgtagcacttatggctaatcatggactaattaggctcaaaagattcgtctcgcaatttacatgcaaactgtgcaattagtttttcattttatctatatttaatgatctgtacatgtatccaaatattcgatgtgacgtttttgggaaaaaaattaggaactaaacaatgcctaaattcgcatgagtccgggatagtagattgtaaaaaaaaaacccaaggctcatgagttactcgagctcaatttaagctcgcctcgagttctagttgagtagagctcgagcctatgccaaagctcacgagctttgtcaagctgagctcgagctcatgtcgagttttaccgttcatttaataaagtagtacatcatgtatgccatatatctgtatccatgcggtgaagtatcttgcgttggcacaatatatttatcttattatttttcatcaatcattagcatgattaaatataaataaattatttatttcaagagattatccttgaaatatactatgttgcgctacttataagccgactttgtaggaaagctcaagcttgaaccgagcatgtctaaaaactcgaaggttactcgggctcggtttgagcttgagcctagataggtaagcttgctcgagctcgacccgttgtcagcccaagttacaagcatacccttacacccaaatccataacatgactttcactgaagcaatgatatgcgcgtatcaatccgacaaacaccaaagacaacacacaaagggcccgtttcgtagagcttttaacttctattaactctaggagttggggtttggagcggagttgtggagcagcctaaacttagttccacatctctaaatcattttgtgagagtgctccacccagctatattcccattttaggtggagttgaaattgttcggctaagctccagctccagaataggtgaagctggagctgaagccgtgccaaactagcccaaaaccacaacgtcgcacaccaactttcgtgagagttttgcaggaaaatagtactaccttcgtttttttaatatgcaacactattgattttgaacacgcatttaacaatttatcttattgatgaaatatgagaaaaatacgtaattatcatttgttttatcgctagaagtactttagacatgatttatatagcttttgcttaattttttgaataaaatgaatgatcaaacgtgtttaaaaattaacggtgtaatcaacgcttctcctttttaccctaaaaaagtatctctttttcacgatttcaaccgtcagaaatgcgaaacccacagatttgcgggtgccttcggcaagaaggcgtttctcctcccgcacgggcccgtgtgcagcccgcacccgagattgggcggcccgctcccacccccgtccgtccgtccgtcggaagcccaagccaaccgcctcgcgactccaccgcgtctctgcacatgcccagcccccaccacgaaattacccaccccccatcgcgagagaaaaaaactactaaaaaaatatcgcgcataatcccaattcgactccgactcggccattccgtccccaaacccacgccgactcgctccgcttttttaaatcccccaacccggaacgaatttttccccttcgtttccaccaccaccccccaccaccacgacgcggatggcatcttcgtcgtcttcgtcctagcgcgcggcggccgccacgcgaccctgtttgagagggggaaaggggggttccgctcggctaggcggaggaaggacgcagccgcccctgtcccgcggcgaatttggatgatcgaggcccgccgtcgagggtaaggagtgatggaagaggcttccgtcgcagcagcggatttcgatggcggcttcggcggcgccggggaggacaacctgtccatgcccctcggcgacttcatggccttcctcgataacgaggactggaaggagcagcagcacgaggtgcgttactactcgccgccttgccctaattcgatttacgcccgggtgtatttttttttcttctgtgtgcgtcggatccgattcggtgcgcggggttgttggggggctgggcttgcgtctgttctagggtttttgattgcatcggggccggatgcgtggatttctcgagaagtttctgccttcaattaagcgatttaggatgtttggaggctaggcactgtgttttcccccacgagtgttgtgtcttgtttaggcgcgaatgatacaagcgtgatcaagcttacatgcggttttggtccggctactcagtttgaacaggtattttttttgttgttgtttcggataagtggagctctgggtgcctgaagaagagctaaaatcaagtccgttatgcagtttcattaaatgttggttggtcaatgacaataatctgacgacagatcttcaacaatcatcggtcgctgaaatgacgcttgatgtacagaggctcggttgctggtttattgggtctcatgtttgattcactgcccttgccgtggtttatactatgagaaagtgtgttgatgatggcggctggaagcgagtttactggcagtcgtggcgttgggggttgtgatgtggtacatgtatgctgttttcagtggcgatgggctataaatggccatcaggctgttgggattggagaaggtcaaacaggaagcagcttggtagtgagttggaagtgtgtttgctgccaaatggatacaatgatatgtgggcttttcgtgttgtcttttctgctctcactgaacttcaggcccctgtacacatgttctgtatgtttaccggtgggcatagatatacatcatgcagctatgaggtatccttatggcctgttaagaacacaggagttcagtatatttttcacttgaaacagttcgatttcctcatgaattggaaaaattctagtgttgcaaacggccaccttttcccctgaatcctaacacatgtattttagcagtagaaaatattgaatttgttgtgagcatgcagatagctaatagtctgacctcacaatatttattatgatggtcgatcctggtaaatgctttgtttttatgtgtgcttgatgcttttagttttgcatttgctatgcctcattactaaagagatgaatcgtaaaactgaagtcatttcattaatgaaatgggagagtagatcctttctttctcaaacaaagaaaactaaagagatgaatcaaactgattttatttactgtgttgtgattgttgtgaccttgaatactttgggtgagtgctggggaaatataaaatttcttgccgcgttcagttctgtggcaaaataattggctgataccataccaagtgaaattgaatcttcattttttgtgctttgtttgaggaagtgtttttttgggaggttttgtcttttaattgtattttcaagttgttggttgctaggtcttgtatttaccaaccttgggtagtaatgtactccctccgttccaaattagatgtcgttttgactttttgcttgcaacttttgaccatttcgtcttatttaaaacattagtgcaaatataggaaaggataagtcatatatttaaagtacttttgataacaaagcaagtcacaaacaaaataaataataattccatattcttttgaatagatgaatggtcaagcattacacacaaaaactcaaaacgacaagtattttgggacggaggtagtacttgttatgctcggaatttgtcatatggtttgtggtcagtaaccagtaaaactctacatttagttccagcatatgccatcataggctgttaactatgtgtggctaactggatatgttcatagatgtccaagtttccttgagtacaataactgggattgcattttttttcgtgtagctgatgctaattcttgtgtttattgtaagataagtcagttccttgccaggaatatctacctacttagctttgttgcatctatatatcatgccccttgtttagtctattatcttgtgttcccttgacaaatgtgcatatttgtaactaaagagctattatgttgtttaatacagggcaatcaaggtttagagatgccagtggacagcacaagttctgaaaatgcatttcaaaaccatgaaggtaccagaagatgctcgttttattttggtttctgctagatacacacttttcttttccgtgtccatttttttaatttttaaattttattaaaatgagcagaaatttttgagaataaagaaaattggtcaaactactcgcatacagatccttcacatagtcagatggatgtaatggtggaacttaacaatggtggagaatcttttgatcactcagaggatacctcttatagattgcttagcaatggtgagaaacacaagaaaggcttcaatctggaaaaaaaacatttttattttattatgtattatatgattttaattttggttttgctccacagattttttggaaaattcaaggaatggtaatcctgagatgcatttaccaatggatgcattaaaccatgctaaaactgttgatgaagaaattgtccctccatatgaagattatacaaatggtttatactatggtcagcattctatgcactccgacaatacacaagttagagtagataacaactttgagggcttggagccacacactaatacttgtatggcggttccctgctttgtaatatacacatacgtgtgtgctttcttagcgttgtaatataaagaaggcactaattatttgatatctcctgcagattcgggatgtgatatgttcgcagagcaatctggtttaagtgaagttaaatgtgagggcacaggtcccatgcttggtaattctgagcaggagggtaaccatttcacgtcagtgcctatgtttgaccatagtgctgttatacctgatattccttacaccgagttgaacatcggtgatgtgcctggaagcatgcagaatggaaatggcagttgcctaactgtacaaggagaatatctgcagggggagtatcaggagtatcctcagccagattatggatcgtttgatatggctaatgaaatagtgctgcatgatttgccacaaaacaatcagtcatatgagctggaacaattaccacagaatatatgtgaaagcagttcaatgcaagtgggctctccagatcaatattgtgatgatacatctctgtcggattattacatggatgatgtatcttcgatagagtcgatgtccagcga

SEQ ID NO: 9830 - DNA, 4519 bp, Oryza sativa
actaatgttgagtgctcaccaccaactggttcttgtggtgaccgtgcagtgagatctgatggtccttcctccttttcagtatgtacccataattttaagcccaattaatttcaaagcaatttgaccttattatctggttggttggtgcattcatgaatgcatgaatgtttaagaactgtacttactattttcctaaagtccttggtgataatctcaaacatttttcttaaaccaatttatctttctgggacatgtcatacatctcattcttgcatattatacaatgtaaatttctgtattcgtttttccccttactgcgaagtacattctatctggagatagaagtagaagggataaagtattgttagaaaccagattgtcataaatcataatgtaatgttttgtggacttaagtacttctgggagattggagtattttcagaaataaaatcagaatatgggctagaaaaatatgactttacctttgctccatttttatttgttcatgctctctagcatttacgaattttttcggtactcaaatcattatattttgcaatggttgtaatggacaggcagaaccaagtcaggcatatgagaaggacttgtcaacaattgatgaggcgatgattccaatcaatttgatgcagaaccatgatgaatttataaatgccgtaaaatctcggctgacaaagttagaggtgtgtcctgtctctgatctttttacttgcggacttctgtttgttaccagctcatgtgcaccatagaattccttccttgaccttttgtatccaataaacagggaaccaatcttgcatgccattgcatgatagattatacatatgatgaagctcttctgtgttctttaggctattcagtacagggaaaatggcttatcgttgttagtctattgagtacaattagacaacttagaattgaacattacctttttctttgatacttgcgttaaatgatttattggcattttcttaaagacaattggtgtggacacacctataaattgaaggtgaagtcagctctagtgaagattgttgatcaatcccgcaacaccctaaaattaatcagctagctttgaatccattatttctgatagcctgatataagatgagagtgatctacacttgtatgtaaattatgcattggcatgcacttttcccaccatctactaattatcctacaagtggagagtggggaatagtcagtgaggaaagcatttgaaaactagtaaaagttgcatatatcatagccatcactccatcagcatatgatattaatgttaactgtcttcagatgatgcgtcatgtctttgaccaaaatggtatcaaaggagcgattgctgcagtggcaaagttgcctgacaatgctgtaagtattctcaagatgccgtgcgatattcttggatgtacatgtacttcatattttttagctgctaatggtttgacccttttttttacaggttctagctgatgttgttagtactctgaaggggaaacttgatctcttcaacctagacattttcttaagctttctgcctgttcttgcggggttactgaccagcaaggctgaaaggtgatatattggatgtctctattccattgcatgttggttcttgtctgactggaccaagtgatacatagtaacttaagcgcacatgctctgtgcacacatgtagacacaagatgctgctgttaaattgaattgtctatcctcttgttagtctgttcattctattgcaagcaaggtcatggatctattttctttacaaaaccatggagatattggcatcttacattagaaaatgtttggtttagtagtaactttgtcttatggttactttgcctttaatttcaatttgtaggcatgccattgtttctttggaattgttgttggatcttataaagatctttggaccagttattcgttcaacattgtcagctcattcagcagttggagttgatattcaggctgagcagaggtacgtgcattaatgttattcaagggaatgctatttaaaggacgccgcaaaacctgcaaattgcaaagagacactggatgtgaggtgacaagtgggttctgtccctgcacttcagttaggaaccattgttttaaagaactgcagtgtttgtagcatcctataacctattgctctgcctatgccaagatgaactggactgttgctgacttcgttgatgtcacaggttgcaacgttgcagtcggtgttttaaccatttgcaaaagattcagcaagttctacacccgttgattatgtaattcctttccttcccctccctgtatgagatgctttatcctttactttatcagactattgttttcttaagcttgctgacagttgttcgtgtgcaccatgttgtttatttttgttgctacccacgtcatttgttggagctacctttcctgacattctgtgatggtttcatattttgctggtgcaggcggggtggtcaatcagcacaacttgcccaagaactgaacctgtctttgcaagacttggtggtgatctgaaacaagcggggaggttcattcatactagtacaacacagtgagagtagataactagacatcattctttttggcaaaaaacgcgccagcgccatacagtttttgtagcttgttgccatagctttgcaattgagctgtgtaattgtgttttgacttggcttttgattcggcgtagtcccctgttgtacatgtgagcttggctgtgcataatctgtaattaacatttgttacatggacagccccggatgagggagaagcaagttcaaaaatggttgatgtcagttcaacgtggtgattcattctcttctttcatgtaatgaaactgttgcccgtgtaatctggaatctggtgataattcaattcaccatcaacgaagtggttgaagttttgaagacagagtttggcacggtttgaacgcattacccattccccgtttgacttcaaattcaaaccagctgggtgctgatgactgtcttgtcatcatttgattatttcctaagccctgtttccttcgttcttaagaaaacactcgtctgtatttttttttaccaattctggctggcgatggttttgctcagttactaagcgggtacgtcaggacaaatttgtgttccatttagaaacttccaattctttaaacttagggtggtgacaggtttgtcaggtcaatcaaaacccgccgatcgtactaaccgtgaattaaatcagatccccttcgctaatactactatcatgagggacaaatttcagctccaaattaagaacgtacttgcaagtactaacacaaacgctgacaatcttgttgcatttgtgcagtaccaccaccccgtccgttcctctttgccggccgactagtctcaactctcaagtctcaaccgcccaccggtcacctggccccacctgtcggccggtgagcaagtacgcgaagaatcccacaggtcagagattagcaccagcggagacaggaagtaccactaaaataagcccctcctgaacaaatcccaaattccaaacccactaggttacgtaaaagcggaagcccggaggccggagcagttggtcgccaccgtcacgcgcgttccccttccctcgccggagagagaaaccaccgacgcggccgcttccggaggaggaggaggagttggggtggaggggagctatggcggggaggtacgaccggaaccccttcgacgaggacgacgtcaaccccttcgcggtgagctgctgggttaggctgtagctgggtcggggggctaaaccccccctccgcgtcgcaatcgcgcctcctccttgcttcatctaggcatggagaagcttgtcctcgcgcctgtgtggatggggtagtcgagctgcgtcccggattggcatgtgttgtgctggttttctggccgtggccgcttcgtctggtcctgcacgcggcacgccatgtggggtgctttggatcagcctgagttgttggcgctagggttagtgatttaggatccgctgttagggggttggacttggatggcgcgaatacggccttttttgcttgtctatttgctagctgatcgcgaggcgtggcaacttttccccttgtattgttatacattttcataggagaaatgatgctcggattgaaaattggctcttaggttgtgttgggacgttatgtttctggttttacgagggaatatgtggtgcaatcgatatgtataacttgtgaaaatggtcggtctactcttagaattattggaaaatatccgtaaaatggggcagttcacacttgtttggttcagatcgtctataacattaggagattgaagattgtctctgccagtataaacatttagtgtcgtaagcctgcagtcagtttacttcagtttgctggatatgcacgtgtcagcgagtccataatcatgtgaattgtgcgtatgcgtgcacatgctccatctaggatttctaaactgtccaattttgagctttcggccaataggcg

SEQ ID NO: 9831 - DNA, 8394 bp, Oryza sativa
ctataatgatcgtggtgccacagtggacatacctcttgattcaaccaaggtacttgtatttccattgagcggtaatactacgtgctactatatttacaagttatgttctgtacctcagcgtgagaaaatcatactgtacttagctctttcactctgatattattactctgttagtgtgtaacaacagttgcatgcttcattttttgttatcttatctctttaaaaggctgaagaacacaattaatctagtaatgatggtttcactattccttggtttggatgtttgataccatatattcttttgttgctgtatttgtggttggttgcttatgcattgagtatgttcgtatgtaattcaggacatgaagaaaaaggagaaagaactgcaggcaaaggaggctgagctaaacaaacgggaaagcgtatgtgccttctgtagttatgcttgaaacttggaattttcaattgatcttttcatgagcaatgtgatttttaaccaatgtttgatgaagtaaaaaactattctaatgaatcaagttgtcaacttcccctggccaaagtcctaattcctaacctttttcctatgatgtattgggaagcacctatatattgtgttagtattgagtattgaactagtaaccattatgcaatgtgaaagatatttagctggcatggatttgacacaaagatccggcaccaatagacctcgctgatctaaccattaattgaatcattgacattgcacaattggtttgaaatgatgaacaaaacatggatatctatacactcaattatagcactttgaaaagaaggatggctgtttttttagataaacagaaggataccagcgtgctaatgcaaactaacattatcaaatgatttcatctagatatctcctcttttcataaaatattgcgcacgagaattacgtgtatagaatgctgaatctgtgagtgtgctgagttttactcatagagtaaaaatttgatccaacaagtttcacatgattggaggttaaaacaccctagatttgcgtacaagcatgctcttgtattttctttaaatacaccacctgattttttgtgattccctgatacgcaggaattgagaagaagagaagaagctgcatccagaggtatatttttttctcgcagctgagtacgtgtaatctttttgtttttgtgtttctaacaaaaaatattcgaagataggaaacagttgttcatgatatttgtgtcgattggttaattaggaagttgactagaaaactatagctaattttagatttagagcctgagacttaagttacactttgcaatataatgagatttgtaggcaagtatcccttgttgtacaatttagaaatgctcctgtttatgctatattattccctctgtcgcataaaaaaccaacctagtactggatgtttcacatcctatgatcctagtactacgaatctggacatatctctatccagattcgttgtactagaatgtgtacatccagtcctagattcgtgttttttgggacggagggagtacattgtgttcgtctttcttgaaaaggctattcttgctaattttgtgcttatgtttgttctgttgcaatctattttccattttagttgttgcttctgcctttcaactctttcttttatttttcagctgggattgtcattgaagagaaaaactggccacccttcttccctattattcatcatgacatttcaaatgagataccaatccacctacaaaggatgcaataccttgcattttcttcattgttgggtaagtgttagttttagttttaagttttaactctctttttgttccctcatgttgggaaagctgtcacaagaactaaaatacctggtggaaccacaattctttatatccttttgcttaaacattgtgaataaaatactgcctgaatcactacatttactgtccaatcaatgaatttctgctgagtcaatgccagaagtgagtagtgacatgagaaaaacgtgcctactttgagacattttgatatcaatgaacttctctaatcttgacttatatatccaattaagagattcttttttaaaaaaatagaagttgcaacctgtgtcttttgagaaaaatagttattatcttcttggtgcagtaattatgtaagcctaataagcataagcatgtggtgtctaccctgttttgtagctgggctaaatgtctttctgtaaaaagattttcaaagcaacgctaacaatacttggcatcttgtaaaaagaagcactatttagtggactgaattttggttgtgagagctagtacctatttgcatgttggtgtagcattgctctacaaagctgcttcttattgtgcaaactttgatgtcatgcaggattggcggcatgtcttttctggaacataattgcaactacagcagcatggattaaaggggcaggtatggctgactgagtaccttactatatatttatcttatggatcagctgccatctgcactgacacttcaaactaatcctgcggttcaattcaataggtgttatgatctggttgctagccattatctactttatatctggtgtacctggagcctatgtgttatggtatcgccccctttacaatgcgatgaggttgtgaatatacttgtgtttttgttatttctgcacactatttcttcttatatttgacatagtgtattgttacaatgtatgttgcaggactgagagtgctttgaagtttggatggtttttcctgttttacttggtaagacccttaccttctggtaactgtaaggttaaaatgatctagtataagattaatggtttgccacactattggttgcaaaattgcagatattccgtgcagtgctaacagtgtttgccccctttcagatccatatactgttctgcatctggtctgctgtggctcccccatttcctttcaaaggaaagtctctggcgtaagtgttctgttattttatttaactaaacatacattttatttaagcagcaacattggagcactggatagtgtcttagtggctatgacttaaaagtgctttgagactttgttattcttcagttttagcatatatattagtatttggctcatagaggtacctgtgcaacagttctaggttgcttttacgtggcatttgcatagttattaggtgatggtgttaattgttagggtaatacctggatcactgctattgatgctctaaattgttacaaacttgtagcaattcaacttgcaggctgtccattttctctacttcaatttataaataccacttctctaattgcctctcccttttttttttgccacagtgggattttgccggctattgatgtcataggaaacaatgctattgtgggggtaagtctcactgtttacttaatgtttttcttctagattcaagttaatttgagatatcagggttagtatcttgggaggaccctatttgcatttttttaacagaccttttgcctcagtgagtaagcactgccgcactgggactctgggagttcgtgatgctttgcttaatttatttgattggcatgtctcatacaattgattgagtcatcaacattgttcacactttctttcgacagatattttacttcattggatttggactgttctgccttgaatcactactcagcgttgttgtcatccaggtgagttttataaaacttgatcttagccaaagccaaatagtaacaccttggtgtctgttcagcaacactccttcattctgccgttcatcatcatgcgtcatgctgtgccttcagaatatatacatttctatttgcattgatgtctccactcccaactagaatgtgctgtcccctaagattttgttcttgttgcaataaaatttccgctgcaatgctgtcttcattttctcctgggagatgtcattctgaacttggccgtttgaaatgcagcaagtatacatgtatttccgtggaagtgggaaggctgctgagatgaaacgtgaggcagctcgtggtgctatgagatcggccttttgatagagctgcttcgatggacgggagagaataggatgtgtcgttctgtggtggcgccttgtacatccctacacctatgttgttcgtatctaagttattccattttacagcagcatatagctaaaggattttcctgccttaatgtaatatatgttcactggggccttttatggatacctcaagagctttttacctaggttcagatgtgcctatagttaatgttttccttttgaaatcctgcatgatcacaatggttcctagggccgtattgattctttgtggcaggaaacagtttggtttactaactatttttcttctttgttaatatataaatattaagaataaatccctgaaatacatcagaaatgacagtacatattgaaggactctgttcaaggcctaaaactagcttattatcctatgaaacataagcatcttattgcatttcattaactagctcggtacagcaaagctcagagactataggatcaaaattgaagggattagtacttgtactgatttcatacttgggttaggcaggaagcaggcagggcgtgaggcgcctctcatttgctgctcatggtgggctgcgcttgctgcaccttggtcccgaacctgcacttcctggtgaggaggctccacgatctcctcggcttccccagccgccggatctcctgcttcatgctcatgcactccttctccagctccgacaccctcgccttcacgtcggtgatggcctcggcggggagctccttccccttcccctcgtcggcctccgcgtcggcgtcggactgcccggccgccgccgcgcccttaggcacgatggcgctgccccccgggtgcggctgcggagcgccgtcgccgcccgccgccgcgttgccggacacgaagaaccagcctgcgatggacgtgcggaggcggagctgctcgaagaagagcacctgcaccaccacccgcagcggcaggcgctcgttctgcgccgcgtgcgtgcacgcctccagcgacagcttctggcagttcatcagcctgcacagctgctccctctccgactccgacagccacgggtgcgactgcgtgcatggacgccgtatcatcatcgtacgtgtgttgatcacgagatgaaatcgaaatgcaatgcagctagctagatagagcgacgtgtgtgatcaccttgaggtatatgtccatggcgcggtagatgccgtcgtcgacggggcgcgcgtagtcgggtacgacgggggcgagcgcctggaacttgggcagcttgaggttggtgtcgggcgccacctcggcaaggtacccgtccatgagcttggcaaccatggtgatcggcgacagcgacgaggggctcccggcatggagcgccccaagctggctgccctcctccaccaccgccggcgacgtgtacccggtcccgagcccgtccgtggacgacatgaagtagtccagtatcctctgcacgcagtcgatgtcgtagagcgtctcgacggtgtagccgaggtttgggacgagcaggtcgtcgaggcaggcgtcctccagctgcgcgccgatccgccgttccaggttctcccggcacagcgggctggcgtggaggagcatcgccgtgcggagcatcccgagcaggaacctggtggaggcgacgcccttcttcgccggcagcagcgccacgatctcctccaggaagtacctctggtcgccctccgacggcgccgacacgttggcggcgcgcggcgtgatgctgcggctgccggcgccgcagtcgccgccgaagctggcgttgctgaagctggtgttccgcttcagcccgggcaggaaccgccccgcgtagaacatgatcgcgccggcgatgctctcggggcgcatccccttcccctccatcgcctggatcagtcgcttgaacatgggcaggctcaggaacgacacgtcctcgtaccaccagtccatcccggagcaccccgccgccgcgcccgctgcgccgcccccgccccgtggcgtgccccccgagccgatgccattccacagcgcgtcgtagctggcattcttggcggccacggccacggcggaggcggaggcggcggcgtggccggtggaacacgcggcggcgtcggaggcgcaggccttggaggcgagcgcggtgatgcagcgggagacgatgtggaggtcctcggcggtggggagcacgccctcgcatgtctcgagcgccttgatggagtccttccagttggcgagcacgtcggcgaggaaggactccgcctgcgtgatgaggttgccctcggcgtagtcgtcggtcatccgcaggtactcggcggcgcaccggaggcacaccacgttgtgcgcgttgagctcgatcttgacgtcgtagcagaacctcgccgccagctcgaacgccttggcgccccccgggatgtcgtccagctgcagcgtgcacatgcctccgccgccgccgccgtcctcctgcggcgcttggtactcgctgatcatccgctgcagcacaccgctccggctcagcagcgggaactgctacacgtcagctcgaccaggccagctcaatgcaattcaagatattttaattcacggtgattagtttagagaataattgcgctaaccttgtggaggtaaaatgacatttctcctacttccacgacgacatcactctccagctccgtcatgcatctcctggcgattgacaagattaagattaagcatgtatttggaattgacgtgtatagattagcaatgagggataatctgaatcgacctagtatgtgcatgggagtttaggacgtgaatgtgttatatcaaacagaatgtaagcgtttggaattgacgtgtatagattagcaatgagggataatctgaatcgacctatgtgcgtgcatgggagtttgggacgtgaatgtgttatatcaaacagatgaacatactgtgccatgaaagatttccagccgatttgccagtgaacaacatggatcagaggttgggaatgacatagttcatgcgtgaaactcaatctgttgttacgttacggtgcagaaattaatttgattgtgttttacattgtttgagaacctacgcatctccatacaatctgtcacagaagtacccatggttttaaagcactagttgacatactgattactgatatggttagtaaatgaacatcaactatcagatctcttaaactcaacatatgatagagatcctttaagagaattctgaactagaaaaaaaaataaattcaacatacagaaaattaacacaacagaaagaaacgaggaattcaggataaccatgtgaggccttccagaacaaagatttccggcttggagcccaacttcatagtcgccatcgtcttcttccttctcccagttattctacacgtcgatctgtactgtaactgtcaaactggaacaagatgccgacgagatctgcctgctacgcagttatgtttaggagaaaacggaagccttggaaattaagcgatgacgtatttaaaggagaagatggcaggttgctgtgctatgcttgtgcatgcatcactcgctgctgaggctgcatgcatgcaggcagagagacagggtaagggcgaaggaaagccgcatagccagttcaaaggatagcccgggtccaaaggtgagctgagaaatctgcacgaacagagctaatctctctgccactctctgacaggtggggcccatattcctcttactcatgtcatggggcccactagccggtggctggtgtgatagggatactggcagctggcttggcttggttaaacagaactgcacaggtcgttgtttaactgtggtttgtggtttgctaagtcccagtgtcccactggtcaggcaattgcaatcggatgcatttttggttaacttttcgctggagatcatacaactatctatctatctgtcttcctgtctatctatttatatattctgtcttaaaatatagatattttgaacggataaaacacatcctactattttaaaatcacttatattttacgacagagagactactaaaaatttattaaactttctacaaacgctctcgagctgctacgcgacaccctataaatacatctaagtcaatacgtgatactctaataaagtatatcactatatctattttaccaaaccaaaacctcccaccatccccacctccttgcggcatgtgcacgcacgcaagtaccgactgttgtacgcaccctccgttcctttctccgtttttttatccatatcataattaaaattaaaattatctttataggaaaaaaatcccacaagtagacatcatacgtgttaaagtccattaaacattctataaatgtttctaaacggggtgcagga

SEQ ID NO: 9832 - DNA, 9909 bp, Oryza sativa
ttctcactaaaaatcaaaatatcccacatgatttttttatacaattggttgacctattacttatatcccattagacatctaacgattttctatcaacttaattaatttatttctcaatatgtatataggagctatttacccatacaatttgatattgatgcttttatcaataaatgatctttttaggagataaataaataatcttaagatgattataccatctaaattatatatatgatctatgaagtcactgataaattaaataaaaatattgaaatgatattctttttttacatcataacatgtaccccatctagcattattttttatagacaacattttaaaaataaaaatgtggccagttgaatatcataccaatcataccaagaacgtgggttgcaccaataaatcttagcagtgaaacagacatgatgtggcctcggcaatatataagtcaattcctgataggaattaaaagaccatatccatttatttctttttggtaaaacttgctatggtacatcgtaagttcctcacatttagcattgaataatatagaaatgtatatttgttacatgacacttcagtttagtggtaatttgctaaaaaaatactacaacctctattttatttttccttacttaattagagagataatttagaatggacatatttatcctatgttgggttgtaggcttaacccacttatatttttatcttcaattatagagatcaaatcatttcaaggatgtttcatagagtggaattctccattttcttaaaaaatgaagatgaaaagaatgaaaactgttgggttttaaacccattctaaatagaaattttcaaacattttattagcatgactaatagaatgaacatatctaaaatttcaaacataatataacaaaaacaaattggactttcataggaaaaagatctatttttttgacacaagtttctcataaattaaaaattatgcgatttaaagtgattttagtttagaatttatatgctgcgaaggtaattgaaaaaaaatcataacagctgatcaaagcacattaaataaatttaattttgttcatgatatagtaaaagaaatatttttactagaaagacatcctcacatgggcattcgtaaaaaaattttcacacattaatgagcgggcaccttcctgttaggagagagaggttcagatagtcgttgtagctagttgtagtggtgtacgcttgtacagttgtaccattagaccctgacggtccctccatgatcacagttcactaccgtgcatctgctagaaaatcgcttggccagtgtctccctccgtcgcgcatgtccagctagatccacgcatctgaggctgccgatccatgctgcaagttcagcagagtccttggcgctttagcaggtaacaattgctggctggtgatccgtatatgtatgtcggtccatccgtagtcccgtgtgggtgtggccgtacagtacatcgatcggtacatgtatgctctgctggcgcaggcagaggcaggcttcaattgtgcaactactgtgtgttgcgacgcggtgcatggcgagattccaccgcaccgcacaccatcgatgctgcgaggctgagagagtgaaccgccttttttatgacaactttttgacgaacgcgagagttttgtcagccacaaactcacccacgtcagcaaactcggctgcatcatctagccagcccagacgccacagctcccggtgcagtactcgtaccactgtactagtatttgatcttggcagtggcagctacatcctccatccaaaataaatttattcgtggtttatgtgtccaacgtatgtgcgatttaggctctattttattcagcttaggattattataatatgaattattagaagtaagctaaaacaaacaagtagattattatgctagattattataatctataaagccagattactataatccaataatcttctcttaaaggagccttttctagattattgagtggctaaagacccactacgcttagatgcctctaattatctagagaaacaaacaactcgtagcttattttatgtcaggttattataatccagcttagagtaatctgatttaataatctagattacaataatcttaagctgaaacaaacagggccttattatttttattttttttcatataaaataaatagttaaatgttggacataaaaacttataaataaacttatttgggatggatgttgtagctagtagtattggagcatgtagtagcagactataagccaactataagcacattacaagataaaagagaagagacaagagaagctgactatagatttgtactccctccatcccataatataagagattttgagtttttgtttgtaccgtttgactactcgttttattaaaaaaaatttgtgcaaatataaaaaataaaagttatgcttaaagtattttagataataaaataaagtaagtaaaaataaataaatataattttattttttttaataagacgagtggtcaaaaagtgtaagtaaaaactcaaaatctcttatattatggtacagagggagtagctagctgtagcacgaactctaagacgcaatgtgtatatgacatgtgggatcaaatattaataaagtaatatatgtttataactaattggtgttaattaattggtgtataaattgactataaatgatttataggtacagtggctgacaggcgagcgaatctcttgctggatccaccgtgcctcctgtcacatccgtcgcgtgccttccactgctcaagtagtacgtggtggttaccccggagcccggacgcgcgccctccactgtagttgcacagcaggaagagccggcgttaacactgtgtactcggtactaaccgctttttgttccgtcttatacgcgaaaccaacctactagtactggagtactagtctctgctctggcgtctctgagccggtgagccacatcgtacagtacatggcacgtctctgagctggtgaaccatcgtacagcgcgtccgtacgcaccagggttgagacacaccggccagtacgaagccggtgtcgcttcatcactcgtgcaggacaccggcctcgggagacgccgtcgcttcacccccaccgctcgcggacaagcgacaagttgacaagggcaaactcccgcggccgctctctgcgccggctctctgggccaccagccgcgcgcagcagtggagagagcgcgaacaccaaccaatccacagcggaaaggcagcagagacgtgggggtcgcgcgacgtatgacagacagacgcctagtgcgcaacagcgcgaggccgcggccgcggccgcgcgaatgatcccgcggcgcgcgcgccgcgcgcggcagccacgaccgccgcctcattggcgccgcgtgggtggtgtgacgtgccctgcaaccagcgctgccgcggtagggggaccccgaataatatcgccatcactggacaacatccccatgctacgtgcgcatgccgctcgcgacatttctaccaaagctcacggagcgcatccatccaagcgatccatcgcgagctcaagcattttagtagggtgtatttggtttccggtcaaggttggatgggatatgatggtctatattttactggatatggcgatccagttttttgtttggtggagtgaatacggcgatccagtttttttagttgtagggatgaaagtggatatggtgatccattttttttttggttggagtgggatggatgagtggttgcaatcaccctttcattacaggtggtgagtatacccctccaaattctcacccaacaaatatcaatctactaaaaaaatctaaatagaaataaaaaagcagaaagaaataaaaggggaaggagaaaaaaaatgccttctcgaaatcgccggtcgccgctcgcctcctctcgctggcaaccccaccgccgcgcttcctctctcccccgccgcctcgtatcctctccccggccgccgccgctcgccctctctccttggacgccgccgctcgccctctctcgccggcgcccccctagatccggttgtcgccggctcacctcctctctcgtcgccggctcgccctagccgccgccgccgccgagctcgcctccacggtcgtcgccttgcctagccgccgagctcgcctcgtggtgagaggggtgacgcgacccacatgtcgctcacccctactcgcccgagcgctcgggcggctgcatccggccaattcggccggatccccccatccggcatctggggggaatattcctccccgggccgccccatcccacccctgcccaggaaccaaacacccacaaaaaatgggccgccatatcctatctacccatatccctccatccaaaacacacccttagacgccgaaacccccttgcattgcattgcatacaaagattcaaccaatggcaaccgattcacttccccagcaatgtactaaaatgaacatgaatagaattttggtaaattatatgaagcaaaaatcggccggctttccccggtactagttgttgtctatgggaagaagctagtcaaagaacatctcagttctcagaataggaggccccccccagtgaagccggggaatcattggacctggggggtttgactaaaaaacatctgggtctgcaagggtatatcgaccatgctggtgtttcatcctaccatgtcccatggtggtgtttcatgcattgtttcatcctcctactccttggagttatggtagaagtcgacgcaggtctggcacccgcagtcggtgaagcggcagatctcgcacccgaagcacacgcacttcacgcagccggtgcacgacgtggagcgggagcagcctctcagcaccttgcggctcgcgcgctcctcctcatcgccgcaggtgaccctggtgggatcaatcaaggttatatatatatgcaaatgtacacaagaacaaagcaaatatatgaaatatggaaaaccaagaaatgtcaaactgaggatggaaggaacacagaacaggtaacggtgcataaaagtacactactggtcactaggcaaagcaatgcttcttttttaaaggaaaatttaatgtaaacattgcagccaaatttagaatgcatgtactcatgttactgaaggaacagcacccttcagcgatcctagaaaattttccctacatgctactgaatgctacagggatacagtactgaatgtgtcctgtggctacaggccgcatgagtacatgaccctgcagagatctggaagtgtttggcgagaaacttgcatagcaacagttccaacagacggcactacagggcagcagtttcgactttgctactcccacagtagatagtagaaaaccaaagacatagtactaaactactaatacgttaactgtaaagcattagtagtttcctacaattgcagtttgatcatgcagacactgtagggcatttatgggctaaattcccctccttttctctgtttcatattatagacgttttatttttttttttcaaatcaaacttcttgaactttgaccaattatatatactccctctatctacttttgataagcatatttccaaatctgaaaaaattatttttaataggtatatttcaatccaacaatatatcatcttaatgactttcttggatttaatgcatgactctacattcttccacacaagattagctacatgagcatcgagaaatataaatattattgaatcacttgtttacgaggaataactagtagcatgtttagatggatgataagtagaattacatgaaatatgactttcaaaagtaaatggagagagtaaaatttagcatcatctacaataccaaattggttcatttaaatctaacaatcgaatatattttgatagtaagttagttttgtgttaaaaatgttatgtttttctataactttgatcaaagtagaagaagcttaacttagaaaaaagtcaaagtgtcttataatatcagaataattaccaactactccatccgtcccaaaaaaaacttaacctaggaggggatgtgacctttcctaggacaatgaatttggactaccctttgtcctaggaggggatggggtcacatcccctcctaagttgagtttttttgggagatagagggagtatgtgcacaattttgttgtgcaaaacattgattaaggtaattagcataaatatttcgcagtgcatcaataattcatagttgttatattgcaggcttgaaacaggcagctaccagagacgctaataccaatcatggtcatggtagagagaactagagatacatgggctgccatcttggattgcaaagcctgcggctggagtgctggattttcattaacttgtgtcactatcattgttatggctaccagttgagaaactcagaaaagtaacatgcatatggacactaagtgtactccagcaatcaaagggtatgcgcaccaccaatatttagttcacgtgtcaatttcatcaactaacaaagcacagaaatataagaaaactagcaattatgtcaatgtgttctttttttttaaaaaaaaaggatggacatgtaaagcaaaaaataataataaaataaaatagcacaactgtagcagctgttctccaataataacacttaacaagaagtatccgcaataccactaacaaaaagaaaaacgataagaacccgacagtaggttggcatgaactttggaacaatgacatgaacatatcatatatctcggcaaacagtatagcttgatattagcaagctagactgttaactaacacaagcggtgacagtacatacctatcagttgtcaaatcagcacatgtccagttaggtttagcaagagcatcatggtaaatacggcactcttctttagaccggagccgaaacctcctctccttgccacattccgtacagtgaataaactcatctcggtgtgacaggcgaccattacggcctttgttagaaccattagcagatttgtgagacagcgagtagtatttcagcagagctgtctttgacaatggaaccttctctccttgaaccatgacccacacagtattcctccactttccagcagtctcccttccagagtgtttctcaaaggcagaaggcgtcaacttgtctgcaaatttcaacttacaaaacttaaatggcagttatgcgcttaaaaagcatgataatagttgcaactggcatatattaccaagattttgtacaatgcttgtaatagtactatactagtacaaagatattacttgcatttggatacagtcagaagatagagaaatatgacaacaaagcgatgccatgtacaacatgtaactggaaacagattttcccaaaagaataaagtaaaagcaagtactgcaaagttaacttggaaatacatgcatctacaacatcctttacttaaatagttaaatcaatatagttgcatgcaaacctagagcaatagcatgctgaacaaagaaattcccagctatatatagataaccccacagtgcatgctcccagataaatgggcatgctaataatgcttgaaggccttcattataaattatcacaaaaaaaaaaagaactgcatattttaatctagacaatttttctttgttatatcacacttatatctagatttcataatccttgaaaactgaaaggtgcagtggtacataagttacaagatggggtagtcataagttgttgctatatttagctttgcctatgatattatcacttcacacatctctgcagttacatgggtgaaccatgctagaacaagtacaaaccacatttgattaaagcaagactatcttggttcatgtattaaatatgttaaaaacaaatattgtgtgtacctacataccattgcaatcaacactctggggaccattcaaggaggagtataatgtattgtaaaatccacagtgatagcactgatgttatatgcctcaactaaatatacttgcagcacagtacggacacacactgaaatacagacatcggggatagagaaactgaatgcagcatctacagctttcggaaacaaaaaaaatatagccaccaggtaacaacattagaacagagacaacacaacagtaagttttccattccgctctcatcaaacgcaagcatcctatgttggagtcaagatcgcaattatcaatttcacacatttgcataagagagcagcatgcaactacaaaccagaacatggcccaagctagctctcacacgaaagaaaacctcatactaaacagagacgtagcaatgtaatgtgagtgattgaacacagccactgaacagaggggaacctcatcatccccagcatgcagggagtacacaatgtcaaaattcaacttacgtgcattaggtaccacagaagaagaggaacctaatggtcctaaaccaaaggtaagatgcaggcgatattacgctcagatacatcatggacatgtctaaaaaaaaagatacatcatgaacatgcagattgcagaaaaggggatgatttaattgccgaaatcgacagtcccgcgagccagactagcaatgcatgggcaggagcatggtacaaagtacaagaaacaggcgacgctgggcgcaggcagcggcgaggcgcatgagccggcattgcatgcaggtccagtcatgggagcaagacgccacaaccaaagagatcaaacaccacccgtgcaccgacgcgcgcgctgacatgaaatcaagaacaacgagacaaacaagcaagcaagcaaaaaggacgtggtgtactgatgatgcacagtggcgagcacggaccttcgcgacacccgggcgtgcactcgcagctgacctcgaggtcgccggaagcgtagacgcggaggcggcccacggcgtcgccgtagcggtggctggtgcacccgcacgtcacctccacgaaatcctcgcaccggcgcaccccgctgacgtcccgcagctcctcctcgctgaacagcgccgcgccacctccgttcgccgccgcagccatgcctccaaccaagaacagcaaacacaccgcaacaactcaaaataaaacaagcgccagacagcgatctggcctgcgtcaaatcaacaagcgactaagcaacgatcaaatgccgagacgggggatgccgaaaaccggtggatggatcgaagtaaaacaaagttaggcaggcgcgcaggcgtatgtgaacaagatagtcagagagatagatatatagggagaggagcggcgcgggagcgagcggtggggggaaacaggagccaaagcggcgcctttccacacaaggagaagtgagaaccgcgagcgaattgggttcccacttcccaccaaatcttgacgagggcgatctcccaaggggccaaaagaataaatgcaaaggcggctccttttttttccttgcggggatatgtgatcccaggccaggaacaacgagcagagaaggcagcaggagcttcgcaaaggcggctcctttctgcgatttgggagggctttctttgctcctccaaatcgcccgaagaaacgatccaaaaaagatggatctggggaagcgaccacgccggattcaagaatgcctcaacgccgccagcacccccagctgctgcctatagctatggagggtttggagagggagagggggagactggtggaggcggagagagagaagagaggagagtaggggaagaggagaggataggaggcggagccaagagctgccgagacgaaagcttgatggttgcgcttggtgctgggctttttaacctatagacggatggggggatggtgatgtcctgtgtttgttgtgtgaccttgttttttgcgtttcttctctgcaagacccttcaaactttctcgttattactacgcttccacta

SEQ ID NO: 9833 - DNA, 1314 bp, Oryza sativa
acaaaatggatctttttttctttccaaacaagtgctgttatctggttaattattttattttgccaaatcccactttattagtcaacttgtcattccgatttttagctaaaattttccatccttgtagtccatgttttgttggccagttatattagtcgagttatggctaaggcagcattccttaggagaataaaggaaaaaatatctctcattgtccactcgtacgcttctcaaatgattaaacgggacgtttttcctaaaaaagaatttctatataaaagttgctttaaaaatcatatcaaactattttttaagctcaaataatcatatgttaatggtttatcttgttttacgcatcttctcaatcttttcatttcccctccttccaaacacacctaagtcaaataaccctatggatttttgtgcgcttatataccacttctacttttttttaccgaatgaactaaccaatgtctggatgaatttagtattattgttccactggataaaagaaaattcaattggaacaacttatgttccaaaaccacgaatgcattcccggcgcttatgtgaagcaaaaggaaataagaaacaccacatgtatctagaaatatatagtagtactagtaattactttgtcctaaaatataaaatttaatattaaatatgcatttgaacagctataaaatataatgtgtaatcgtagttttttatattttggaacaaaagtagtttatgttttggaacaaactgcaggggtgaaacgcaaaaactgcctctacggcctccggcctccgcgtcgtatctgcgaggacgaggcgtggcggtagggggaggtctcggattccggctcccggcctccctctatgcagtttgcaccgcacccggatgcgaaacgtggcccgagcctccgcctacaccgacccgcggggccctcggttcgtcgcgtggggtccaccgagcagtggcagaatcaccggccgcggggccccgtcatgggagaagccgctttttttttttttttttggatgggagaagccgctgatacgctgggtgaagccgtggagggggcacacggagaacactctctcgaaccctccctcgcctgctacagtaaaattcccctttctcgacccctcttcctcctcgattccggcggcctcgtcgccggtgacgggagggagaggggtcgtccccctcccctagtttagtatagtagtcgggctagtctcgttaggtcgggtttttcccgtttctcgtttctatggcgatggaagttgaagacggtggcggtggcgcgattgaggccggtga

SEQ ID NO: 9834 - DNA, 7237 bp, Oryza sativa
  unsure (1)..(7237): unsure at all n locations
gcggaccagctccacggcaacggcggcggctcgaacgcggcccgtggcgacggcgacggcgcggatccagtccgcggcggcgccggcggctcggacgctgcccgtggcgacggcggcggcgcggatccagtccgcggcggcgccggcggctcggacgctgcccgtggcgacggcggtggcgcggatcctgtccgcggcggcgccggcggctcggacgctgcctgtggcgtctgcggcggcgcggatccagtccgcagcggcggcagcggctcggtcgcggcccgtggtgacggcggcgtcgccgatccagtctgtagcggcggcgatggtgtggacgcggcctgcggcgacagtggcggcgcgagggctgtctcccacgtcgttgcttccagttgctttcagttgtgtcgttgtttcatggtgcaggccatctctttctcagccatctccatcatctcagcaggacagaagctgatttgcagccattcaagtgcttcttccttgaaggttggctgttcttcggattcatctatcctgttgttccctaacagaagaaaccatgtagggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgatgttaggttatttcaggaaggttgctttcgtagttcagttaaccctcctttcttaaggatggctcttttgcttggatatgtaatggggtttattccctagatctgttcctgcttaataaagttgatgtgttttcaaaaaaaaaaaaaaaagccgtggagtggaggagagaggaggccatttctgggaaaagggaaaaggcctgtggcgcgcgggccccgcgggcgctgaggctgacgaggaggagggttggctggcggtgtggacgtttgtttacgaaaggcgcctgcacccggcgtgttgcagcgcagcgcagctgcggctgcagcatatgactcgtgtgacatcacgagccaggttgttttcgtcgcgttcctcgcatgcagtgcaggcttttgctagcagcttcccccgccgtctcgcgcacgggagtttcgccgggcgcgcggcccggccggccggctggctcgatcgtcttctgcgccgagcgcctctccatcccgcgggtttccgccgggcgaggaggacgcgcgcggggatcgtgcacgcgagtcgcgcgcggtggagtttgcgcggccaaatcccggtaatcgtgggtgactcggtgcgggtgtgcgtggtgatcgactgatccgcgctagggtaggttggacgtccgcgcgcactcgatgtggtgtgtcacgcattgggggtgtgctttggtgagatcgctgctaacttcctggcacaaaagaaaaatcgtggtagtgagaagtgtaacacgacgtcctaacaagtgtcggaggtagcgcgagctgtaccccttcgtggtagtgatacacggcccaacattgttgtgaccgcattaaatattaacatataatcacagttttactcttatatatgaccaagatgttgtatatacataccacaaagtgcttttgtgaccgcattaataagccagttttactcctatactactccctccgtccccaaaaaagacaaaccctagatttttgtatccaaaggttgaccgtccgtcttatttgataaaattatgaaaaaaaataaaaagacaagttacgcataaaatattaatcatgttttatcatctaacaacaatgaaaatactaattataaaaaaatttcatataagacggacggttaaacgttggacacggaaacacaaagtttatcttttttagacagagggagtatatcagaaagtaaatttagtacttcctccgtttcacaatgtaagtcattctaatatttcccacattcatataaatgttaatgaatctagataaatatatatgtctagatttattagtatcaatatttaatacgagaaatactagaatgacttacattctgaaatggagggagtacgtctgcaaaggctgaatcacgtgcttagatccctgacccctcacgataggagaagctaggcacatagtagtggactttttcatgcatgcatgcagaaggagctggcagggtgaatgaagcaatatcgcatgttcttcatgaatcatgaggcaagataatggaaccagaggactttcaacttgggcagcaaattgatggtattgttattgtgtttcacgctaactcgactatttttttaatgtaatcatttgacatacccttttttttcaaacataatggaatataaatacccaattacgacaaaccggagtgttttttataaaaaaactttaaaaaaaaactacgacaaactggagttcaatccatcaatgatgagctcaaaagcaaggatctgattaaacttactagcagtactactagcttttgactgctaattgtgccgattagagggcaaaacacgtgccaaaacctaacccaataattgggcaggagtttcgttgcggcccggaagcacacacataaagattgattggtcgatcgttcgatctaaacaacccgcaaaagccaggccggagaagagagcgacgccccgggccgccacaacccgacgcgtagccgctctctcgcccacccgcgcccactggggcgttgctatagctgccaactcgaaaacaccccgcgagtcgccaactcgccaccgcgccgcaagccacaacagacactgtacatcattaacaaccccccggatgcggcgcccccctcccccatctccaaacggcgttgcgcgccgcagaaaaaatttcggcggagccgccacgccacgcgccgcgtccaaccgcgtgcaagaaaaaacacacgtccacttctgtcgatccgtggcgaattcgtcacgtacaccgctcggcttttcaccatcggcacttggaagttgaaagtgcacgcacctcctgctagcttggagctggagggctggaggctgcaacgaggggcatcagcatcggtcctgcttcttcagatcatgtgaacggtttattctctccggtgcttaagtcaatgctttttattctacaccaaaccaactaccagatgctgacacgttttacttctactgctcctacgtactcctacctgttcttggcacaatcaatgactgagtcagtcgaccattcgacctatcgccgagacctgttctccctaatcaagtccatgactgcgattcgttttcggtatcccacataaacaaaccggcctagattccacaccggcaccgcgatgtgaataaacaaaatcatcattgcgcgaaactcagtagctaagagcacccgcaatggtaaagtaatgtgctatctataaaacatgtacatctcagcaatagactagattaatagtaaaccatctcaatagtatgtctacatgggtatctatagctctttaatacattgcctcgtttttctctatagactatctccagattagtagatagctttgctctctctcttcatttaatctcttccaagtagaaaaatatgctgacatagatctcttatagagagtctatagataaccattgtgggtgtcctaagagcacccgcaatggtaaagtaaggtgctatctataaaacaaaacatgtacatctcagcaatagactagattaatagtaaaccacttcaatggtatgtctacatgggtatctatagctctctaatgcattgcctcgtttttctctatagactatctccaagttagtagatagctttactctctctcttcatttaatctcttccaagtaggaaaatatgctgacatggatctcttgtagagagcctatagataaccattgtgggtgccctaatacttgccatcggttatccaactcgttaacctagaagggcctgattgtgatgtccgtgagattgtcggtaaggcaaccaggcaactaggcagccgtttcctgggtctcgacaaaatcgagcggcggcagcagcccgaccgcgagaatcaaacaaaactcaacaacttgcatgctttagcttgcgcgatgcccagtactaatattgtccggcttcgctgacagtatacgggtgtccaggcctcgaagtccacacgtttcagcctctaaatggatgggaactgtcaatttggtgaaccatgggctttggctgtatgtgaaccagtccaacgccgacggcctaggcctctttgctgccttgaacattttaggccttctgggccagagtgattatatcattttaggcccccccccctttttttttttgccagagctatttggtcattagaactccagcactgtaattttgccgtgccataaacttgagaatgggatgtgtagtgtactaatacttactgttgatcttaaggctgtgttctttggtgtgcttgggaacaaatcccatgcaaaaaaaaaagaagtggtagattggtgaatggttaattaaataatagcttcaaaaacttaaaaatagattaatataatttttaaaagcaatttctctattattttttaaaaaaacacactgtttaacggtttgggaaacgtgtgtatgtgaaacgagcgtgtggagattaggaaccaccccacaaacgaactcagcctaagccgagttgttagcattgtccattaaaatctaatagtgtggcccgcgcaattacatggctagcgcctatataactatttttttacacataattttctttaaaatttactacctccatcctagaatataacaagctttagagttgaatacgattattaagaaaatagatagaattaaataggaaaatgttgtgattggttgagaagttgaggtacgtggaaaaagtgaatggcagagggttgtgataggttgggaatggaatgttgatgaagaagttcttatacttttggacaaatccagagcattaaaaattgttatattttggtacgaagggagcattacatagtcatctcgttcttaggattttaaaaataacaatttaaatttgagtaaattgtatattgggcctatatatttttaccagtgttacaccttggaccagagacaatctaacttttccgctatgaaccacttaattttacaatcggcttcagtttggacctctgtttcctcaagttccctctccctagtccctccccacttctccatgttgcagggacatcaccggtgaaaacctcatccgaccggcaccactgctccactcaatatcggccttcacatcgagcctccgtagcactgacgcgttcgacctcgagtcccaccagtatcggcgccggcgcaataacacccttcagccaagctagcaccacctgtgccccatggctttggcccctatcttgagctcgagctcgaccggtcgatatcatgctccatctctagctccgccagtgttgatgcaacgagcgcttgagctcaagttccatctttatccctgcaatggccaaggtcaatggagatttttttttgtgctttctttctaagctcaagtgcaaatatgtgtgggggagatattgagatgccactcaagagcgatgccggcgagctccgacgtgagcgttgtggcagtggcggttgagcgttactcgacctgctcatggtggttcctagcgtgaggaaggagagagggaaagttggaggtagaatagcatgcccatggtgaaatatttggtattttttcctagcccaacttgaaaatgtcagcttacccccggtccaaagtacaatagtggtaaaaaaaatatggcccaatatacaatttagtttttttaattttatagtttttaaaagttacanataanntcccctctactccttttcgtttgcctcctattttcgagtcacataacaataacaattcagtaaacatactcacgagaaatgaggtaatagtcagattggagaaaaacttaaggccccattgacttacctttttggattgactacttcattgttctatgtgagcacgttttctaaacggttagttttctttaagttccttttcaagttctattaaataaataaatacactttacggtagttaatattcacagtatgatgaatccgaaccaaaactttctatattttgggacggagggaggagggagtattaatatttagggcatgtttactgtgctactattttcaaccttaacaagttttggcattgccaaatttcgataaggttaccaaaattttggtaaatttgtcaaattttcgcaagatttcatatgtacttactaaaatttggcaacaaactaaatgcagctacttttttttataacttaaaaaaaaggtaaagttaaaaatggtaacaaagtgaacaagctcttaaattatacattaatgatttagctcgtcttaggtgcggtggaacagctgagcttaaccgcaaagcctgtttctattgagaggacgcaaaaactgcagtggaagaaacgaacgacagaagctgccgtgcaattcgtagttgcgtttggttctcgtcgagaggtcgagtaataactttggaagaaaggcaaaacaaacgcgttgggcttaacacagtcttacacagatcgcttcacttttacacgaagcccctcgcaattcttcgacctcctaaactcccccatcgcgatccctctcctcctcctctttccccaatctcgcgcgacgcggcggaaccctagcccccaccgcgattcgctcgccggagagggagagggagggaagggaggctaggggaccccctcgccggcggcggagatggaggtgaagctgtggaacgacaagcgggagcgggagctcctggagagcctcgccgacctgtacgccatcatcaaggcgacggagaagctggagcgcgcctacgtccgcgacctcgtctccgccgccgactacgaggccgagtgcctcaagctcatctcccagttcaactccctctcctcctcgctcgccggcgtcgtcaccatcccccggttcgtcgaggcctaccgcctcgactgccctgacgccctcaaccgcctcgttcagtccggcgtccccgccaccgtcgagctccgcgccg

SEQ ID NO: 9835 - DNA, 1714 bp, Oryza sativa
aggtatgtgtaacttgaattgtgctatattatttgtcaataatagtgccaattttgtggtaacacatgctgttataatgagttctgtggcctattggttatatatattgtaccgttccggattctcacttcgtgagattacctgatccttatacgaattatctgaatgattgcgctcatgcttacgttcttgccttttgtagctattgcatcgcaaagttttcatcttgtaccaagctggtgcctggttcatctattgggtttcataaaaaatttctggcagctagcaataataggaaataacacaaactgttttgagcaatagctccaatgggctctttggaacatatagtggttataatacacgaagtgctggttttcctacctactaatatacagttagattgcaatctgcaatattattttggtaatggatatatcctttgtttacagccattacatgtttcagtttttttactggtcttcactaagcaacttttgctgcttagttgtcacctgcatcagaaggcagagaataacttaactttacatgagataggtgagcccaattttattgaaacaatattttccacttgcaattttgtattcagattaactaaaggttgtccccaatattttctcttctcagtatagctttcagaggtgaaaagagaaaaaggagaaataaaaggaggtagcagatcactctgcatttcaagttgctgacctagcctaatcaacatgtcaaatgtcagacgtgtattgagtttgatgtactaaccactacaacttattgaataagtatgaattgggttttttaccattaacatttaactgctgcaatggataagtacaaatgaggatatttagtattaacatattactatcttttatagacacttgtatcagtctatctccattacaggtgtaacttctgttggtttgttgatatcacaaaaggtaaaagaaaaagtcgccttaactataagtctgtaactgtacaatatggcatatggttcaggtaatatatctgtaaagctttacaaaatatctccaaataccaatctaatttgttgtccagaatttaatcttactaaaggatatcttaatgactgataggagttaggactttatccaatttggtatgttttctggagctatataaatttagataattgcttatggaacaagttttctgtagtagtagatgttgttcaaatgatctgcagtgctctacgagtaaatggctttgttctttatttttgctaataaggggttgaaagcatggctgcaccagtactttctttgaaatttaaaggacatgaacgcatttgtggtactcaacagtttgattctctaatttgactcggtctcattatgcaattgttgtaaattgggcatgacccaagctgtataaaaagagaaggcaactcgccatcatgtactttttgtttattatcccccagtgcagaatatatacttcattcccgaacatttgagtcatctactatcttgcaatatcactcttcctctccctccagctcttttgacttgagcgcaatcctctccattccactctccgcaagcagtcccatgtgagttatccatataaacctaagtctgctcatcttttatatttgcaaccctcgtgtttcttaaataaagtgttgattgttcactgttagtctatcatctaccccaaaggtttggttgtt

SEQ ID NO: 9836 - DNA, 603 bp, Oryza sativa
  unsure (1)..(603): unsure at all n locations
cacttcacttagagaattgagcttaacaaacattatgactttaactacgcttccatcggaagaggtcctccaacatctggccaatctcaatttcttggccattcgttcctgttggtgtatcagatcgttggggggcttgcgagctgtctctattaaagaaatgagattgttttcctgcccttctttagagttggcatgtggcgcagagtttataccattgtcccttaggagactatgtatatacaggtgcgttgttggagccgacttcttctgtggtgattggccgcagatgagggaaattctcttatgccagtgcagaagctctgcgtccttgcatgttggtggcctaacctcccttgaattattcgcactatatcacttgccagatttgtgcgtgctggaagtctcgtcatcccctcgacttcaccaggtgcatttgataaatgttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9837 - DNA, 17564 bp, Oryza sativa
tgtaggatgacatgcagccccaaaataatcgtaatatactcagctcttgtttctgatggagattggcttctttcgcgttcgatgtactctttatttttctcaaattgtacagccccaacatattggtaaggtatctcaactgtttgagctcctcaattcccctgccagcatcggtgtccacgacaaacgttgttagtgtcaatagattgttcagtagactaaaatttgggggcatccgttttaatctatcgcatcccaacagataaaggtggttgagtttccttagatttgccatgccttcaggtaaacattctagatagctgcagccattgagcctcagtgattgtaagttatacaatgcacatattgaatctggcagtctatgtatattagacctagaaaggtcaagatatcataattgttttgtatttatgagatggctagtgataatagaagaatcgtacctacagtgacaccacagtcctctcaacgacctcagttttaacctttctaagaaaaatgacctcagttccaacacttcaagacccctgtataatggtaattccatcaacaaagtgcggagagatgttgtacctttgaatgatccactgatttgttttaattcaccttctgatatttgcacatgccaaacatcttcagatggtgctttctgttgaatcagttcttctgtagttgcacattcacttgaaacgtcttttgctaagtcatgcattaaatcatgcattttacatacaacaaagtcataatctaagcttctgaataatattgttttaacatcttgaagaaatgatctccaaaccaactcattgaaaacaaactcgcctttttgtgacaactcaattgtgccctcttcttgaataaaaccatttgctatccatagttggatcaacatgtccttctccatctcatagtccttgcagaaaattgcacagaaggtgaagcattgtttcatttcagatggcaagtgtttgtagctcaattttagtattgataagatttcgtcttttcctttgacactatcaccaatattacttcttgcgatggcttcccattccttgacttggtgtttggaactcattagaccgcccatcgtcttcagagcaagtggcagccccttgcatttatgtacaatacatttgccaatggtgaccaaatcttcttgctcttgtacgtctctaccaaacgctctcttcgagaacaattcccatgattcatcttcacttagacatgctggcttatagggttgaagggtttccattatagatgccacccgccgattgcgagttgtgatgactataatgctccctggacccccgacagaattcagaagtggccttaggtgttcattccacttgttgtcgtcctcattccatacatcatcaagaacaagtagaaaccttttcctgtcaatgactccttcaagtcgccttcgcaacaactcaattgagtcaggtaggtcacattttctatttgtagccaactcaatgatggatttcacaatagaaataggttcaaagttctccgaaacacagtgccacatcttcagttggaaatgtttctggacaatcggatcgttgtacaccatcttcgcaagcgttgtcttgcccaaaccgcccatccccacgatggggagaacctgcaaattctgttgatcatgctgatccagcatcagtttaaccaacacctccttgtcatgctctcgcccaaatatgtctgctgactcgtccagccccgagtgtgttagccgataaggaagctgtggcgcctctgtgtgctccatcaggccaaacttgttcatctcttcaaccagatcgttgatcttcttgaggacatcgcccagcttcctactcatggtaacacggaacaggagtgggctatgcggcgtgaagtagccgagtaccttgcgggtggtggagtcgccgatcttgacctcgcggcgcagagcctcgtactcgaagtcgtcgaggacgtcgtcggcctcgtaggcgacagccttgaggtccttcatccagcgcttgacggcggggttggtctcgcttagggttgtaagtggctaacccgtgaaacccacttataggctaaaataagccgcgagcccgcttattttgacctataagtaggttcgcggctgacccacttacacccttagtctcgctcttcgccttggcatcggccagcttgcactggacggccagaagctggcgctccagcttgcggcggtcgccgtcgacgccgcacacgcgcgtgacgctctggacgagcgcgttcgccgccttgccagccaccccgcgcaccaccgggaagcgattccgccatgttgcgttctcagctgcaaagcacggtggaatgaatgaagatgaaaggcaaagcatgaagcgctctgggcactctggtccgtaattcaagtgggcatgtttggcccgtatgagtataatatggagaaaatttacaacttgacttacttttgcgtccttctcaaaaaaaaaaaagactaacttttgcgtagtgcattcatgtcgtggaatccaccagtttggttggcagtttcgttgaaatctcctcggccctcgccgtcttttcttatcagcaaaaacatactttgctgaaacaaactggcacggcagtcggcaaatcctgggcttcgaatatgatcctgttgagacgaatgcatcagaattcagaatagcaaaggccaaattttgacaaagtctggatgaaatatttgctaaacatacttccaacgaacaaatcccaaacaaacatgacgaattctcccaaaaaaaaacagagcacgaaaccaaccatttccatgggaatacccaataacgagaacctttacatctcaaaccacttgggtcagatataatcagcaacaagtttcagtaaggcggaaacattttcatcacaatatgccgtagtaccttccaactcaagttacttggtcagagaggttctcaaaagctagattcagtagaatcacttcatcaaaactaagaacgagaaggcgggtaggaaaacagattctgctatttcataatctgagcatgaacactctattaagctttcagaaataaaggtacaatcggctaggctattacaaaactgacaaggtataacggatccatcccttgcacatgaattacgactgggcataggttctgcactaattcaacttctcaattaattcattgattttatcttcgcggttccctgagtcaccaccatccttgaagggtttcttcttcatctgcaacctcctctctggacacttgagcttgaagggcatgaggaaatttgaagcttctctgaagtgtgggccaactgatgcgatttcatgcacaagatcttccaaacatatgatgccatattctcccagagcctgttttcagaaaaaaagcacagatgggtatatttcagtgtacattaccaaaccatgagattgtcttcaacatcgaaaactgaaaccaaatatccttttgttttatttagagactgatgaaaatgtatcttatgtctgggaaattatacataaccgagatgataatcaacacacaaaaaaaagcataaccacagtgatttttacacttgtggaaggagacagaaatagctctaccaaagcagtgcatgcaacaatggaattgatcctaaatgaagtattgtagcatgccaaatttgaggtccagaacccaacaaaactattagccgagattaaagaatcaggtttcagacagcgctacacctagtggttttatataaactatatctccaaaataagccagcccaattcccatgctcattgcaaaatagcctgttgtagacaaatttactaatgccgtgcaacctcaagttttataaggtgtaacaaaacaataccttctcaatgagatcattgctggtaagagggaaaggttccttgtccaggaacccacggcccttcttgtaaataagatccttcacattcttcaaatttgggaacctatattacacaacaataaataaaatttcagcactgcaagctacagatggacaaatcaatatgtttttgtacaaaagaactgttaatagagaagcatgtttgagttcagttacccataagtgataaacggctccacaacaagaagcctcttcatagtagcgtcagtggccttgaggaacacgccggtgaggacctgcgtcagccgcagcttgcgcaaaatcctcctcatgtgtggatgcaagtccattgtgctgcagattacacacaaacaaaattgttaaaattgtgaaccgcaatcatcaccaatgaaaagagacaaaccttgcagaaacaaaaacaagaactcctcatcacttgtactgctgctaaaatacagtaataatactgacccagggatgcgaatcgcgaagacgagcttggagttgagggtctcggcgggggggagcttgcggaccttgaggcgggtcttcatccggacgaagtcgagctccttgttgcggaactccctgacgaagtcctcgggcctcttgatggcgcccttgccgtcgtcgcggcggcgctgcctcttggccgccttccgctcccggttcttgaccgcccagtcctcgttcaccttccgcttcttcagcaccgtctcccgcacgtacggcagctgctgcgtcccctcctccgccatcatcgtcgccgctatctctacgcaagcttcgccctggacgacggcggcggcggcggaacgacgcgagggagaagggtttcggggatcggcggtgtctgggtctcaccgtcttattatggccttttcatctcttactgggccgggctcacgaaagtttaggcccattaatgatgtgtggcccagttgtagtgggcctgttgggctttttcttgctggttggtgtggcccagttgtagtgccggtcaggttgggtcggcggcgatgacacgtacaagaacagtcgtcgtgactcaagacgacgactcactcaaaggcagcggcggcgagccacgcctccgccgctctctcctgctcttcagtcggcgggcgatcgccggcggctcttccggcgaactcgcgagtcgcccccccccacctcccctctagcctgtactaaggaaggtatgtcatgtgaggggtggtctatggtcgccgccgcgccatggccacgagcttttcgtgttgattctagaaggtgcgcttattttctgagtggaatggcgaataagtgcactcggtgatgtcctgtgatttagttgtgcttggaattttgggtgtactgaatactgatgcttatgttcttcttgctgtgtcattcaggcttgtaataatttattggattttgataatttattcgtgcaatatggttcgcggttctgttgatgtggcaatcaaggagatggaggctttatgtatcggacaaaatcaagaaaccaaagtaggtgtgctgcactagtttcatctttggcgtgaattaaattgttttgtgcactaagcaatactgctgcccatgctttgcactaccatgttccataggtgataccgtgataatagatgtgtaacttttgaaaattgggtgccagacaatgatgcgaatgccgtttagaattaacctgttattcagtgtttgcagtgttctcatttattgatattgttagtttggttatgttcatagtttaccttaatatatccttgtaagttgttaccaatggcctgtttgctaatcttttttgttagagatcagaggtaccatttccataccaggagtttgaaagctatatgtatgatttcaatactccacctaatagtaaatgacatttggtttctaggatagctgaacctctcatggcttccatcttttcattggtccttggctcattgcctttctataaatttactttctattaagttaacattattattacttctttggctgcaggaggaagtcggttttgaaacacaggaggcctcattaaaagcaagcaaagttgcagatagcaaaggagctccgtactcaccaccagaaaatgatgatgatgcagaagtggactatccgtctcaagatggagcacaaggtgacaactctgacttgcaagctcttattgctgagttcctcagctagagttgaagcttttgcaattctctttagcacttgctattaaataatctcattccaagttaaaataatctcattgcaaggaacagtaatagctgccaagaagaaaaagaagaaaagcaaagcgaagtaagtttatgttaaattaagccattactgttccttttctttttagaaccatgctttaatttatttattctgtagaaagaagaagggacctcttcagcagacagatcctccatcgatccctgttgatgaactcttcccatcaggagaatttcctgagggtgagatccaacactataaggatgagtaagtatgcatttatcctcataaaatttgtttttttttacgcaatcctcataaaatttgtatataatagcaaacctggcacactaatttcttagccattttcacctctaaaaattcctaatggcaaattcaatggactgtaataacagtgagcatatgtttgcataaattaattgtgctattgctcatcagtaacttatggaggacaactagtgaagaaaagcgggaactggaaagattgcaaaagccaatgtacaatgctgttcgtcgggcagcagaagttcatagacaggtttaaaatttattgatatctttgaatatttgcgaattcatttgaatatgctctatatgttacaactctgaaacatatgttgtggtttgctaggtccggaagtatatgagaagcattttgaagcccgggatgctaatgattgatctatgtgaaactttggaaaacatggtcaggaaacttatcaaggagaatggattggaagctggtattgcctttccaacaggatgctccttgaattggtacggtattccagtattttacatttagtacttcgtaagttccttactctgcattcccttatgaaactaacgaaaacaaaaatgcaatgcttagtgttgcagctcactggactccaaatggtggtgataaaactgtactacaatatgatgatgtgatgaagctggattttgggacacatataaatggtatgtatattgtttgttatacgcgtcagagttttttgtggctttgtccttgaaagtataaagtcacaccttttctactgccaaaaataatttggtatttcgattcttctcagggtacatagttgatagcgcattcactgttgcattcaatcccatgtttgatccattgcttcaagcatcaagagatgccacaaatgctggtgttaaggtaattctctacacttttctgtgcattttctgaagccctcaatatagcaaatcaatgggcttggaaatggccccttaagaaaacacctttgtcatgtcacttgttaagggcttgttttaacggaatccattcatagttgttcattaaactgttagtcaaattgttgtgtagcatttatacagtttttttggctagttattgcatggtgttcttcactactgatttgatggatgtataatgaatctattgttttattttctctaaattgtaatagaatctaccattgtacttcagtagtgttttggttgttcccttcattttaggaagctggaatagatgcacggctatgtgatgttggcgcagcaattcaagaagtcatggaatcatatgaggttgaaattaatggaaaagtattccaaggttagtgctagtgcatctttttcccatttcacactggtaacgtaaagtgataagttgacaacgcaaattaaattattgctatgcggcagtaaaaagtgtgcggaacctcaatggacacggcattgggccataccaaatccattttgggaaatcagttccagttgtgaaaggtggtgaacaaacaaagatggaggagggggaattttatgccattgaaacttttggatctacaggtatgtcaatctatagcttaggttgtcacattactaatagttgaaattcagttttgcatcaaatataacaagtaactactaatatgaccctccttggctaaagtgtagaagttttcaagtgttgaaattatctttttttaaataatgtatatcaatccggcctctatatgttgaagttcttgaagaattttatgcttactgtctgtcataatgtttgcaggaaagggatatgtcagggaagacttagaatgcagccattatatgaagaactttgatgttggccatgtacctttgagggcagcaaaagctaagcaactacttgtgacgataaacaacaatttcggaacacttgccttctgccggaggtatctggaccggcttggtgagaccaagtacctcatggcactgaaaaatctgtgcgatgctggcattgttgaggtatgtatagaagtccattctctactccaatattgttgtaggccttgccataaccatattcgtggttgctcatagttgtatgctttaattgttggcagccatgtcctccaatgtgtgatgtgaggggaagctatgtgtcacaatctgaacacaccattttgctccggccaacctgcaaggaagtcatatccagaggtgatgattattgattgcaatggctgtccctcttgtactggttttgtgagatcattgctcgccattttttattttgggaaacctgtatacactgttgtatgtatcatatgatatcactatcataagataaataatgtgcagtaagcaccgtttgttgctgctgctgcttaccacttggcagttggtactctttaaataatttttagtggaagcttgatactatttcgaagcatagtcttcattttgctggaaatgtgccaatctgttgtattttggtttattggtatgtaggattaccatctaattctgatatgttggcaaaaagtaatagagtttccagagaaaaatgcaatagcaaatttacaatagaagagaagaagcttgaaagaggaggcccatattaaagcccatgaacgaaagcttagcccatctaattggagcccttctatgcctaggcccacctgcagcgagtgatgggggcatctcctgaaaactcgcgcgcatttaactaagggttaccagctcaatataaagtgtgtcttccctccccgccgccgccgcctcgtcgtcgccgctgccgccgccgccgcggccgcgcgagaggaacatccgttggctctagggactcgcgtggaagatggtaactattccttctgatccttccccttctccctagcgtagccggtttctaccgccaaagtgcgggtaggtgttactcatgccagatcggtctcaagatccgggatggtgtgaaggagagctgcgtttgatcttgctttgtgcggcatgtagcttggatattacgctgctgaggagatgccgctttgtctgtggcactctgttccgttatggtgacaggaatgtgggaggagattttgagttggctgttgcttcagtttatgatgttccgtaactttcctgtaaatctgtaattggttgatatgtgccacttgttattctattgctaggttcaatttgaggaacgagtgcttggtagtttttgcttgcagtggttgcccatcgctaccgtgttccgttttctattactccctccgtttcataatgtaagactttctagcactgcctgcatttatatagatgttaatgaatctagacatatattttagattcattaacatctatatgaatatgggcagtgctagaaagtcttacaatttaaaacggaggaagtaataattttatcaggctctgaagtttagttcatcccagattactgtaatatagcaattgttaagtggtatattgactggaaatgaattccaggttgtgtaatctacacccgtttacctagtttgtaggtaggatttctgtatgctcaccaggactagttatgttttcccaatatccctgtcatggaacatttattttcttcatgctactgcttgcgtggtttccttgatgtgcatgtaaatttcaaatgtgatatgatgctagaatggagccgattaatttgttatctactgtcatcctgtgtctaaactctaaactaaacaattattatgattccgtagccaaagcagattcgtgaggtcaaggacttctttctcactgtgagaagaaggatgctcgttcagtgaacatcaagaggagcaaagatgttttcaagttcaaggtcggctgctccaagtacatgtacaccctctgcaccttcgagctgagaaggcaaacaggttgaagcaatttatcccaccaggtttgtaaaaagtggctctagttctgtttagcactatctcatttctgtttgggtatctgagtagtttgtgctggtataaatcttgcttacaattttgttcttcttattgatgggcattctttctctgcaacatgatgctttgttccaatatgtttgttgtttataatgctggtattgcttatatctgttggttgatgtcccagtgacgataaaattttgctccaaagatgattattctctggttttagcttcaagccctctgtcataccattttgacacggatggcttgtggctaaaaccattatcaagaatcatcaatgatggccaataatagctatgagatctgagggacaaccctacagtacaacatattctggtatctcaattctttgttatccttggttcctattgaactggatgtgttattggagatgtcaacacattctggtatctcagttctttgttatccttggtttctcttgaactggatgtgttattggagctgtccccaaggaagataaaaactttgtaccaaatatggatttgcaattagttttagcttcaagccatccttcctaattcatatgatgtgtgtggcttttggttaaaactaggttacgcttttaagttcatcagtgattggcaatagctatgagatccgagggatatgggttatggttttttcagacaaaaaaaaaactattagcagatcaagaaactatttgagctgtcaattctgttttttttttaaaaatagagatgtttttaatgatgtagagattttctttatataaatttctgcatctgataattttgttttcattgatccatgtctgagcgtccaagaggtataaagatacaaaggcaacatcttaatgaagtatccaaggtctttggtgctgagaatgcaaacaagttgaagcaatttctcccaccaggttcacagaaagtgtctggtaagttgatgccctagcgaagataaagttttggtccaaagatgtttggtgtctggttttagcttcaagccttctgtctgaccattttgacaattggatggcttgtggctaaaaccattatcaagaatcatcagtgatggtcaataatagctatgagatccgagggacaactgtacaatataaaatattatgatatttcacctttgttatttgggatgtccccatgaagataaattgtttggacctaagatggatttgcaattagttttagctttaagccatccttttaattcttatgatgcatgtggcttgtcaaaactagttcaatttttaagttcatcagtgatgggcagtagctatgagatttgagggacgtggactatggtcgtttcagacacaaaaggctgtcaccttttgttctctgtctcgttttgtatggtccttcactgttctgaccaagaagctatttgagctgtctgttttgttttgtgaatgcagagttttttttttcatgtaccaaagttttgcatttgatgactttgcattccttggtccaggtttgagcatccaggaggtctgaagacacaaaggcaacatctttagtgtccaagtttctgtctgttagcagttcatgcaatgtgttgaatcttttggactcctaagcaaattagacctgcctgttcttgatctgtaatctccgctttggagaaaaggtgtcttttgccacagttctgtgatgcagattttcagcttattttaacccagcagattttcagcttattttagaaataaactgctttctggataagatttctctcttacagtttacattgcactgaatgaagcttttttttttgtcaaagtaccttctgggatgaaggtgatcaaatgcgatataaaatcgtcctgtgctgctgtcacgtatcaccctgccatatattctgggatctcaatcatggttcatagacgggctacagtgcttcatctttgattctttgtttaacttgtgaatcatgcatggataatataagtagctattaaatccttgattctcactggaagaattgaagctactttggccgtgtttttagtttatttaccggactgtgaaatggattactttgctccatgttttaaaaatatattttcttaaaagtacttcacttagactgcttattttaagctatttattaaatttatttctaaaaactatttaatttattcatatatttaagtagataatccataacaataatctaaggcaaacatcggctattgagagaaatctaactttctctgttttttttcgatgggccggcgaatagctggccgatgtatattaagagtaaaaaagggaatgtacaaggtagcgcggtacgtcaatgcaccaccattatagacataaaaagaaagctaaaatctcacagaatgagttgttacagagtgacatatgaggttaacaagtcgtgcagctatccaagtctctcattcatccgccccaagtcctgcagctatgcaagtctcctgttcatcccccatggaaccgttgccacgatcccttcgaacacccttgtgtttcactctttccaaatcaaccaggttacaaggatcacccccgcatcaatgttttatcgtcaaccttagcaacagatttttgggctgtaagccaccaatcagcaaaatcagccgacggcgctcgcaaaatctgactctgtgatttcttttgtgatgaagttgtactttgggcatgaaaatctttcactatatcgaaatgcacaatttgtaacttcaaactgccatttttcattgtctttgaaaggttaccactttattttattttacaggaggtaaaacaatcctataaactttcagttagtaaagcagcccgatgagatcgacggcgatgttacagtgcgtcgccgtcgtcctgtcgatgtcggccaccggagagaccttcgagcggcggacgatcatgttgtcgcacatgatcccggcgtagtaaccggccagctggtgcctgaccacgtcgaggtacgcgccgccggagctgtaggcgtcgaccgccgcctgggcctcgccggcggcgaggtcgtacatccaccagcactcgagcagcgtcagctcgaggacctggccgtgattctccaggaacttgccgtacacggcggcggcgctggacttcacggtggcggcggcgatgtcgaccgcgatgccggcgagctggtgcacggtggtggccctggcgctccgccggtcggcgctgagcatcttcacgcactcggtgtggttggtgcgcttgcacgtgcgggcgacgaagcgggcgtcgccgacgacggcggaggggagggaggcggcgacggagacgaggacgacgacggcgaggaggacggtgacggcagcagctggtctcgccattgctgaacccaactcagtttgatcgatgaactccttgattaattactctagttcttgtgtttgttgattttgctatgagtgttctagctagtttgtgtatatataggctttgaaaagaatcccaaatataaaaaaactcattaattgaagcatttaatgtttttttcccttagagcaaggtcaatagtatagccaactactgactccaaaacatctatagtcaatctaatagtctattcatacaatagctaactataaaaatatactacatcattaatacctggtcccacctctcatacacacataatatcttggagtccgtgttacagccgactacaaatctgtagcccgctttcttctctcttctctttttttctcgatatatggttatagccagcttatagcctgctattgtacctgctcttatggaatccaaataggagtaatgcctttgagcatccaatttgaggaatttaatactatttggaagaatttagtgtatgtatctttaatgaatttattgccttcaccccctagaaattccaattttcttgaggacttcattgtattttcctcaggaacccaaatgtttgtgtgcatttatttttcgtggaatccaatcttttgctatgaaatttattgtggattttttttctttttgaacccaattatccaaacccaaaccgtgcagaatattaaaaaggtcatatagatagaaagatggtgatttaacattggaagtacacatcttagagggacgtgactatacaggtagtggtagctccatctatgttagaccctatccacatatatttcaaataaaattttctcttaaactactcattcgatcgacgatccgattacaccgttgtgttcgtaataattactccctccgttttttaatagatgatgccattgacttttttttacatgtttgaccattcgtcttattcaaaaaatttacgtaattataatttattttgttatgagttgttttatcactcatagtactttaagtgtgatttatatcttatatatttgcataaaatctttgaataagacaaatgataaaacatgtgagaaaaagtcaacggtgtcatctattaaaaaacggaggcagtaaatctttataacaagatctcacatgattatattttgataaaaaaatataaattacttttataatatatctaaattacttttagatttcactaaattacttcttggatatataaaagtaaattcaataaagcctaaaagtaatttacatatattatagaagtaacttataacaaaaaaataactttaatgcatgcctttttttttattttggacgtgactacacagctagtggtagccggtttgtattccttctagtgtctcatttcaacttgaaaaatgcaatagtatgtatcttttttaatctctttaataacttatatcttttaaatcacatattgtttttaagatatatttatagagagttacttctgaaccatgcaaaagttacttccatttaacattgaagttatttttaaaaattgttaaactttcatgtgttgatctgtgctgattaaatttaatttctagatagtcatatttttatccctacaacaaatttacttctaatgtcgtgacaaagttacttccgttttattttaagttactttttataatatatgtaaattacttttagactttattgaatttacttttatatgtctaagaagtaatttagtcaaacatatgataaaagtaacttacatatgtaataaaagtaatttacaaatataattttatttcatcgtaatataatcatgtaagatcttgttctgaagatttaattgcaatgaacacaattgtgtaattggattgtagatcggataagtaatttgagagaaaattctataaaaaaaaaatagacatgcattgtgtgcactagtaacaactggaccttttctcacgtaactatactagcaacactggaccttctctcacgtactatagcactggaccttttctcacgtatgaatgcatcgctcttttaacactaaatcgagagcgctgtcggtttagattttgcgatcttagagcttatactagttataagtaagattggagctagtagtaaagtataggtaagctctgatccaatattgagcccctgagctttactcctttgcaactatactcctgtgcaaacagttggtgatgattcataactgctgactgaaaatggacgttagatgtctatgatatgatctcgttcagaagcagaactgcagaagcataagggtttgttcggttcatgcatgatcctgccatgatgcatgccatggcatgctcagttcgttgagacacattcagaatatggatggatcaaattgtcagacaactctttttatttaggagtacattttatttccatccaactagatggtttgatatggacacaaaaaatatctgaaactctgtgttgatcgttgttattaatttatctgaaaatcaatacagggatttgatgcacaaatacttgttacaaatttcacaccaagcacaatctatccaaatacaaaaatttggctcatacatagctcattgctaacatctatcatcacttgtacgtaatgggcatccatgtacatcatcggaatttttttccccaatggtttcagaaattacggcgtaggaatgaccagttgagcctcttgatgcgaacgatgcggttgagctcctcgcgaacggagacgagcagcacgtacgcctcacgtgcgccctccacctccacgtccaccacgtgctccaccgtgccggagtcggggtcgtagtagccgccgccgccgtcgaccacccgcacctcgccgccgtcgaccaccgccacctccttctccgtcgtcaccgtgagcagcagcacggccccgtcgtcgtcgacgtactccacgcaccgcaccgcctcgcggacgccgccgccgtcgtggagcgccgccggcaccgtcctctcctccatcagcgggaacacctcgccggcgatctccaggcactcgcgcgcgtcctcctcgtcgtcgtcagggacgaggcggcggcgacaatcctcgcgcgagaagaagagcggcttcccgtcgtactccacgcagtcgcgcacgacgccgccggacgtcgcgacgcgccacctcgtcagctgcggagcgtacagggacgccatggccgcgcgccgccggtgacgccggatcacaccggagaagctaagctaagctaaggatcagcaagtgcaatgcgctctgatcgatggcgacgatgagcttgcgatcgaattgcttgagctctcatcagggccagcatctgaatttatcatgagcaccaaactcagtgtggaattcggagtcggacaccgattccgagacacagtcgatccggcactgccgctcctgtgggacccacataatgtattctcctggagcccatgggcccatgaccagttcagtgccatcttgggcttcgagtttctattctccataggaataagttcatcagaggtcccttaacttatcaacgaatccaattttcgtccttgaccctcaactatcataaccggtgcagataagatccctcggcggtttcgatggtggttttggctaacgtagcgcctacgtggttattttgactcggtcttcatccgacgtggcactgatgtggcgcttaggtggcaattcagtctagaaaaataataaaacctgtgggacccacatgtcagtttcacattcaaaaatatatttaaaaagtgggacccacgtgggccccacatgtcatcctctctgtctatcttttttttttcctttttcattcttttt

SEQ ID NO: 9838 - DNA, 5585 bp, Oryza sativa
cgggagaaaaggcagcacgccccggccgacgggagggagggagaggagcgggaggtggctccggcggctgtgggcggaagaggaaggggcggcgagaggtggccctggttgcggctgccgttgggagaggagacggcgtcgatggtgaggaggacgctcgcggcgctggagacgcggtcgctaggttggtcgaagggtgagaagggagtggcgggggaggtgacgtcggggcgcactagtcacggtcggcgagcgcggcatgcacgtggcggaccggaccgagaaaggcagcggggacgacgacgagaggagatggagcgcgaatcgggacagtagacgcggcggcgtgaccccggtgtcgaggccgatcgaggtcgagtagcgtgaccccggcgtcaaggtgcgcggcgacggcggtcgcgtccccctcacctgccaactcaggatatctggtggtggtggtggccggcgacgtcacactacccggtctaggaggagcggcggcgcgggcggtcgtcatcgccggagttgcgcggaagatggggagttcttgttgttgccggacgggcggcggccggaggcccggagcagagtagcggagcaggccaactttgccgctatggatcgccgcggccacctcctcgctggccatcccactcgaacgccatcttcgtgcgcgctcgccgcgggccactgtttttctttttatctgaccgacatgtgggccccacattttgtttttattttttatttttatattttacttccagtgccacgtcaccgccacgtaggacgaggaccaagtcaaaccggtcacgtaagcgccatatcagccaaaaccaccatcagaaccactgagggacctgctttgcaccggttttgatagttgagggacctgttgtatctggttttttctggttgaaggacgaaaatcgaattaattgacaagttaagggagcttaagtgaacttattccttctccatatattgggccagatgactaaatgggccggacacagactttctttctgctgctctccctgtggtctactggtctcgtcgcagagcagcagcatggcagttggcctgaatgcaacgcagaatgcttactgtactacttgcttattgcagcatattcattcagggtttcagaaattcagtctcagaatgcaaacagttggattctctagaaatttcaggaccaacacatgtaatcatcgatatgaagcataaatcgcattgggttaaagttcaaagtcaaggatcacaaatttgacaacaaatcacggaaactatcaccagttgttcgagcgtagccagtttgcagtgccatatatactgccatctcttgtttccatcagaacctacaagctaggaggagtaccgattaaacttgctttgtaattgcatcccaccaagatatagttatgaattcatgacgaggagcagcacaaggcttgcattgcatggctgcatcatagcttaccatactccataactgttactcctagcccatccatcatgatgcatatgccttgccatgctctcttcagacttcagatcatggattgattcatcgatcgtttcgtcagaaaccttagttccccaaaaaattttcctaaaaacatcacatcgaatttttgacacatgcatagagtattaaatatagatttaaaaaactaattacgcaattagaggaaagattgcgagacgaatcttttgagcctaattattagttcataattagccataagtgttacagtaacccgcatgtgctaatgacggattaattatgctcaaaagattcgtctcgtggtttccaggcgagttatgaaattagttttttcattcgtatccgaaaaccccttccggcatcctgtcaaacatccaatgtgacaccaaaaacatttttttctcgaactaaatatgcccttattttgatttcccatataggattacttcctagtgccattcaagcaacgatcactgttcagtaacagtacatcatgtcgcactctaaaaagcacataatttatctgaaactctgagtagatctgttgtttctttggagtaacagagattcagacaacagaatgatcaatgcagcacttacaggtaggaaaaagattggatttggggggaattgatgcatgcaagatgggagtagataatgctctgttcagaaagtcagaattccatgcccccacgcatgtgacatgtagcaataccaccatccatatccactgcctactcaagtgttcctcatcaactgccattttctccttattagataatggaataatcctatcaacagtccatggaacacagtaatttcacagtacctacctaccatgacaagtcataaatatttctaaaaacattccggtgttccaaatggcacattaaatcctgaattaatgtgcatgatggatcaatgggacagatctagtacatgattaatatttcaaaacaacaaatttatctgatctgtaaaattatactcctactcctgtttatttcgttacggttgtctgcatgcagtgtgatgcttgcctgtcatccagtgattattgcagaagcagcagcagcatcacattcacatcccacgttggcgccgacatcctgtgcagcagccacatgcgcatgccaaaaccgagaggtattaaaaaggagattaacttagcataaatccaagattaaatccgtttttgtatgcgttgagattggtgggaggctggagaaagcacatgctcaccaaaccgtttttcagttaagccacagttgttgtgatgtgtgatgatctatatggaccatccatgcagggctaggctgcagccatccatgcatgcatgaaccaatgcaaatgcttttgataatatgcagatctgaactggttaattatttcccagaaagctactacagcctaacatctctcactctcaccatcatgggtgtcacttggttgctttgctgccagactgaaagttttaactgtccagaaactagaagcagtcgagtctgtctaattactcttgtattttggttatgtacttttgatttagatgtagaggctgggttttaatcaattttctaaaaaaatatatacagaaggtattgtacatatggatcaagtggttttacttaactcatctgaaagaatgaacgaattaagcaggtttgttcttggacagtactacagtgatgccttgcaaattgagcaaaggcaggcaaaacaagtacataaatttccccagattaatggagtgagacagctaatagtactattatggtactgttagtaccttgctgccactaattcgggccattttttatctgactttttgtttcttcgagcacttgggttcagaaccgcatggtttttgtttttcgtttcgagaaaaagtggagctctgttccttgcttttcaagtgaacttctgcaatttccatcctgttctgcttcagaattttatttgtacatacatgaatgtgaaagatatcaaatgtgtacacatgtttgtagtcttgtagagagtatgatcaatgatatcaactagctgctgcattactagaaccacatgcagataaggtcgaactaaaccaaatcaatgataaaattttgagttattaaaactaagtactttggctggtgcaatgatatcgacggctccaatacacgacgacataatacaggcataaaaatactctggcaattagtttaccaaccggcaatgcaaattatacgacagtggttaggagatccctatcaattaatcatcggcagcgactgtattattctgacgcttgaccaaaatgggggctggcctgaacattaatcattttcaggaaaatgtacttatctgaaatctacaaaatatcaatgtgtttggttaaatttaaccctttctataacatggattagttggagtacattacaatctgaagtcaaactggagtactgcagagacagactgtcggtagtccgatttttgattctgcgtacagtcgttgaccaaattagattggaccatttcatggttactgcagtctgcaggagaaagaaaagaacacttgatctgcactcaagcttgggtgcttatcttaagtcacaaccaaccacatcttaatgacctgatgaatatgagatgagcttggtgcttttatgagaaattgacttctcccaggaggtcccaccatgtcagtttctaacccacaaattttgtacaaaaactaaataaattcttgcaaaactcctactattactacaattttcttagacaacagcacacaaaaccttactatatcaaatactctatccgatccaaaatataacaacctaatacaaaataagacacgtcgtactactacgaatctgaacaaaacccttgtctagattaatatttactagtatctttatcttaatttgatcatcccctaaatagagggcatcaagaccaaatacactaatccaacattctgaaattaatcctcatcgatcaaaggtgctccgtcgcttcatgttcaacaagttaattcacactttaaatgttgtatgggttgaactaatagaaatcaatcttgatttgttgtatgcatgtggggcattcacaatgcacatgtactctttacacaaataaaaaaagaagcaatttattaaataattattattttgaaaacatcttagatgatgattaaactgggatgaagggagtagaatatactcctatctctacttcgggtgttatattttaggttggaggaaatagagcttaagcttgtaatatgctccctctatcataaattgtttagaacacgatttttcttttgctttaaatccaagtatgccaggaaatatcgatgatcgatattttgaaagagcaatcgaatctcgttctaaaggtcggatatttatgacgtgtattagggcttttgcattgccattgtttacccaaatgttgtaagcataaaaccatgtcaagattgttttttaacttttgggtgaaaactttcacagttggagcagtaactaaaagaaaaaaaaaaggctttccctttctccaaattgtccttggaactccactttgccccattgaaaacgacgcctgacctcaacaatagcaccacccaggcacccacccactgacttcccgggccccacatgtacaatccctacaatcgagagagagagagagagagagagagagagagagagagctcgaagcttttcccaaataactttgccacagtgcctcctgcttcccccctgtgcttgcagacttgcagcgcagagctcagcgtagcgtgctctcgcctccacactccacaccacaccacagtcgcctctctcctctttcaccgagaagcgaagcgagagagagactggcaccgccgcaagaagccaaccggcgggggagggagaagcagagcaagcggcagaaagaagaatcattggttaggctctgcagaggagaggcggcactgcactggaggtgagaggctgagaacgagaggtagaagaagaatcgggagaaggatcgtcttcacgggaggagcaaggaggggataattaggctcggattgccatta

SEQ ID NO: 9839 - DNA, 6663 bp, Oryza sativa
cacattgtagcctttcagtaacatttgaattcatgtttgatcctttattgcccatcttttttttttccaaagttactaatctttgctggctcttttgttatcagactccaagacgcaaaccactagtagaagagaagccattgcataaggatgacagtaagattcagactcctccaaggaagagctcagcaagtgccccttcagatgattctgagaaaatagtgaataagccttcttctcctttgaggaggacgtctggagtttcaagcaacacaaatattacaaatctagtgaagattgcttcaaacagcaaaaagttgacagatgctagcgcttcatggacatcacttcctccttcacttgctaaattagggaaggtatgaatatgctcattcacatgttcgcataggttggctcattgatgtgttcactatggctgtttgctacaataggtctagcattgcaaaaccttttgcaattttgagggtgctaatttaatttttgtctttgcacaaatatatacttaacaaaagaaacgatggacaagccctgttttactatgtgaaatgatggctccagttcccctgggcatcaacaaagcaattttactataccattttagtcatactgtccagaggattgaaggatgaaagaattggagatcatttttctctgtagctgttgaatgcttcattaatgtcatattgaatatttaattgcatccaacttttcacaggagcttctgaagtacagggatgcagcacaaatggctgctgttgaagctatgcaggaagcttctgctgcagagaacttgcttcgatgtttaaggtaattttttcactgacatatcctttgtgatgttgcaactacaaaatctataatcagcaccatttcaaggtattgccaactcctgatatttcaatgatattgaattgtttctcttgagctattccttgacttcttagtctgatactgatactacctaagtactaaccattagtatttatttccaaattgtgttttgtatgcatagccgtatgcatgtgcatcatcgctgtagttattttgagaaattttgttaactttaaggtgaaaattcttcaagtcaactgcttgcgccacactatgctcattaacttgtttccagcctaaatatgtccttatggtgtgcgtaatatgtgcagctgatatgatctgccttggattttcttttttgtacttagttcaaatttgaacccaaagccaaagatttgaatccaagccctccctatccaaacagggccttgaggattttgttgcctgtcctagcatgttgtatgcttacaacaagcaattttatggataagtttcaagtcccacatggcatctaattattaacatggttgataatcgatggctctcttgatgtttatatcacatgggttctaaaataatcgatgaccaatcggcgtcaggtcgaaatacctcagctatagctgtcaagcaagttgcaatgatattaccaaccaccaattagctccctctccttttgatccatacaaaggcttgattatgtctgcacatgcttggaatttagatttcggattgagcttgtgttcctgagtgctctacggacagattgaacaagttcctggagtccatgctagcaatgcatggaacagccagctgttcttgtctgaataaagctaggctgtatagtgtttatcttctcaaacagtctgaactgctgattcctgtatcttgacaagcattgccagacaagaactcctaacaattcagtacttgtcactgcaatgtactatgaaataaagtagtttgcactttctgctcacacactggtgcttgcagtgctctgacagttctgtgcctagtcacaactcacaaatagtagtactatggtaatgtcaaatgtgaccttttaatctgatcaaaatgtgtgttttactgatggtcccatcactgttactgaataatgcatggctgattgtacagcacaaaagttcagatttctgcaacctttttaccatgcactgttgtagaatttgtgtactcctccctctgtttcaggttataagacgttttgacttttggtcaaagtcaaactattttaagtttgtagaaaaaagtagtaacatcttcgacccaagacaaatttataatgaaaatatattcaattattgatttcggattgagtttaaagcgtcgtatgacctgaaacggagggagtagttaggaatggtgcatttgttgccgaaacaacaactaagaaatgtcctgtcactgttgtgttgatctgaatgcttatcaaatgagcttttatctgatcaaaatgtgtgagttttactgatggatcattgttactgaatgctgcatacggttacttctacagcgcagaagttcagatttctgcaacatttttaccttgcttgtgtcgttactcgttacgttcgttgcagtaataacagctaagaacttacctttcactgttgtgttgatctggatgcagctcgtacgcggaggtgagctcgacggcggaggagcagaacccgcagccggcggtggagcaattcctggctctccatgcagccatgtcccgcgccaccgtcgtcaccgactcgctgaccaaggccacggcgacctcgacggcgacttcaccggaccgatcaacacccagtgaagccgcagccgtcgacgaggagtcccttgccgtcgcggtggagcgccggcgccgggcagcgtcctgggtgggcgccgggctcgccaccgacctctccgcgttctccctttacaacctcaagccgccacccgccattgctgcctccccgctggccgtcgtgctcgtcgacgagtcggcgagaccggcggcggcgacgaaggcgtcgccgcccgcgaagtcgcggctgttcccgcccaaggtcaaggggagggtgggacccgtcgctgcggcagtggcggcggcgcctgtccctccgccggagtgggagaggggaggcggcgcggaggagaggggcgagctggcgaggcggctgggggaggaggcgagggggtggttcctggcgttcgtcgagcggttcctcgacgccgacgtggccgccgccgccgcgccgtgggatcgcgaccgcgccgccaggatgctcccgcagctgaagcgcgtcaacgactggctcagcgagatagcgaagcccacggaaccgccgccgccgcaatccgacgccgacggcgaggaggccggcggcggcgcccccgccgttgcgaatggaggcggcaacaccgtgccggaggagacgatagagcggctgcggaagaagatctacgagtacctcctcaccaacgtcgactcggccgcctccgtgctgggcggcgccggcgcggcagcgaacgggaagagggtctgagcgacatgggccgtcagatcttgcacgaatctcgaggccagcatggggaggcttaactggcctcgcaaatggggtgagttgtggcccgctttcgagttctatctagaatttctgcattctctaaaagagcattctaaaatctaaatttgatgcggaaaatgaaaaagagaaggtaatttgtaatgataatgatgtatacagtaatacaattgattgtttcgattgttgaaatgaaaaaagaaaatgaaagagtaaattacactcgtaatacagggacaacaacttagcacgcaacccttgtcaattccttagattgtcttcctttcttcactttcccaactcatctctttcatttttcctacgccttttcaaattactaaacgtgtttttttttaaaaaaattatatacgaaagttgtcttaaaaatcatatcaattctttttttaaaaaatagctaatccttaatttattatgtgttaatgcatacattgttttacgtatggataggagggattcccaactcctttcgtttattagaacaaacttttcaactaataaacagatttgctagaaaacttacgcaagttttttttcccatctacacatgttgcgcgtaagattttagtgatagcttgtgtagtagttataacgtaattactgtcgaaacaagattttggcaataataaaagggggtgactatcaagctaagaaagtggatgggtttagagacaaggaattttatacaggtttaggccttcttattcaagaagtaataccctactcttgtccggggatgattccgccgagtgtattattgattgtatgattgggagaaaaaaaatcgtcccgagaggaacctggacccctccttatataggggaagggatccgtattataaagtacagtccatatcctaacggaacatgagattacagataaaatacaatcgtaaccgactaggatcccgagtattttcttaacatacaagtttagaatctaacccgagtcctcataaagatattctatctatatttggtaccatatatccagctggaatgtaaccgccatgtagatatggggtaaccataatcttcacagtagcccccgagaccttcgcagttgaccaaaatagtcttctcgaaacaaaaaacaataatccgagtgcttcaattcaacttgctccggcttgccgagtgctaaaagactgcgaagggcgaaaataaaacatggtgcatcgagtagatgcacctaattaggtgtagcccccgactatgtgattagttgaaaaactaaacatatagtcaagaaccgggtgactttatatcgaagcatgcatggtactcaataaaatacccagccgactacttctcacttgaatatatcaaggataaaaaatatgaaaagggccgaatgataaacactcaaaaggtccaaaaatagatatatttggtaggaatccgagtaagaaactcttaaaatgatccaccaaatatgataaaggtcatggtaattaagaagttcattagcctaggctataacccttaccataatcaaaataagcatataacatgataggagaatgactactaataaaccagtcatctcaaattaacccaatagcttttgtagcctaaaaaagcttacaaaaatggtataacacctttctgtcgggcaccttttcatgtgcatcataataattccaaagaattattgaatcgcgttaaaaaggattttaacagcatcgggccgcgtcattgtgagcacatattgccaaagcaaaaggcacctaagtccctagggatcacaatgggccacgctgaaaacataattgggctgaagtactgtacaggcccaagcccattagtactcccgataccctaaagacaccgaagtccaaacgtcgtttcgtcttccctgccgagactctcgccattccccactccgtgctacagtacagaaccgcaccgacgaagctagggttcatcaatctgctccaacccaccctcaaaaacttcacgaaatttctccccgcgtccaccgctccgattccccattcctctccagccatatctcggaccaaattaaaccatccagttcacattcatggcggaagaaagagaaagcttcgaaagtcagtgggcgccctccgatgtgacagaagataacctgaaggagatggtggcgcatggcgttctcccagcgaaggagattatcgggtggcgaccggcgttcggcgaagcattcccgacccccgacacacacgaaatcgtggtattcgctcatttcttctatggcggattttctcttccaacctctagattcttccgggggattctgaacttctacgggattagcttgcatcacttgaatccaaactccatagtgcatattgccaattttatccatgcctgcgaagcttttctgggcattaggcctcatttcgccttgttccgccgcatcttcttcctcaagccccagccaaacaaaagcaaaccatgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccggtttaccaggacacatggaactcattgcctatgggagatgaagctgctcaggcaatggaattgatggaacgcatgctaaaactgaaagaacaaggtttgcagggagaacagatcactcagcacttcatcaaaagtcgattagctccaatcaaagagaggtcccgcacaacttttgagtttgatggcaagcatgatccaaatcaggaagatccagattctcttgactttaaggtcatgaaagaaagaatgtacaagatcttctcaaacgctattgttgtcagctattcacatctgctgcccgttgtgccattcaacgcattcaaccctcctccaccggtatgcactcaaacatttcaaccttcctcaaaagtatgcttttaccctctgttaagctaattgaaagtttgaaatatcatgcccaggaatttgctttgatgaaatcggatcctccaattgctcaacgccgatcacctcgccagcagactggtcaggcgagtggaggaccaaaaattcgatctgacgctcgaccaagtgcttccgatccactgttgaaataatactaacagcataactcaaactcgtaggaagccgtctgacatagatccttccgaaaagg

SEQ ID NO: 9840 - DNA, 745 bp, Oryza sativa
agggatcggatcgctgatctccaggaatcaaattttgaactgagtggctcatcaaaaggtacgcacaaactctgctcaactgactcatactgttatctttgcaatcttgattaaccgtaatcaatgtagtgcaagctgccaagatatctcagttggaaaagcagattcaaattctggaaaatgacaaggcagaactggcaaaacaaagagacctggctttaaaggaagttgaaggtatcaacaatcaatacctcaaaagccattatcctccatatgctgacttattaatgtgaatctgttgatgcagaccgcaagatcaaatctcaagctcaattcgacgtcctggttggcaagatcaaaaaacttgagggagcccgggatgaggttgctaacgctgctgccccaattgttcaaccgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaa

SEQ ID NO: 9841 - DNA, 1779 bp, Oryza sativa
cctgcagcccgtctagacggagttcttgtttggtcaaaaattttatgaggggttctctccagtcggcttcaatcatgcttacgccttgagtatccatggcttcaattgcttcttttctgggcacggttggttcataaagatgctcaacgaacacatcagaaggggctgcttcccgttttgaactaaaattggccaatctatcggctgccttattgttatgtcgaaggacatgggtgagctcgaatccatcgaatttatcttccaacttgcgtacctcttgtcggtaagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaagtgtatccacaatacgtagctcaatctttctccagtcggggaaatcaagacgaccccagctccagtgcctgtgagcctctttgacccatcaaaatgcatagtccaatattccatcttttcctctggcatgtcttcttggcactcggtccactcggcaatgaaatcagctaaagcttgtgacttgatcgaagttcgtggcttgaacgatatgtccaaatacatcaactctaaggcccacttcgcgatccgtccatttgcttcgcgattgtgaagtatatccccgagtggaaacgatgtgactaccgtgaccgggtgactttgaaagtagtgagataatttcctgacggtaattagggcaccatatagtaacttttgaacctgaggatatcttgtcttggagtcggctaaaacctcgctaacgaaataaattggacgttagactttttgaacatggccttcctcttcacgctcgacaaccaggaccgcactcataacctgggaggtcgccgacacatataatagtagcggctcttgcggatgtggcgaggccaaaactggtggagtggtgaggagtttcttgaagtcttcaaagctttctgtgcttcgggcccccactggaaattgtcagtcttcttcagcagcttgaagaaaggcatcccccgctcgccgagtcgtgaaacgaaccggctgagcgccgccatgcaaccagtcagcttttggacgtctttttgggagcttggcggtttcatgttgaggatggcgttgattttctccgggttggcatgtatgcctctttgagataccataaatccgagcaatttccccgacggtactccgaagatgcacttttccgggttcagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctacattcttcaatccaaagggcatggtgatgtagcagtaggccccaaagggcgtaataaacgaggtcttcaagcagtcggattcttttagttggatctgatgatatcccgagtaacagtccaggaagctaagtaactcgcagccggccgttgagtcaaccacctggtcaatgcgaggtaacccaaaagggtctttgggacaagatttgttgaggtcggtataatcgacacacatgcgccatgccccgtctttttccgaactaggactgggttagccagccagtcgggatgaaggacttccttaatgaag

SEQ ID NO: 9842 - DNA, 30036 bp, Oryza sativa
agttgggatgatgcggacattgggagttcattatcttgtcgaaggtgttgacgcggggacgttgtcgggaagatagagaggtggtcgccacaggttcttcgggcttacgcttgcgatccttgtggttgttacttccactccctcctacagtcggcgtgtccttctttggcttccaagtggtgcccgactgtttggacgtggtgatagcatcttcggctttggcatactcgttggctttttcgaacatctgcttaaccgtcctgggaggtttacgtccgaacttgccgactaggtcctcgtggcgaatgcctttagtgaaggcggtgatgatgacgtcgtcggtgatgtcggagatcttgttgcgttgttcggagaagcgtcggatgtaatctcgaagggattctccagacttctgaacgacgttgtagagatcaaactgtgtgccgaggcgttcgaaggtgccctagaagttagcgatgaagtaatcacgaagttccgcccatgatccgatcgtgccacggggtagtccgtggagccaggatcgggcggagtccgctagggccacaggtagatagtttgctcattgttatgtcgaaggacattttaattatactatcattatatctgaaagttttttttactaaaaatacttgcggcagatttttaagatattctcactaataaaattgtgccatccctctcactacacacagagcgggcaacgagacgcacatgcagttgctagctatcaacggtaccgagatagagtattattaggtactactccacagagtgttagtttagtgatattatacctcctaaatcccgattagcactagaaatacctcgacctcataataccttttgaagaaccgaaaatttcccttttcctactgtttctgattttacactaagcacattatgttcattcggcaacccttgtcggttccttagaacaactacatgacagaactaataaaattttgttttttttttaaactaggaagcagagctcccccaatttcattaagaaaaatgagagctacaaaagtctttacatgctacttaaagcagtctaataataaaattttgtactcaacacataacatacttgcccacaatctacagccgaaaagaattaatggtccctctagatcgatatactgtatggtaaatcatttgcttcatcatccttcttgtaaaagatgtggaaaaccagaagaggatgtatatatatatatattcctatgcatgctttcactcatcatcaagacctggtatgtacaataagttgacgtcgaacataactgggctgcttggagccactcttggccttccaggagctgaagtaaggcccttcggaaatgctagctgttcagatcaagaaaaacacgaaaaatcaaattatcaccctcctttcaaatctctgtgctaagaggggaaaaatgatgccatagcaatggctgcaattgtctggccccaaatttaccacatctttcattttctcttgcataatatttgttgacattggggagtttaggctacttaccgggccaggtatgtataatcgccgtagtcctccaaccttcattgacaatatcccttcatcaagtccctttatcacctaatgtttaccaccacaaatggatgaaagaaaattgaattgtttttaaagcattttagttagaaggcgcataatgtgttttccagagggtagtttggttactgatagtgtaccaaacattttcttgcaaaattacatatggtgaattcatgttttattaataatacgaactatacatttttcacgtagcattatgtatgttacattagtgtatttcatgtgcaatttacacattagacataccaagagttttaatttgaaaaccaaaaaccagacgttaaccgacatgttccaaaaacttgttagcagcttgttaccctcaattactagtttaataaaatattttggattcaatctttttccagataaaagtggtaagcggtcggttaccctttctcaaagggaccagttggtattttgttctgaaactaatattcaaaacctttgttcgtactctttaacatttaagttttaaatattaattcaaattgttctgggctggtataccgatagccagtcgatggcttaggatcggtaagtaccagtaaccagccgagattttgattcattgtacaaacacgatcaaatatataaactgtatatgactgtaaattgtatatttacagtcatctacagttcatatatttgatcagtttgtaattttattactcacatttcagtggtaatatttcagaacacaggctaccaagtaccaacaggaatatgtagggaaaaaaaataaatacctgtcctgaaccaacacggaatatgtagggctgccccttttccagagaactgtatacaacacagacacacaagaaaatttcagcttgcagcttgcaagtgtacttgaacagcatcaacttaatctcgcctatataaaagatggttagtttggcatcaaaagctcagttcgcacctgtcaaatatctgtccattcggtaccatggcaacataatttgcagcaacctaaatggtaatcaaagagagaaaaaaagaaacagattaagaacatgatcatgaacatctgcactgtgagaaatcaagtgagcacctggaagccaatgggtggacttgggccttcacccactttgatatccttgtactgaagaccagactctgtagtcaccatgggcaccttgggaatgcatcatgatgagttagttgctgagattagcattgattagatgattaacatttactaatctcatcgctaaacatgatcatgtatgtaatcatgcatagctcaagcagggttgaaaacttgaaatgttcctaaccagaaaacagatcgatcaccctggcaagaaagaaatttcaggtaaattttttttaaaaaaaatcgatcagagtaagtacattttcgaggtccttctcgcaggcggcgtcgcagagcttgggcttctcctcgggaggcagcccggcggcgagggcatcatcgaacgcggccaggccgagcgccagcgccgacgatacccccacggcgactccaagaacgctcctcctccgggaccgggtggcgctggtacagaccacgccgccgtcatccactccgcgctgctgcggcggcggcgccgttcccgcctcaccggcggcctcgcacctgcagcagcagcagaagcatcgccgcgccgctgaactcagcgccctgctgcccctgaacgccctgccgtcgggaagccacggtttggaggaagggagcgggcggcgggccgaggggaggaggagcggcgaggcggtggcggtggaggaggacgaagcggttgcagccatggtggaagaagaaggaagaggagaggaagacgaaggaattaagcaggtacggatcaggagacgtgggagaggaggagaatggatagcgcaacgacgcatcgcatcgcatactgggctttgcgcgcggtccgcctccaccactcgctgcgtcgggtcaaactgaaatctttcgggtgctgctggtccacgtgtcactcacagagggtttcgatctccatctcgcctgcaactgcaaaccacctcgctggctgcctcggcagcatttttcaccgtagtccacgaggtgtaaaataagaacgtattatgggatcccccatctctatcataagacagtcacaaaattaatttggagagaaacttcagctcgatcaggtcaagcggagattgtggtgcgtcatgctacctgtgaataatctcaagttctgaactctaaacaagtggttatcacaagttagaagaaatacagtaagaattctgaagattaatttgcctgtattcattggtgtcacggtgactctggtattggaacatttctttgcagtaggtagtagcaccatgccaagccatcagattatttttcataagagtgaaatgcacatacagtccttaaactggtacggatatatcatttaggtccctaaactctcaaaatgaatttttggatcccaaacttgtaatgagtgtcatataagtccaaacgggctccaactcgctccgtgagatgacgtggcatgccacggtaacgcttacgtgccagtggatccacatgtcagtcatataaaaaaataaataagagaggagagagagagagagaagaaaatgatgtttttaattttgaaaaaaacaaatgaaaaaagagaggagaaaaaaatatgtcatgtggttgacatatggggtccactgacacgtaggcgtcaccatgtcatgccacgtcagcacacggagcgggttggaacacttttggatctatatgacatccgagacaagttgagggataaaaaattcattttgagagttcagggacctagttaacacacccacgtaagtttaaagactgccgtgcactttactcttttcataattatactttcgataataacatgtgtaaactgtcagacagaaaacacatgatcagagagtaaaaacacaactgcatacattgcaaatttgcgattatgcagctcaatcgctggttcgtaatccctactaccaccgtagggtttattcttctgacataaaacataaaaacatggccagattgcagggcttggccgaattattgtacaaacatcatcatcctggtagtaatatatatagttgatgcgatcaaacaagctattcgagtcaccagacgttctaataaatactccctaaatatttgacaccgttgattttttttaaacatgtttgaccgtttgtcttattaaaaacttttgtgaaatatataaaactatatgtatacataaaagtatatttaacaaagaatcaaatgataggaaaagaattaataattacttaaattttttaaataagatgaacggtcaaacatatttaaaaaagtcaacgacgtcaaatattcaaggagggagggagtagtagtgtaaggtttttccaagtgatagaaagtgatgatgggactcctgacagcgtggtgccaatgatactctgctgatattgagcttcctctcacattatctaattaaactgagcttcctctcaagtacagcaaccaaccagttgcatatgttgtcagtgaactgaaaataggctctcctggaagctgcactgaatatgaaggtggttgaaacggtgcagaatccaaacgcaaatcccagcagagtaaacatgtatgtcagcgtgtcaaaaatctcatgatgtttgtgtttgtcgctgtccttgtggcagcttcttgtaagtggagccccacagagatcttcatttcccaaaaaagagtctccttcaaaagtcataagttggtttccatatggtatctttcctgagaggtggttgtaggatagattcaggaagctcaaaaataacagtgacttcatgctctgaggaattgggcctgatagatcattccatgagagatcaagtgattctaaccaggccagatttccgattgtttcaggaatacttccctcaatgtgattccttgatagatttaaggacgctagtctgtaaagatttcctatttcactgggtatctccccggttaaatggttctctgaaagatcaatactggtaaggaggaatgatatcacgaaagtaagtctgtaacctctgaaggttgcctgtaaagtatctttgtacacagaaaagtaagcgcccccaacgccataaaccatgaattggaaaaaaggcgatgagtcccattctagatttcgtgagagaaaggacgttagttttcccagagaacgtggtatagagccagagagtttgttgttactaagatccagatattgaagggcatgaagttgggataattcttcaggtatttcaccggaaaactgatttgaccctaaaatcagaagtagtagagtttgtaggccattgcctatccatgttggtatgtatcctgacaaattattctctccaacgtcaaggactaacaatcttttacatgactgcaatgaggtgggcaacaatccagataagctgttcttgctgagatgcaatgctgtaagggaacttagagagcccatagtggatggtatttcaccccaaaaattattgctggagaagtctatgacatacatactggaattcatacgccaacaatttggaagttcccctgaaagattgttattggatatgtcaatcagttccattgatattatgtcacatagatatgccgggattactccactgagagaattatgagagagcgacaggtattgcaattctttgtctccaaagctttgtggtaatgatccagacaagttgttgtgggatagatccagcactcgaacactatttggcatatcaggaatgtatccctcaagttgattatgcctaatgttcagagttatcagcatttttgatcgcaccaaacttgcaggcaactcaccagttatgttgttcatcgagacatttaagctagccattggcgaagagaagttccagatccaatctggcaatgcacccctgatgcctgcactgccaagatcaatcatcttgattctagtttgtgattgcagccaggttggaaactgtggtccaaccaggcaaccatgcagtcctagctttgtgagctgaaagggtggaaaccagctatgcttgactacaaccttgaaagaatttgatgctaaaactaaagcatccaatcttgataaattggtaaagtggagttctgataattcaccaataagtttgttgaaggaaatatccaagtatgtcaagttcgatagcctgctaatgctagttggtaatactccagataatgaattctcactgagatcaagaacttctagacttgccatgtgctcgcaccaaccagatagctgtccagttaatttgttatcagcaaggttaaggatctgcaacttcttcatgcagggaaacatgctccttgctgcttctgagagatttcctgacaaaatgtttctagaaagatctatgtgaactaagttgcataatctgctcattgaacgtggtattgctccattcagcttgttgttccctagtccaataaactgtagtgctgctagtttccctagctcatcaggaatcctgcctgaaagttcacaactagacaggtccaaatctgaaagggaagatagattccaaatccaatctggtaaggaagaattcagttcattattcttgagatcaattactttaagggcagtgaagttgatctgagaaacagaattaaggtccgtagctggaaggcttgcatcattcaagcgaagcacttccagcaaatgaagcatattcacagcctgcagccaatccacagaagcagcaaggtacaaccaactaaggtcgagatacctcagggaagttagcttcgaaacccactggaaatcgtccgcagtgatcacatgagaaccagatgagctcagatcaagaaagctgagccttgacaagttgccaagctgaggagggacagtcccaccaaaaccagcatgcgagagatcaagatacctcaacatcttgaaacagccgatgaattctgggatgggcaccccaccgaagtcactttgactcaggttgaggtacaccaatcttgtcagaccagacaacgatggattgatctgaccattgagagtgtactcgccgaggtccagcttgatgacatggccagtcttcttgctgcagctgacaccactccagctgcaacagttctcgccatgccatgagtgtagccgcccatcaggatccttgatactggtgttgaaggcaaccaaagcatccctctctgtggagatgcacgcagctatctccctgaaattgatggttaagcacaacagagccaaagccataagcaatccattcatagtattttccatgttggtggataaaactgtcagtactcagtagctggtggtagaatagagaagataggtcgagttgcacctaattggataaatggaagtgctgagatgaagacttgaccagttgacctgatgacctctggtcttcgctgctagtctagtctttctgcatttttagtcatctgaaaaacttgctttcctgtgtattaattgcattttgcagtaactggcctttttggcttgacggccagggaggaactgcaattaccgatcgagaaaagggtgtacacaagggatatgtttgctgagattaaagcagtaccacctgtacactctgggaggttacaaacttacaattactgcactctaatattttttttgattgaaaatactatcaggccttgcctatatattaaaggacaaagagcattctttactgcactcaatattataattcactcaagaaaaaccaatgttgtggtcagcctacccaggttcaattcaagtcgtaggattggctaggatgatgtagagctcatgtttagttttcagataaaaaaggcaagttcttactcaatttgcttttatacttggattcacaaattgatctcctcttcccgggaaaatctacatcttgctcattcatatttattggcctgaaatttctggtagatctaagcacggcattctcagcctgactaacatctcagaaaatgcaaatgttactgaaacataaaccaaccccctcctgctaagagcctaaggcactagggtagtgaagtgaactaaactacgaaaggattggcactaacgaatttatagcgggatgtacagtaatccggaaacagtaaatcgtagagaggaagaagcctgtgcggccataaacctgaaacccgaactcccaaacccctagttgcgtacctcgcagcggagaccactccacgctccgccgccggagacgtcagccggcaagccgccacggcgaacaggcagcacggtgttggagaccagtttgccgccgtatccgctccacgggtagctcggcgaggatgagggcagagcctactgtcggaagcggcgcttcggttgagggatcttcaggtgagggtacctgcggcggtgaccggtggagctacgcctggagcggcggccgccggcggcacatgctcgccctattctattcgagaatttttttcggttttagattttttttaaaaaaatatttacagaaataatctatcggctaaaaaaattacaaaaatagaccctgccgcccacctctggggcggcaagctgacgtggcaaacgggggaggaacgggcggtgacggagggagggtttttttgcaggaaaacccttgccgccctctggtggggcggcaaggggcccgaatacaaaaaagccagtcggggctggctattttgcaggcggccccttgccgccctctggccggacggcaggcctcgctgcctataaaaggcctgctgcccagcccccagccctcattcttctctccttaattccagtgaaaaaaaaagaagagaggggaggagaagagaagaaggggcgaagccctgccggattcagacgccgatttcaggtaatattcatagatcctatatgtgactattgagttaaatagtgtgtgttctttaaaaatttgtttgaataaatgcattatttttttgggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccagctgagaggagtgtaccttctataaaaggatggttaatgaggggcttgagagttgatccacagacaagtgacataacaatcaatgttatagtaagtcggacaactaagggtttttattgggaactaatgccagttcaaaactctcgagtgtggagatggtatttggaaaatgcattgcaacgcaagtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgatgttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacatcaggatacacctcagttgttggacccggcgatagatcaccgacaccagtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgctgtgcggtgaggtagcccctaccctacaggacgtatcgtacttgttggggctaccgctcgcgggagacgctgttgggccagggaccacggctatggactggaaggatgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgactgcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgctgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcaaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcttgagtttgttatggagttcgaccgccttctgccgactgacgtcgtgtgggagccctacagtgccgcggctacccaggctcgtgcgctgttgggtctgtccacactctgcaccagggaccaggcgtactggatgactacggttccgatggtcttcgacatctgcgttgagcttcacgcccctttccgcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccaagttgcgagcactagagacctctatgccaggcaccgcgaccaggacttcgctcgtgctgtgagtaccctgcatcgcaccattcctttatgttttcatgtctttctcttcgtcaaattttacgaatatttacgtacaaattaaccatgcaggtcgacgacatcaaccgggtcgtcgttgatggttcaacgacgatccaacgtttaggcgcggggattccggtacccgtagaggagcacctgacgacgtacacgcggatggtggagtcgatgcgctcgcttctccgagtgctcacctgtcgtgccgacgacgttgctcgggcagacgcagctgtatagcggccacccgtacagactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccatgttgggacctcatcggaccgcttgctgccttccaccgtgctcttcgacatcactgacttcgacttcgcttcaggctcgtcagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggtgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcaaggaaggcgcttttttaggtgccctaactatgaccgtgaggtattttattatctgcatatgcttattcattctgtatgggcaatcgctttattcttcgtaacactactctattcggcagacccgcactacggcttgtgcatacatcgagtggatcgatacaaaaaatcccgttctcgacctaaccacttgtttacaagaaggtcgctggtatttcgcatccgaaagtaatgagcaatacttacagagaaaagcggcttatgaacgacaatgtcgtgaacaacagagcgactggcgggtgctaactacggcactccctccatgggaagcttgtccaagatgcaggtgtggtgatcgttgtcaggtttttcgttccataaatcctacaacattgggttgaaggttctttgtttgtccaaatattcttgacgacgatttcatggtaagaatattttgattacatgaatccttattttctcacaacatttactaactttgcttgctttacatctattctttcctcctaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtatgggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtccatataatgtttatacgacccagactgtgataggcctatataaattatccgagtactaatacgtcgaataaggtacaaaataatacctcacttaacatatgaaattacgcaacaaccaacttcaatacatttttataacaatattaacaagttttaccaataaatacttctttatttattattaacataacatagaaaaatcttttggccgtacttttttcatctggggacccagatgaaaaagtacggccgcaagctctttatgggcggccaaaattgcaattagccccttgccgccctctgtatgggcggcaagggcctaatcgcaattttggccgacggcgcggtcgacccaccgtctgccacgtcagcttgccgcccaccattagggcggcaggggctatttctgcaattttttttggtcgatagattatttctgtaaatatttaaaaaaaatctaaaaacgaaaaaaattctactattcgatattgggcttcccgttcatgggccttcaagttaagcagtttctacttggaaaaagtatactttgactccctcaactatcgcccgagtatgattcatatcctccaaccacaaaccgggtatataaccggtgcaaacaatgtccctcggtggttttggaggtggttttggctgacgtggcgcctacgtggtggtccgtctccctgtgtgtcgtccccgccgcctccgccgccgccgccgctcccagagctataagggagagagagaagggagaaagagggggatgaaaaaggaaagagagggaggatgacatgtgggtcccacaatactttttttgtgtgtgtgaatgacataggggtcccacatatttttttatttttgttttttctaatgccacgtaagcatcacataggacaaagactcggtcaaaaccgccatgtaggcgccacgtcagccaaaaccaccgagggacattgtttgcaccagttttgatagatagaggagttgatatacccggttttgtggttggaggacatgaatcataatcggacgatagttgagggagtcaaagtatactttttcctttctacttctgggctgcaacttcatatgggccgtccaagcatacaggcttcagtttgttcattcacggattggagaaagtatacattgagtccctcaattatgatctgagcatgattcatgacctctaaccacgaaaccgggtatatcgacttctctaactatcaaaaccggtgcaaactttgtccctcggtggttttggaagcggttttggcctatgtggctttgttgacctggtcttcgtcatacgtggcatcgacgtgacgcttacatggcattagaataaaaaaataacaaaaaaaatgtggggtccatttgtcattcacacagaaaacaaattgggggacccactcacatgtggaccccacttgtcatcctccctgcatccccggtcattcctctctctctccatcccatcttcctcgttcctctcccccctctgtatgtccttatcgctgcgtcaccccgcaacaatgatagccccaacgtcgacaaccatggttatggctaaggcagctgcgtcagagaccaagggagacagagaaggacagccgccgaggccagagcagcaaggagggtgttgatgcgaaaaacacacactggcctggaagatctgcttaactcctgtgcaggtctaaaatcttgcttttaggttcgtgagcgtgccagttgatttgatcctgcaaccaacaagaataaaagacaagaaaaacgagattaaatccataaatgatagccgatcggctaggagccgatgacatatcgtccatcattgagccgatgttattggtgatagatcggcaatgaagaatgaagcaatataaaactaaatctactcgatcggctgtagatattaacgatatataatccttctctcaatgcatattttgattaagtgattgggatagatcgagcatcatgtcgagacagtataaatcacatagatccaaagatacaataagatgacgattatatgaacgtttataacatagctgatcaaatagatctagcatgtatcggctaatactccgataccactctatattaagatattaaaacagacgaacatattaagcaaaggcctaatatactctaatgcaataagatcttgatataaagggtatatttagcataacaatcaagcatataagatatgaaatagctaaatcaggtaagatcggctgaaaccccgacgatatctctttcagttatcataaaacatgctagatattatagttataaatattacttaatagatcgaactcaaccgatgcagcattaagcataaaaataaatacaagatctaggcaaggtgatgaaaacctctaagagatggtagatatgcgatacaatctagattaataacaagatttaactttatcggctgctctctagcagtaaaaaccagccgattgtgagttaaataacacaatcaacaaagattatgaagcatatatgataactcgatgaattaaataaacaagattagagtatcataaagatggaagcactaatcccgagaatgtaaaccgccatgacaagtttacctctagttgaagatcggaatcgatgcagctcaactcgaaagtaagaactcgtcgaaacaaacgaaagtgaaaaagggtggcgatgcgtcgagagtgttattgaaccgttatttctagatcacacgggttcgggtcatatttatacccgagatacatgataggtccttgccggacacaactcttatatctaacaaactctaagatacacataagtctttacggtagacttttacctaaacatatctctaaggaaattacataaaatataaaagatacaattgcctatctgagagcttatctccatcgtggcaatccttgtgaagcacattgaccgattccagaaacagttttataaccatctcaaaagaatcggctgcatcggctgtatcggccgtattggctgtcccctgtccgacccatctcagccgatgcagactccagccaatgccttcgcagccgatgcacactctgttcttcgaacgcaatcctttgctaaatccactttgattccagtaccaaacctgatttatatcttaccaaatttggtcgttaacagagggacggttgggcgcggagcgaggggagtgtcggtgaggcgatggcgaccaagggacagaggtcgatggggttgctgacggtgagggaggcgacgatgggcaccaataagaacgccatggggagcttcgtgctacacaacgacatgtgggagctcaggtctggcactaaccccggtgccatgctatggtccatgaagaggaagacggacgaggagaagaagaagagggatttggggtggtgctggcgcggatgaagaaagggggatttagggtggcgttggtgcgagtggtggcggaggacgaggaggcaacgcttcaactagcggcggcggtggcgacaaagtagacggctgcatgcttcctccttcaatttctccgtcgctcgatgttgtgaccgacgatcctccgctgccttcgcccccacgcccgtctccgccgccgacgctccggcccttgcccgcctgctgcccgtcgccgctccaacgcccgttccccacgaacaaccgaagggtaagagataaggggaagagagagtaaggaggaacaaggaaagggaggatgtcctgtgggtcccacaatatattttgtgaatgacaaatgggtcccacatatttttttgttattgtttattctaatgccatataagcgccacgtcaacgccacgtgggatgaaggccaggtcaataaagccacataggcgccacgtagaccaaaaccacatagagataaagtttgcaccggttttgatagttggatgagtcaatatactcggttttatggttggaggtcataaatcatacttggatcataattgagggagtcaaagtatactttttcctcatagattcaccaggcgaagtcatgggccagatcacagataagtctaaatcgaatgaatcacttaagagtgagataatttcattaaatatagtaggataaaaactgtacattgtgaaaatacaaaacaaaaaggagatgtaagatataatttgtgccaggcgtttcgctcctgctagagcccaagtcttggctcttccttgattttagcttcgagggaaattgttgagagcccttttatggtggaagactgtgttcggacctccaggttcccaactcctctcactcgtttttcgcgcgcacgcttttcaaactactaaacggtgcgtttttttaaaaaaaatgtttctatataaaagttgcttaaaaaatcaaattaatccatttttgaaaaaataaatagctaatacttaagtaatcacgcgctaatggaccgctctgtttttcgtgcgctgagttaccaacttcctctagcgaacacatcggaaggagcaaggttctaaactcctctcctaggttcctcatggtgggtttccagctatatccaccaaccgtggattgatgtcggttggtcccaattggtcgggttgatgtgcactctatactcctttaaaagcctcaagttatagtggtaagtcaccttgatattgcttttataaattgttccctaatattttttaatattatgaaatagtacaacatttagtttgaacaagtgaataacagatactaatcaaataaacaaccaagtgatactaagatatttgattaaaaattataaaatatatttgataaaaaatattttgttatggtatattataatattttttctcttttgcccatggtaaagcaagcgtatagtttaacatgaattatgcaatcaacttttttttttgccaagattaatgttcgttcaaattacttattttagttcatttttttgcccggattaatcaactcgatttctgtccaagttcgtctctattgacccatggtgatcatcgtggagatcagagttcatgctgggatttgttagtcagtgacacaaaaaaattcttcagtttgttagtcagtgacacaaaaattcttcagtttcccactctactgagcaagtgtagacgcatgcagagagtttttcagcctgtgctgcttcccggaaccccagcaaccatgaatttcaaagtccaatccacggccaaggacagcagcctgtcgccattcccattcggatatacggaacccacagaattcaacaacgaactcctacttcattgaccataacagaatgaagaatatattactcgccttttgacctgtccaacacagttgatgtcatgtgctaacagtgtgctagttcgttcgtttctttcaaaaaggaagctcacttgaaccttgctggtacagattacagaatgattagcagataaccacagtacggcaaacatgaggtattttttagtctgatacaatctttcgtagaaccgattcagacatgctctgagtttgatattttttgtattatctcttgcatgacaaaaacattgataaatgtccaagtgattacacaatcacatggaattttttttaaagaaaaacaagaattcagcatgcgttttccaagtccaatatcttgacttcccacaggtgacaggtttgctcccaaatctgcactgggtcaatgttttctccccacaagtttgctctttccaaatccatggctccacacaatctctccaccaactcatttcgatatttttctactgaacacatgcgtcaactgctccagccaacacgcaatcaaaatgcttacaaatcaaaccgcctctcgaactatatatagagcagagcaccaaccaaaagaccaaagtgtttcagagaaaatttcagacttcagtttggtgttaagctctctttgtctcggcctctgaatctctctgaactttctgatgtgttcgtggaggagacgagttcttgccgtgttcgtcgtcgtcatcgtggtgatcatggcggtcgccgcttcccgtgctgacgcggcgaggccggcgccggaggaggcggaggagcggctggtggactgcggcgaggggggatacgagtcgatggtgtacccggcgatggtggagaaggccaaggagacggtggagctgctgctggcgaggttgccggccggaccgagccccaagggacccggtcactgaagatcatagtgattacatgttctttttttttttcacttttgttcatagtttgatttctcaaaacagagaaacaaaagatattcttttttacctgtatatgatatcagtaggaatactggatgtaattagacagtgaatttactgattgctacgaaggttaggattctttgatatggctgctgtcattgtagtcatgtgttgtgtgttcttgcccattcgggagaatcggaatcaccaacgaaaactttagctctgtttcatgcctcgaacatatcgaaatatcgagggagtgaaagtctagaattaaatcattcaattggggctagaggtttgaacaatgatcaaaagaggggaaaaaaaggaagacaggtgacaaaaaaaaatttaaaaaatgcccccacgcaggatcgaactacggaccttcagtttacaagactgacgctctaccactgagctataagggcgcttcttgttgaatgattgtgtatttctaatttatacttattttatatttgtgtcgacaagatgcacaatttgttgaatagaatctctccgtagcttgaatgcataaaggttttcttctaaaagataaaatgaattgcatagatgtacagtcaggtatgatcatgtggcttttctgctgcattttttcttgaaacttcgtttatgggtacggatctaatcttcgcatatgcggtagatgagcaacgcggttatgagtttgcttatccaatggtgttttgattatctctctctccagatcaatatccaaacgacttaacctgacacggactcggagtcggactccgagtctgatttccacacgagttcgtgccctgataaattcagattctggcgctgatgagacctcaagcaattcggaagctagcgcatcgtcgccatcgatcagagggcattgccgccatagccaccttcgcttcttcgtcaccggcggccatggcgtccctgtacgctccgcggctgacgaggtggcgcgtcgcgacgtccggcggcggcgtcgtgcgcgactgcgtggagtacgacgggaagccgctcttcttccggcgcgaggactgccgccgcctcgtccccgacgacgaggaggacgcgcgcgagtgcctggagatcgccggcgaggtgttcccgctgatggaggacaggatggtgccggcggcggtccacggcggcggcggcgtccgcgaggcggtgcggtgcgtggagtacgtcgacgacgacgacggggccgtgctgctgctcacggtgacggcgacggaggggaaggagaaggaggtggcggtggtcgacggcggcgaggtgcgggtggtcgacggcggcggcttctacgaccccgactccggcacggtggagcacgtggtggacgtggagggcgcacgtgaggcgtacgtgctgctcgtctccgttcgcgaggagctcaaccgcatcgtccgcgtcaagaggctcaactgatcattattctactaaatccctaggaaatttgatttgtatttgatagattcttattgtttgtggggaagtttgtaacaagttttgtgcatcgaaaccctctgtcactctgggttctgatttgaagaatgatggttctaattaacttcgaatcatactgaaatcgtcacagttctagttagtacataccatgctaaaaggacatgtagtctagtggttgcagtgtcctgagtagcacccaagattctaagttcaaatatgcataggagcgaatttcagattgggttatttgagaactagttttctcttcgatagactaagtttatattaaaaaaaggctaaaaaagctacatatatccggttagatatagacgccgggtaaaaataccttctctaaaaaaatgctgctgttacatgcttgttttaccatagagacatgaagaaattatgaattcatattatttgatagaaccccacgaattcacagtgcttgtacgacttttatatattacaaataatttaagaatgcatatactcaaaagctttggaattttgttacatgtatccgtaatcaaaagacaccaacttaattactctgccactgtcaatgctcgtcccgcgcgcggcggctcagcggcttccagctcctgcagctggctcgcctgctgcgcgtgccggtagatcgccggcggcggcggcccggtggtgccgccggcgccccacatctcgatgtcgtcgtcggtggtcgtcgggctgtggtggtggtggtggtgcgccgccgctccggcgacgttgtggacgaggcagcgcgccacggcgcagatgagcagcctcgccgcaacgacgacggcgacgacgatgagcaccgccaggaagtagtccagcgccgaccggtgcacgcgctggcattcggcgacgctgatgcaaaccattgctcgcttgcttgctgcttatgctgttgtgcatgcaagaacaagaagtatgtgtgcgagaagttgcagggacagtgagtgaactagtagctgatgatatatttttgggggcgtgatgaaaagctggagaagatttggattcgttgcttgggttggcaagaggatagagagatgtttgaacctgtaccttccttggggcttttgggatctagtcgcatttcagacagcgattgatcaatggcttttcagaatgtctttctgggaatggatcagccacaacttttaaacatttagtacgggagatcgacggagaagctatgattttcttcatcgattaccaacttaattacatgcagttacaacatgtgagttttattcccagtcttcttcatgcaacagaatacagctgaattttgtaaaatccagctatgcgaagccgccattactgtagtttggatgtgaattttcatccctcaaggggacatcctctcgttgcttcgtaatttgcttgtcatctaaatagttataaaaaaataaaaaaaatattaatatagattaatatgaaatatatctctccataaatatacaagaccaaattcaacttccataagttgtaaaaaaaagaacaaattaaactgaaaatagttctcatacattcacagttatatttgttattataacttaacattatttgtgaagtgatatatttcatactaatttatcttgtaaaattttttaaaattttcataactatttaggtgatatacataaaaacattttccatgtagtttgtccaatgtaagaaatttaccatgaagctcaaaaccagtaaacaggtgtagtttgatccaaactccatcaccactgtaacgtacgatcattcgatcaaatggatgattagatgcaggtggagatcgatcagctagcgatctacggactggaggaggaggcgagagcttcacctccggtctcctcctcctcttctccgacctgatgggaagcgacggattcagatgccgcgtcctcctccttcccgtcttgaatccgctgcggaacgacgatccgctgcctcttctccttcctctcaccgcggcaggtggtgatggaggacgccgtgtcctcctcgtcgtcgtcgtcctcgtctccggcggcgtggcgcttaggagggcggttgagggggagggggtagccgggggggaggaagccggagaaggccccggacatgaagtcggccggcgagggtgaagccgccgccgccgcgggcctccgtcctgagcgtgacgcgctcgtagaggtcggccctggcgcgcgccacctcctcggcgtccgtgctctccctcaccaccttggatagcctgcgctccttctcctccgcctcccgccgcgcgaacacgttccggtggtactccatccgctccgtcaaagtttccctcgtcgcccactcgtctatcggcggcggcggcacccagatccaccgtagatactcgcgctgccccatcagcggcacgaacgtccgctccatctcaagattgatccctctctctttcgccttagattattggattggattctgaagatttttctcgcgatcacaagtttgtaataactgacttgctaatctgatgactcgaggctgactcaacgactccgtccgattccgatatacaccaatcctttcaggccgcccgctccagtttttggatcgaaattgtgcttgcagtgacaatattcatattactagcaaacgagatgtgattttcctcgaggaacaatatttttcatacgtacgtatccaccattcatttacacaggcaaaactgcctcgacctacaaaatgttttttttttttttggaaaccgatcgatcgtcctacaaaatgtcaaaacttccaaagaggacgtaccaacagttccaatctacccatctcattccttgggcgttcaaatagtcttctgcaaatgcaaatccagcggtatgtgagggcgccatcgttgaagtttgtcgaatggaagaaagcgtcatggagctcaatgaatcccactaaaacaagctgcacatctgaagcaccacatatgcctttggcaggaaatgtcaagaacttgatccagttcccatcactttgtggtaaacttcgattgggcggtcaaaaccagtaacagcgccctccagtttgtccgtaaccacctctaccgacctgaatccgatctgcaaggaacaatgcatggtgaggcaaaaattctgttgctggggccaagaactgaacatagaattcgtggctgacattagaacataccttgtctagaagtatctcccggaatttatctggatgtattaggatggtattgaagttctctttggcaacctgaaagatgtaacacaaaaaagagtgaggtattgcaactttgcacgataaaaaaaaaactgcggtcatggaagaatcaaatgtttaatgaggactaagatttctgccagtatgttcattctagtaatcttaagattgaaataacagggggttaagaaagcaggtccagtaagagtgaggccccaacatactgacgataaagccaagcaagcagctaaaaccacaaccgcaactgtagcttttacacaagcaaggggctgaaagtaaaataactctagccttcaacaactgacatagaaacacaataagcatttcaaacttcaacgcgatccagaaaataatcaactgggtgtcagagatcagtatggcattggggaaaatgatacctctgaaaccaatctgtttctcctatatgaggtccaaggttgaggctccataataaaaactccaccctgaaaaacaagagaatccagtgggaaaatagtttattattttttttcatcttatcattgacatctactttaccaaagcacaggaaacataaagacagatagataccggtcttagaagtctccagatcttcacaaataaagtaattatgccatcgtcaccccagttcaggtggatccatttggtcacactcaaactgcatgagaataaaagcatataaaaacgcatgtgtcaatatgacatccaatgtgggtaatgatggcaattttcacaaatatgttgcaatataaaaacgacaaagtgactattattaatgacagcagaaaatctatgagatctatattataatttgtaacttaccaaacaattgtatcatactgttctgaacttgtacacatgctgtccacaaaattctcgcgacgaaaagaaacaactttaaaaatatcatgatgactgccattagaaatatccccatttgatatctcaggtgccactttttccggacagctttcagacggtgaatctgatgacttgtgagccttggtgttttctacaaccaccttatccagtcgagacatccttcttaaattccagttggcagtttcgatcaaacctaacaggacaagatcaggatcagtatagcaagaaaatagctttacaaaatttataacaatatgtttgcctaggaaagacatgaaacattagttaacaaacctgaatcaatatcaactccaagaatgctttggcatttaaatttcgcagctgcacaaggttcacaaataaaatgagaaaccatactagtaataaaatttaactaacacagacatacaaagtatcttacagtaacacatatgaatagataaaagaatatatactgcaaatagtttaaattttaaataccgtctctgttaacattgatacagaattcccaattctatttataagaggtacaacaacgtaactgtacaaccatacaattatgaattagatatatcatttttgttcaaatggacaagacagatcatcaaccaaacaaaatagtactaaatattgcacaaagatgatttacctagaccaatcgttaccaaaccctggttgcatccaatatcaagacaatccttgctttcaaaccactctctcttaaatattttaagacgagggtcttcatcaacattacggtcaatctgtagaacattagaagaaaggatgtataagctaatagagagacatcagaagagagaatttatcagatgagaacaagataaggattgcagtatccggcgaaaacaagataaggattgcagtatccggccatcgaatgggatttatattgtactaagagaagtaccacatgcagcgctgcaagtagaatgtgaaataaacccttcccccctccttgtctgaagaaatctacagtacactttggcattggcaaatcttaaggaaacaacaagatctaactaggctccctgatacttcactccttccttcgccaccaggtgtacttatgatatgcagggtatgggggcacttcctcgacctacttatgttatgactaaataatcagtcaaagtaaattagacgattttgctttcctgaaatagtgaaatttgttgttcacttggatacccgacacaatcattctgataaacaacaaaatgctgaactaaggaaacggaatagaaacagaaatttgattatctacattctacatgcccccaataaaagaacctaaactggtctactgcaaaccacaacaaattaaatcagaaatgacaccactgtaactaaggtacattctaagcgagagcttcgactgatatccattcagcgttccaatccaaacccatgaaccatcccaatcccacgagcaccgcgaccaccatcgaggcattccatcgaacagttggtgcgctcatacacacagcaacgatctgcgcgcccgcaagagaagcgacagggggaggggtgggtgttcactcacccggtagccgtagtagttcctgtagttcccgtagacgaatacctccttcctcttccgcttctgcccctgacccccgtcgccgcggccgccgccgcctcctcctcccccacgccagttgctctgtttcctcttcgcctctcctttagcccccttggccgcggacggcgcgtcctccggcgcggtggtggtggccatgctcggagaagagacgcctctctcgccgccgccgccgcggcgcggttcgtgctggagctgaaacgagaggggaacagcgcgggacaaagcggcgagaaggagacgaaaccctcgccgccgacttaagaagaagaagaagttcagagatagcccttccaaaatagaggtccagttaggcccatcaatatttgggcctatcgatgtttgggccgtaacctctcatgcatgtgcaatttgatgattaaaggatttgcacaatgtacattgtataaacagagatatgctttgcattgtttaagatgaaggaagatttagttgtgaattactcgtgttctgattttttttctttggttgattttttttttctccaatccaacgcaagctaaattttttttactcatgctctgcccctcgcgccggcggccggcctgcccgccttcccgagtcccgacggcgccgcgacggcccactgcccctcgcgccggcggccggcctgcccgccttcccgagtctcgacggcgccgcgacggcgcagcggcgctctgcccctcgcgccggcggccggcctgcccgccttcccgagtcccgactcgcgccgtcgcggtcgcaccgcctccggcctccccgacgcgcatcggcgcgcgcgccctgcctcggcgcccgccgcctggccggcatcccgcatccggcggccctccccctccggtgagcactgcgccactgcttctccggcagtccggctctcctctccctcagtccctctactctcccccttgcagtagtcagcaggcagtactacctccttcaataatcaagttctttatatccatgattagccaattggggatatagtaatttgtatagattaccacaaaattgtgcgccacaatgaacctcatatgacttttttgcatggtgtgatggttgttaggagattgaggaatgaagaagtcaagcagtgtatttctttttcagaagcatgaagcaaaaaaagttgatgaaggggcaatttacattgtcatttaggtaaattttaaacttatttattattttctacttgtattgaactatttagagttatatacccgtatcgttttacagattttatatcgaatcatgatgtattgcatttagatttttttcgctaggcctaccctaggttcaaatcctgggtccgccactgcctaaattacccaaggacgcggtaaggaaattattggactcagctattgggcttcttcatgagcctgtaaaacattagtacaagtcgccacagaaatatccgattgttagggagttcggagaagaaaacaccgaaccccaaacgatcacagagcagactgcatgtcatgctttcttctgttcagtcat

SEQ ID NO: 9843 - DNA, 10262 bp, Oryza sativa
gccggatagtcttcagtgcaaggaattaattaagagcagacaatagaaaattcagcgagagtgttcaccattagccgaccctcctccaatgcctctccgctgtgcaaacgcctgcaaggatcagtgtgttggatgcctgtactgtatgctgttcgattatcccgtttgcatgttgcgccttcttctggtaggcgaggccatcagctgaatcaaacatcactattggagcaatcaaacatcaccattggaggctggagctatagtttagtttcctgtttgtaaagaaaaagtgaagaatgttcgtgactgccgggggtcggagaataaaactccgaaccccaccggtgaccgagctgattgcatgtcgtgccttcttgtattcttcagaaaagccaaacgaccagctgatcaactatcagatcagactttttgtaattaagtaatttatttctcttgtgaatgtgttctctacgatttattttcgaagagaactctaaagaaatgcagggagttcctttttttcattatagaataacagtcactagtacgtaaccttccatctctaacggcctctaacatgcttagaattagcggactgtcataagaaagtcatctcaatcgggccgaaaaagcgcccgattgagataacgcaggtccgtcacggatgacacatatcatccgtgatggacaccaacttggggcccgattgagatatggaatgttatctcaatcgggtctaaactacggctcgtcactgatatgtgtcattcgtgacgggcctgagttttatttccatctaacatgtttgtgcgatcatatctcaacaactaggtgagagatatgtgaattttatgaacaatattactatcactttgtcggatgaaaaaatgaccaaaataaaagttatagatcttgatgagttatacaactttgttgttaatgactttttcagttgaaatcatttagaatttgaaattgttgtttgaagttgttatatttttaaattcaaattcaaactattcaaaaaatattatatagaaaaatgaccaaaataaaagctgtaaatgttgataagttatacaactctattgttgatgacctttccatttgaaatcatttagtatttgaaaatattgtttgaagttgtcatattttcaaattcaaattcaaactgttcaaaaaatgttatatagaaaaatgaccaaaataaaagttatagatcttgatgagttatacaactttgttgttgacaatatttccatttgaaatcatttactacccgaaaaattatttgaatttcttatattttaaaattcaaattttatatagttcaatcaaacccggatgaagaaatgaccaaaataaaattggtagatctcaatgagttgtacaactttgtttttgtttttgacagctttttcgtatgagttcatttagtatcataaaattcaattcgaaatttatttttgcctagaagtcttatttgtctcctcatcatgttaatacttgctaaatatatattaactcagttttgctggtgaaatatgtgaatggatgtgaaatatatgatcaaaatggatgttatgtgaatgtggttgtgttaaatatatcgatggttgtgtatgtaaatgaatatacaacttcttcttaggaagctgatctccaaagaactctgaggttaagcgagccaagggtggagcaatttcggaatgggtgatcgaccggatgcacacgagtgaggataaagtacgcagaaaagactggcccgcgggcgtggctagcaagctataatttaggcccgttagagatgagagtcatccgtgacgggctatagtgttggcctgttagagatgagagtcatccgtgacgggctatagtgttggcccgattgagatgtgtgtcatccgtgacttaggcctattagagatgagagtcatccgtgacgggctatagtgttggcccgattgagatgtgtgtcatccgtgacggccggagaaattttctcacatcagtaacctttgctcagtgacggggtcctgtctgaaagatatgaggctttaggctcgttagagataactgatcccgttctagtaagttaatccaatttacaaaaggaaaccatgtcttaaaaccttacaaatgttcaattaatttggaagaaatccagcgaaaacctccacggagcaaataatgcaatagtcccaagcttaatttggaagaaatccagcgaaaacctccacggagcaaataacgcaattgtcccaagcggcatacccaccacaactgacgacaaccgacacaagtcaccgttgctaagattaaagccaaagaccaagcagctccaacttcctagggttatcctcaacccccacgatcaacaatgctgacaaaagggatatcagcgattaatcaaagtggaacatgaccttctaaacagagcctcaaataaggacataacgtcgaggacgttgtcattgcctcctggaactctaggactaggttttcatataaaagcaagagagagaattcagcacgacaacgcctccaacgaggaaagcggcacccatagttgttgccatcaccggtacctaccaaaactagggcaaggcttccgtctagtcacttcctatcaatcacaccctcctcaagtgtttcttctatgtggctagaataggaggatttaagcaagaaatggcagtgcaactatgcaagcaggcaacaccatcctacaccaagtaaaaataagggaaaacctagcctatagtgaaagagagaactcattgtcctctacgcatcctttgccgccgcgcacccggatctagccagagccgatcggtgcctctccgtgccctggcaactcatgcttgcaccactcgtgtgatcgtggcgttgctactatgtgcggccttaggccttgcgcccttcaactacctgaacccatgcaatcacgcctgcctaacctccacgctccacaccgactagccacctcgcggttgtgccgtctctctccacatattcatacctccttgttacaggccatcgccccttccgtactacgctgatcgggtcaagaaacaacagatccaaccggagggacattggatctagttgtctttgtgcactagccggccttagcacgagcaccttatcaagtatatgactaatagccaccttttcctcgtccaactcccctgcacaccattttgcctccttggccgcttaagtagtgaccttctccatgagtcacgagagccttatgacgtagtatgatgaaggaggaaaaaaggacgcctcgccactaccattgtccttggctccttgaagccaaatgggctccagctggactgctctagcagtagcgatggggaagaaagaaagatcgaggttgcgacactaggtggtcccatgggagtgacgcacgggcttttatttgtttctatatatttgagttcactataaaacactaaaagattacaccatatatagatttacaaaggacttttgctctaagcgactttagatacctttatttatatagaagaaaacaaagttcttgttgagaagtatgcgagtgatacctgcattttatagttcaaactttgtatatactagttggcaactcggtatgcaaacaagtagtgacgaaggcttttgctttgtatgatacgaaaagggctcctctaacacactactattctctaacacactactattctctaaggtaggtcgctgacatgtgaacccacggctatagaattcacatatcagttactcaaaagttactcaaagttagatgatctatatatgcaggatagctggggtgagatagcagcagcagtagaatacagctgttgtcttcatctcatgcagcttagctatgaagctaggtaacgtacgtagcggcacatattccgattcgcatagcatagcagagtagcaacgcggcacccgaaacacgttttacaccgcgcaaactctcctacaacctgtacccacccggattcctacgcgcctcccataaataattgctacgctctctcccgccgcatgcactaattaaaaagcccacacgcgacgcgacacgcccggcgagccgcgcgagcgcgacacacacagaggaggaggccgcgcgcgcgacgcgagctcgccctctgcgtgcgccgccgcgaggtcgccgccgccgccgccgccgtcgatcggcgcccgatcgatggggggctgctactccgcctacgcctcctcgcgcaagctgcgcggccgcatcagcaagatctccctcgtcatccccgacccggtccccgacgccgaggccgcctcgccgcgcaaggacggcgtcgatggcgacggcgacgacgtgaggggtggtggtggtggctgtgacgatggcggtgacgtcgtcgccatcgcgacgacgacggcggacgagttcgcgcggcggtacgtgctggggaaggagctggggcgcggggagttcggggtgacgcggcggtgcagcgacgcggcgaccggggaggcgctggcgtgcaagacgatccggaagcacaggcgcctggcgccgccgcgggtgaccgcggcgaaggcggcggccgcgcacggggaggacgtgaagagggaggtggccatcatgcggcgcatgtcgtcggcgtcgtcgtcgcgcgggggcggcgccgcgtcgtccgccgccgtggtgcggctccgcgaggcatgcgaggacgccgccgacggctccgtccacctcgtcatggagctctgcgagggcggcgagctgttcgaccgcatcgtggcgcgcggacactactccgagcgcgccgccgccaacatcttccgcaccatcgtcgacgtcgtccaggtaataatcaagaacgaacactacacatcatcttcttcttctcccattgatgcatcaaatcaaacgagtaatcactaattaatcaccaacaatctgtgatcgatcggtcgatggatgcagctgtgccactcgaacggggtgatacaccgcgatctgaagccggagaacttcctgttcgcgaacaaatcggaggactcgccgctcaaggtcatcgacttcggcctctcggtgttcttcaagccaggcacgtcgatcttcagcaaaatttccacctctcatcgtccatgatttctgtcaaatcctccatggtttctgaaaccaatcaaatgttgatgcaggcgaccggttcacggaggtggtggggagcgcgtactacatggcgccggaggtattgcggcggagctacgggccggaggtggacgtgtggagcgccggcgtcatcctctacatcctcctctgcggcgtccctccattctggggaggtatatactcaccttaattacctttttttttaatatacaatgtcattgatttttaaagatatgtttgataatttttttgaaaaaaagattatgtgattaccgcttattttattgtgagtttattgttaattattctataagtatgacttaaacttttttttatagtttgcaaaagttttgaataatacgaatagtcaaatatttataaaaaaaataacgggatcatatcttaacttccttttttactatatatatgatactatttaactttttagtcatgttcaatcattttaccttataaaaatattaaatatttttcgtttgatttatcactaagaaactttaaacattatttatgttttaaagatttacatattttttttaataaaacgaattgtcaaatattaaaaaaaaagttaacggtatcatttattaaaaaaatacattaccaattcaccatgatgatgcaaatcatctcccctgtcaattcttgtcatgaaaaaaaactataactgtaatcttgtctgaacttgcaaatgtgcagacaacgacgagaagatcgcgcaggcgatcctccgcggcgccatcgacttcaacagggagccattgccgagggtctccgccaacgccaaggacctcgtcaggaggatgcttgatcctaacccatccacccgcctgacggccaaacaagttcttggtaagtaaacaacttaatcaaaccttctcaatgattcagatatacacatgattactggaaatcaaacatcattttgtttgtttcgtcgattggttttgaaacaaaaacagagcatccatggctgaagaacgcggacacggcgccgaacgtgtcgctgggcgacgccgtgcgggcgaggctgcagcagttctccgccatgaacaagttcaagaagaaggctctcggagtaagtcgtcgagttgtctcattgcttctgtgttgcgatgatcttgatgggtcgccggagctaacaacggcggtgtccggtgaaggtggtggcgcggaacctgccgggggaggaggtggacaagtacgtgcagatgttccaccacatggacaaggacaagaacgggcacctgtcgctcgacgaactcttggaaggcctccacatcaacggccagcccgtccccgagcccgagatcaggatgctactcgaagccgtaagctttctgctcatctcctcgatctcgatctcagaatcattttctttattaagataatggaagatttttatcgagctcattcaattacatggagaagatctcaaaaatcatttttcttgagtcttgatctcagaatcattttcttttaagataatggaagatttttatcgagctcattcaattacaccgaggagatctcaaaatcattatttttctgaagattttgttgagatcatccaattatatcgagaagatattactgtaaccgttgaattgtgatggatgatcatactctcattttctcgatctcaaaatcgttttttaaaaaagataataaaatattttatcgagctcatccaattacatcgtgaagatataactgtaccgttgaattggggtggtcagaccctcgtattctcactctcaaaatcgcttttcaaagataatgcaagatttttatcgattgaacttattagctaatttattgattacttgtcgttttagacaagtaaacggtcttaaataaacaattatagccaccattttctattacaatatatatatatatatatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgatatcatggtgccccatatgagtgtcctatatatatatatatatatatatatatatatatatatatatatatatatatatatatatatatatatattagaaaaaatattttattgtagtatttttaagactaatttctacatatggtctctacatttctacgatttaagaaagtttgaccaaattattatccaaaacaataaatatcatcaactcggaggtattacatcgaggatatagtaagaagatgagatgatgaatttgcaggcggacacggacgggaacgggacgctggactgcgacgagttcgtgacggtgtcggtgcacctgaagaagatgagcaacgacgagtacctggcggcggcgttcaactacttcgacaaggacggcagcgggttcatcgagctggacgagctgcgggaggaggtgggcccaaacgagcaggccatcctggagatcctccgcgacgtcgacaccgacaaggacggccgcatcagctaccaggagttcgagctcatgatgaagtccggcgccgactggaggaacgcctccaggcacttctccagggccaacttcagcaccctcagcaggaggctctgcaaggatactcttactccctgatgatcgatgatgcccaacaatctcatcaactttgtttcatcaaggcttataaactgcacatctttcaccttcaccagacagggataactagagagagatacaagaccaacttagagaaatgtattggagtggcaacacgatgcgatgctgcgcttggattgtgaaatgagaaatggaactgaaatggggatcgtaccggttttgctactctttcggtaaatgggtatttttgtttgctataatatgcacacaacatcaaaaattccatccatcaaaatatgcagctcgaacgacgaatctataagaaatcaggtactgctgagtaaacaccagtttcccacatgatttatcaaccatagattatgacgagctttggtaatttacatgaccgctcaatagataagagctacatctaccattctccagcttcacaggttggtcagtacagggggtggaactttacccaccacatcatctcatgtcatttaaacaaaaacagaacattgcccaccacattaacacaactacagaccataactaatatgtacataatataggctagaaagtaaaaaaaaaaagactacccacatgtttgtaccccatccactttcgctccatagtcggtcctgcattgttgttgcaatctagatacaaccagggaccttcactcacacatgtacgccattgctgccattggaagctcttcttcaacgccacataatttaggaacagaactacaatcaacaatcttctcatgaagctttgagtaagcacccccttctcaacagcttcgagatttatggggggcactggctttcagccagtttttcatctagtatctatgcttatcgcagacgctgcatgcatccaccgatgaagggttaataaacgtgcagcgctcacaagcccagccttcatctgagttgtccgaagatgttctaggaagctgtttctatgttttgcattaagtgactgctttcttggaggggatgttggtggcattgcttgatgtggtaccctgggcagtagagtgtacatcctccaagccagcctccagtgcttgaacaaggttctcaaaataattccgagtcacactgcagtggagacgaagcaaagtcaacatatcgtaaacaaagctcatatgacaataaagaataggcaaggaagctgctatccatgagcatagacagcatctcaagaccttgtaaaatgctagcaagtaaaaacatttgcgacaacaactaccaaaatcaaagaagcaagtctagggtcaacaagtaaagagcatagctgaaatgtccacctctttgactgtttgactactttacatgatggattaatactaaatcattaccaagagaaaggtgggcacaaacaaagttcatgtcctttattagaattataaaatctcaggcttctaaaattctcaaatggcatttaaattatggcataattagttacattcatgtgaacctacccaaggattgttaagaacaatgtaagaacgttcaaggataatttggaaggagcgcaacgccaaaatctttcagcacaagcaacacaccgtggagcggttattggaagacatcaaagaagaagtttcggtgtggacgtctggaggttattttcatattgtgtaagacatcaaatttttattgtagccttcagccttttctgtatggcttcgattgtttgggggacctgtccccaccctaatctcgacatcctactgtcgatataaagcccatttgtaatttgttccccttttccttaatgaaatttggtcgaccgaacctttcggccgacccggcaaaaaaaaaaaacgttcaaggatgaagaaaagcaaacccttgggttcatcctaaaaactagtactaattgaaacaagagtaactatcttaaagcatgcagtagttgaatatggccaaacccaaaaggatataggaaaaacaataactgtgaaataccttgtcagccccgcaagcttcacccggaagtcaccgaattcagcaattgatggtgcaggttcagtattatcagatctcacagtcaaaaatgattgcaggtctttctcagcacattggtgaagacgctccagaccagactcagcttcacctataaaagatataatatacataccacatgat

SEQ ID NO: 9844 - DNA, 1454 bp, Oryza sativa
tgcctcgactggcaatataagtgaatatgtcagtacagaaacttgcatactacagcagaaaaaattccaagttcagaatagaacaatgcagaacattcatcccaagcatgtacagtagattagaaactatatacccatcaggtatagaaaaacatctggaactgtatttttttatatcatgaactgataaggtaatacaacataaaaattaaaaaagagcatttattagcacttactaccttcatcccataatgttgataggatgacccatcttagaacaacgaatctggacatgaggaatgtccaaattcgttgtcctaggatgggtctcatcctatcctaggttgctacattctaggacggagggagtaagagataaacttggcaagtaatcttcaaataaagctgcagctagttgggctacactcggtaggtaagaatttaagtcaaaattagtatctgcccaagcatatggccaacacaacacttgccaagtaaaccagaaggttcaaaaacacagagtaagttatgagcacaagaatgactaaagctgcacgtatagttgttgtagaaagaaaaaaaaactcaaagagacatcaaacttgagcatgttgaacataccgtctgattagatgcccagcgctcatagtaatgcatgtatctctcaagtgaatttttggctctttccctccttgcttcagtctcatcatactgcattagaggtaattaagttaggaaaaagtaacccttatgattctatgaatgaatgaactaattgaacaaactgtcaatttggactcgacattgacttgtgggattgaaacatttaattctacagaagcaataacaaaatacacaagacatctagaaactgattccttctactaaatgcaattggatagtctcaagataaaacatacaactccctccttctttgctgattcatagcgattacaagcgtaaaatccaccagttctctccccatgttcagcccatgaacccagacataacctgaaatgttcaaagaaaacaaatgagaggtacatacactagtaatatggacataaatatttcagcaagcatagacattggactataccagcagaactcaaatttgcaaggtggagtgcaagtcatatgcatgcatccctggtttttctctattggtcgtttgcattttgggcacggcttagaattagccagtatcctgaaaaggatcatcaacaacatgataaaccatctgacatgattagatgatttcaagcaacataaagaccttaaatacatttgagcattcatggactagccatgaactgaagattggtatacaattctaacagcattgtataataggcaaacattcctgtaatgtaaacatggcaaaaacgcttgagcagcataatgttctcactagagcctccacaagtttttccataaaaagaagtcatcaattg

SEQ ID NO: 9845 - DNA, 384 bp, Oryza sativa
atattatgggacggagggagtataatgataaaagaatattcaatgaatgacggttaacaaacttaccatttgtagtgatgaagaagaacacacgcgtcctcccttcgaatcgatagtacagcagataccttgcctatatcttcctcttgacgctcatttatatccttttcagttaatacaatgtatctctgtccatagttaccaaacatgggccagtttttagagacactcaaggatatccagtgaaacaagatgacatagaagtgccaatcaacatgaacgaaaacaaccaaacacagtaccagcttggaaattatggaaagaaagcacagaaagctctctagaaacatatggtatttcatcgtgatgcatgcgattaattat

SEQ ID NO: 9846 - DNA, 1749 bp, Oryza sativa
  unsure (1)..(1749): unsure at all n locations
agtggttgttcagattggagataagatatatcgatttgttagctatttgctggatcttggagaaaagtttgtaaggagtagtccttattctctccctccctggtgccaccatggctaggtccaggaaacctcaacaaggactaatgtccctcagcccaattatgcccgttacatacacacgacaaagataaacatgcatttaccctgaatttgtagtacgagaggaatgcctgtaacactgatattcacctgagcatatgcttattccagcttcacggacatgctcaagagtctgcagtctatcgtcatatgatcttgtggaaataatgttggggtaatattctcttgatgtatctaaattatgattatatgctgtaagcccagccttcttgagttcttcagcttgttgcttctctagcatgccaagagtgcaacagacctccatgcccatacctctgcagagatttatccacagaatggtaaatcgaagtcaagatagtgataaagcaagaaaactaccttcatgcaaatattctatcgtaatgtatgcagaggcttaagtcagtgtcctatatggctcaagattacgtctgtttgtaagtgaacaggcaaagaatagtttaatttttacattcaagattgacaatactaatatgtttggaaatacaaaaaaacagacgaataaactaatgatgacatagcaatggcatggaagagagcatgcgcatcagtgcatggttatgcaagactctgccaaatacttgcacacaataattctattgtgctatctttcaaaaataatacctaatgtccttgacatattcaaggatctgattaaaatttgttttcctcccaatggtttctctccatgctgctcccatgcaaaagcgggtgctcccagcctcctttgcctgagcggaaatagatcagaagaaataatgtgaaatgatattacaacccataattttctgaactaaagctgaagtcctcagtctgtaagaactcatgttaccacttcgcaagatttttaaaaacaacaacataaatgaacttggtcaccttgagataaagttacaaaaacagtaccttttttgctgcttctaagacagcatctttattcattaatttttgtgccttcaatcctgtactgtatcttgaggactgggggcagtatgaacaatcttcgctgcacccacctgtctttattgaaagaagagtgcactgttgcacttctctgaatttatggacacttctatggacttgagcctatagaaaatgcaagcattatctggttaaatgaaaatacattgcaattgagagctatttccctattgactaatgtgaaggctggacatagttttccttcccctttgaggctttgactaaaatgatcaacgaaaagcttgggaaatatgttcaacatatnnaaccaacagagatgcactttaagctaataatgcgaactaagatatgcatttgaatgaatgctgacaagctatcgtgcatcaagccagtcagatcgttgcagattgttgtgaccaaacatgtttgatatgggccattcattactcaagctaaatttgcaatatcaagtccgaattgtctgaagcccctatatgggaaatccttagcaccaatttccagattataaatgcccttgagggcattacttcctattaatactagagcttgaccaagcaannnnnnnnnnnnnnnnnnnnnnnnnnnnnnnnnnnnnnnnnnnnnnnn

SEQ ID NO: 9847 - DNA, 7483 bp, Oryza sativa
taatctcatacgattggtccaaataaacaccgaccattgttgccttttcaagggacctgtagattgccattgcatgtacttgaggccatgatcatcagtacaagcttctaccaaaaggtgaaggcatcaacttttccttttccatctcaaaagatttgaaaataaaaaggcatcgtttttgcatggaaaaccttaacgtagacgttgattaataaaaagtttggccacatgtcgttatgcagtatgttcaaacttgcaatgacggataaatttacaacaaaggattgcgaggacctacgcaacaattccagttccatgatgattccatcgtacgtgtgtcatgagtgaaattggggctgaaattagcacttaaaacttctcttggaagaacactttgcacgtggaggcaactcagcatcaggctttcgaagaaaagagaagaacatccaacgaatatagaacatggtatctcagtataaaatcaatactttggtccaaaaagaacatgcatgtcttgaccgtactatagaaaaagaaataacgatggagcacaaatcttcagtatttatgctaaggccttgttctaaactctgcattgtttcacctttcctttttcacaaaattatattgttccatatgattgtacaaaatttaaattttcatgtctcagccaactgcttaccaaacaagccgcttatctcgagtaacacgtagggcagtggtatgttatgagtttaggtcccaagaaagttgtttccgagtttgatgacctcactctaaatgtaaatgctactattccaaactaccataaatgctaaaaccaaataaagcatatcttccaaagttttggtttcaccataaattttcttttctgaatagcggtcaactaatacattgttattagtggcggagagaatttaaatctgtggggtcaattactagtggtttgtatttaagtgggaacatttctctaaattcttttggatttatacatgaaaatcaaggtttataggatgtttttcaaaaagttgtggggtcagccgaccccacagaaatggcctaaatccgccactatttgttaataaaacttcactaaactaatcacaatagaggggtctagaacaacaaaataaaaccatttcaagaaaagaaagaaactatatatatacacgccgacacattttcttctccaaattagtcgaaacttgtgcatagaacgaaccctaagcctcccttcctctctaacatccattcatcccacccctcccccctctttttgccgcaatctccctacctccaccttgcccctattgaatccacggcctccctaaccttttctactgacttcacatatgtggtgctttccttcccatgtccaacgatcgccatcagatacatactccagcaccacctgatgctcctagccgctacttccttttcaccccacctaccactgcccactgtagtggacccccgtttttataacaggaatcaaccgtgtaaacagtaccatttccctggatcaagtagtctggtacacacgaattcatagctgaaataccaagtgcacatacacgagtgtctagtacgaattattacatcataagcccacaggcatagtcttaaatcatcgaactgagcggtccggaatacattccaaaaacagaagtaggtaaggcagcggagtcaaggcagcggcacgccattgccacaggcaacgaccgtaactaagacctactgagcgccatcgtcttcatcaccctcctgatagtaagcgtagggatcctccgaagcttcatctccgacctctgattaagtttgtatattgcaagggtgagtaccaaccgtactcagcaaaccaccacagcaacaatgcatatgacaggggtattcaaaggatggctatggttcttttgcgcaaagcaagttttgtaattcttttcacaagcctaagacctagcacagactgatcaaattttagtaccagtgttcatattaaacaatgacggttctatccaccatccattgtgatcccaaggatagcttcccgccattgagtcgtcatggttttctgaggacgcccacattcccgcctctcaggaagtggctccatcagtgtagaaatcatcatgcaatatcccatcccacacaggttaagaatttagagtctagccaagtgtaatacatgtcccggtgctcaataaccgcgagcacggttattcgaatagatttggtttactcacactgcagtggatgtacactttacccgcactccgcgactgcccaacatatgagcctcgtcccaacacatgagacgcgtcacggcaaagcttttcgataacctcgcattggcagtacccgctccatgaactttagccctcatgcactctaggcgtcatacgtttctagcagtgagaagagttctggcgctcccgggaagggaaaaacacacacattcctacgttgtttcttgtcgttgaacccagtccatcatgattgttctcttatgggtatcctcacgtagtattgccaagccaacctctgaccatccggaatgggcatctgccatccacctggccatccgaaccgggcatccgccagcagactgcttgccgcatcacacacctaaaagaagaccactacgcatggatactgcctctgctcagctatctactccgctaggtctatacccatacgagaagtgcggttgtacgggggtcgtttcatgcttaacttcatggctcggtccttaattgactggggacggtactagcattttccggataccacccaaatcctccgtccgccccagtcgaaaacagttgtttagttttatttctcctttcacaaatcatgtcatcaacattatggcaatgtggcgctcatatctccacataccgcatctcaattaccttcccaaaggtaattgcccaagcatatagcatttgataaatatgagtatgcataaatctagagtagcatttctaagcatttgtcatagttgactagggacttattcgtaaatcatagttacaaggatttaagggtaaacaataatcaaggcatggcatactcacaagtaggatgttcatcattgcatgcgattttatttgtaaacaaaataatttcgcaattgggatcaacatgttcaaagaatagtgatgacttgcctgctcaaagtcttgcaggtcttagccttcacttggatccgcaactccctcgggttctatagttacgtgcgaaaattgatttgaattcggttagaattcaaataaaaatccaaataaatccaaatgaaagtcgaatgcgaaagtcgatttctttatattaactttactattcgcgaactaaggcaaacccaatttcgattcaaactattttgcgggtataaatattttgttgtcataagtttttaatttaatctacccgagcattatatccatataataggttagaaatttctatcgcgagctaaatatcggacgaaatcctagaaatattatacgaattaatttagtctatgactaaatgattaaatataatacacgggtaaaatccctagtaattaaatccgaatttctaccgtgaaccgattacttaaaggattacccaaaaataatctataataatctataagaattcatctatttgtttagtaattaactacatctaaattattaccgcgaattgatttcttatagaaattgccaagaataatccataatttatattaaattttgcaattctacgactataattaatccataattaaattctaattattttcaattttctaaacttccctaatcttcctctaatttctattttttttttcttttctttttctctcctcttttctctcttttcttttctttttctctctttttctctcttttctctcctcccggctcctttctttcttttccttctcttcctctctcctcttttcttcttcctccctaccggcctctcctttcctctctctctcggctcttgtccacccgagcgacggcggtggtggacgcgagggggggggaagaaggctcaacggcggcgacgacggcggcagcgcggcggtggcgacgacggcggcgcaaggcgacagcgacacccggcgcggcacacggtgcggcgcggcggcaccgagggcggcggcgcggcggcacgaggacggcgacgcggtggagggagagaggggaggaagaggaaaatggagtgggggaaatggaggggggagtatttatagggaagagggggagaaggagaggggaggggcggcggcctgatgcgacggcggcgcggggctcggggcggcgcgcgaggctcggcgcgcggtgatgggacggcgacggcgacagcggcgcgggctcgaggcggcgatggaacgcgcgcggcgacgggacgggcggtgacggggcggcagcggtggcgcgtggcgcgaggtgggacgcgacggcgacagcgcggcagcggcggcacggggcgcaaggcgacgcgacgggcggcagcggcgacgcgacagcgggcggcgcggcgcggggcgcgatgacgcgatagcaacagcgacggcgacgcggcagcgacggcgacggcgcgcggcggtacgaggcgcgaggcgcgacggcgacggccgagcggcgcgcggcgtggcaggtgacagcggcacggcggcaggcggcgatggcgacggctcggggcgcgaggcgcgcatggcaggggaggggaaggggctagggaacctcgtcgaacacctagagtgcaatgaatagtgtctttttcctatttatcccattttagtttatttcccatataaatttgattctataatttctaaatcttgcataaatgaagtttactcaatatttgtgttatctcaactaatgaattcaccctagattaatattactcatattttattggtataatttatttgaatttttaattagggttaattcttgttccattgcatttaaatctaattaatacaaatatggccgtgatgatattttatttattcctatccttacataatctttattttaaattataatttatttatttctttaaccaaatctaatttcagggttaattcctaattaattttcccctatttgtgatcgatgaattccgaaatcaaaatccaataaaatcgtcgaataaaattggcatgatgcaatttatttaaaaagtttttgaaggcccatatttttagagtttagattttttatcggtcgaattttcaggtgttacaactgtccacccttatcttacagctacactgaggctacttacatagttgtccctaccacctttgatacccgggccctcctcccaattcccctccacacccgcactcccaaactcaaaactttatctggatgtgccgccacttaggttccaagatttcatcggatatgaaggcgaatttggtgatttgagatagggtcaacgaggtatcggatcccttacctaggttgactctaggggtctacatatttgcaacatactctttccatgtgttttctcattttctatcttttcattctatctatgtacaattttagattacaaagctcatgtcggctcgattgtcagtctatgctctcacgtcagctttttttttttctacaagaaccccttttcaattttagttttagattcactgctagagaataagacatcttgatatatgatttttggagtcgatcagaatgccataacttagactaaattgataaaaaaaaagccatagatatatgtatatcagcactgaaatagaaggtgactttggatgttgaacaaaagctcgtgacttagatttaaatcatgccaaaatctatatattatagatatatatgtatatcaataccaaaatagaataaatacaactttttagaagggagaaaccttttaattgtgattattaacatcccaaatcacccctctttgttgtatactacatagaaaatccacaagtatactgctagtataaatttctcaattctaaaaggtcactttaaattactcagttacaaacaaactgcttatattgagtaacatgtaaggtgagttatcaggtttaggtagcaagaaagttgtttctaagtttgatgacctcattcttcatgtaagggctactttttcaactaccataataaatgctattaactccaacctaccataaatgctactattccaaactatgataaatgataaagccaattaaattatgtgttccaaagttttggttccgttgcatttttttcatttgtaaatagtggtcaatcaatatattgtttataaaattgtgttaaagtaatcacaatagatgggtcttgaaaaacaaaataaaatcatttcaagagaaataaaaaaggaattacatacatatacgccgacacattttattattgaattagtcaaaacttgtgcataggacaaaccttatctctaacatccatcgcatcccctcctctctgtccaccatctcccttccccaccaccccaccccatccaatcctccactttgttaaccccctcgtcgccgacttctccaaaaccagctaatatccccgctatgttttctttcctatctccagcgaccaccatttaccaccactttcgtttcatcccatccatggcgcccattgtcatcctttgatgttatggctacgataacactactttcatagtcgcccctacctcctttgacacctagcccatcctctcgatccccgtccacacccgtgtcgcaaacttgaaaccttatatggacgtaaccacggcctagtttcctagaaatcatcgaagatgagggggtgagaatttggatatccgaagatggggtgagggagatggagggggaggggaacatgggtcgaccgaggcgtcagatcccttgccatggttggcacatggtgcgaacaactagatctacatgtctgcactacaaaatatcgaggtatttctttcgacgaattttctcaattttggttttgcttaattctatctatgtacaattttagattacaaaagtttgtatttgctcgattgttactctcatactcttgtgattgttttgttctatcatcaaattttagttttagatttactaccaatagaaaagtctttggtatacaaattttagatatcgaataaggggtatctaaaaaattaccataagttttttttttaagttttctgagtgaaaaactttcaaatgtaactatagtataattaaagtgtaactgtattgtaactatactttaactatgatataacttaataaaacttggatttaaccatgttttggttggttagaaccgagatcttacgcatgacatatttgaaacatgcaaaaatcttgaggaagtccgatggctagaaatcagcaaatttgaggataaaaacttatggaagttctcaagcaattctgttgaacaaaacctcataacttagactaagggtgtgtttagttggggaa

SEQ ID NO: 9848 - DNA, 953 bp, Oryza sativa
gccgccgctcccgaccgccatagccgccgccgctccccgacctctgcctcgaccccaccgccatcgcgccgccaccactccccttcgcctcgtccccatcgccacagccgtcggcccgccgccgctcccgagagctataagggagagagagggggaggaagaagggaatgagggaggatgacatatgggttccacatgtcagtgggtcccacaatatttttttgtgtgaatgacatatgtgtcctacattttttttaattattgtttttattttaatgccacgtaagctccatgtaggacaaagattcagtcaagaccaccacgtaggcgccacgtcagccaaaaccacctccaaaaccaccgagggacattgtttgcaccggttatatacccggtttgtggttggaggatatgaatcatactcgggcgatagttgagggagtcaaagtatactttttccaagtagaaactgcttaacttgaaggcccatgaacgggaagcccaatatcgaatagtagaatttttttcgtttttagattttttttaaatatttacagaaataatctatcgaccaaaaaaaattgcagaaatagcccctgccgccctaatggtgggcggcaagctgacgtggcagacggtgggtcgaccgcgccgtcggccaaaattgcgattaggcccttgccgcccatacagagggcggcaaggggctaattgcaattttggccgcccataaagagcttgcggccgtactttttcatctgggtccccagatgaaaaaagtacggccaaaagatttttctatgttatgttaataataaataaagaagtatttattggtaaaacttgttaatattgttataaaaatgtattgaagttggttgttgcgtaatttcatatgttaagtgaggtattattttgtaccttattcgacgtattagtactcggataattta

SEQ ID NO: 9849 - DNA, 26831 bp, Oryza sativa
  unsure (1)..(26831): unsure at all n locations
aataagtatgtgcaccttttatttttagagcaatttacagacaattattcaatcgaatccctctcaataataactaatggccaagccaaagaaataagtagacccccacaggaaagagtactaagaatatcgcatataaagatgttatttacgggtaatcaaagattggttcgcatgattaaaattaattcaaaaacataatctacaagataataaattgctgatggcatgccctatatctaggtagaatgaggatatcaactcatgggaccaaataatagtcacaaatccggttctggacacctatgtgtttttcaagaaactcgttcgaaccaataaatttatttgtctagctaacgcaagggttcttagttcacactaaaattgaaagtttggttgaaattagaatgatgtgacggaaaagttggaagttttgtgtgtagaaaagttttaatgtgatagaaaagttaaaagtttgaagaattattttagaactaaacacggcgtaactattcaaatggttaggaacttgtcaggttgtcttctatatctcttcgtgcgtgcttggagaaatgaaccactatattttgctagcttttaaggtcagtcccgactagcattgatcatttataatattatattatattatattatattgtaaataaatgcatgtgtaggatggtgacaagctaaggcagccattgttgctacatctactaatgtaccaataaaataagtgtgaaagcaatattcctagcggcccacgagattttcttaactgtatcataaatgctaaatgttacggtagttattttcatgcagagtatattctacatatgtatagagtgctttattttttttacttgcttacacccgcaacaaattaataaaatagctctatatttttaacatattttttaaacatataccgccttcatatattgtatactgaagtgattatatacaattaattctggtcaagatttattgtgccaaaacaatatcatattactgtactttgtgtgtattttatatgaaatatatttgatatacaatatgaattgaattagagctcaattgtagatataatagaaaaatattatttttgctaacattaaattttaaaagttattaaaaataaatagaatagcaccatagtgtttagcagcatatttctagtttttatggttgttttgatatggtcttggcaattgttttgtagcggtgattggtgatgaaaataagaatgaggggtactgttttagatgtcttttaatcattggatttgtccctgtagaggttgtcgttctgaatcaacatatggatagaagatttgcttatcattttaatagctcaaatgttcaaatacttgggcaatacgttcctaaaattttatagtggattgcatgttcaaggcaagtatgcatctattaagaaaagttggtgagatttagcaagttgtttataattggttgagaaaagatgatagataaggaattactatggtgtgtttgattggatgaaaatagaatattggtagaaaagttattgtatttttggattaatttaaaaggttaaaggttgtcatattttagaacagatagagtatttaaaattaagtttgaaatatgtataacagtgtgacatgtaggaccgtgcatgcctcgacctgatggatctgtacgcacgtagaagtcatggcacttgcgccatgctgctttgcctgcttgctgtcgagtctcgcacgaaatcgctaaaaacagtctcgcagccctccgcgacgccgcgcccacgccaggtctcggtttgtcgaagaggtcaggtccccggaaaagctagcgcgcgggttggcggcgagcgttttcggatagtttagcctaactaagtgaagttattagtagataataatggtaattaagatatgattatttttcgaaagatttttttttgtactaaccgattgaaaactttcaagtttgatttgaaaatctttgaagtcaaattttaaaaaatttcaaaactcaatttgaaaattttcagctcaaaatttaaatgtgtaagacaaatttagaaaactttcaactcagatttaaaaacttttatctcgagatttaaaaactttaaagtacagatttgaaaatttttaagttaagatttgacaaaatatgaaaactttcgactcagatttaaaaactttcaactcaagatttgaaaacattcgactccgattcgaaaacttttgactcaagattcgaaaaatttcaactcgatatttgaatactttcaaatcagattaaaaaaatttcaagttaagatttaaaaactttgaaaaaaatattttgaaaaatataagtgtgctaaagactaaaaaaaagtaataaaaaaactaaaaaaaagaaaaaaatcgcaaaagaaaccacgaaaaaacaaatcgcgaaaaaaaaaagagcttatgggcttttctgagccagaagcagctggcgcgcggcaactagtaacgccctcgagtctcggcggcatgggcatggcacgcccatcacttattcgcagcgaccattcgctactgatcgccgcgcacgcaccgcgcgagcggacggacgacaggtcgaggctataatggatcggaatatgggaggctctggcatggagcccaacgaaaaagaaagcaaggcccatagcaccgcaccgtaaacttgaccgagagaacctggacgaaacccaaaggaaacccaaatcccggtaaactgatttgagctttctggatgaaataagttcatctgaggtcttttaacttgtcaacgaatccgatttttatccttcaaccaaaaaaatcagatacaacgtatccctcaactgtcaaaaccagtgcaatataggtcccatgacggtttggacggcggttttcgctgacgtgacgcccacgtgactattttgactcggtcttcacatgacgtggcaatgacatggcgcttacgtgacaatttgatttggaaaatattaaaaattgcagatccacatgttagtttacacaaaaaaaatagattaaaaatggtgggttctcaccctcctcttcttcctcctctctacccaactcccctgtattcactctctctcccctctcctctgtcctctccgacggccgaagagagatgcggcgcgcggcagccgggcgaggaggggcggtgccattctgctgggcatcgtgggcggagcggcgggcggctgaacaacccctaccaggacctcaatatcccctacaagcagctctatgacctccccacctccctggagttcctcttccaggagtcgctcgcccagcgctgctcatggggtgagaacctcacctactacaccagcataggctaactctcgggcgccgccgtcgacctccgcgacgccgcccgcaacgccgagcccgggacaccgctaagatccgggtgaaccgcatcctcaactcatgcggcagggccactgcatggggaacacgctcagggtcatcggcctgctctatgccgggagcccgggatcgagagtggcatggtcaccgtgcgcgaccgtgacgactggatcaacagcgtcaccgtggggctcagcactggcgcgctcttccgcgccgccgacgggtcacgctccgccgccatcactagtgccatcggtggggtcctcaccggtgccgccatgtcaggcaagcaggcggcgaagagatatgtgcccgccctctgattcgtctgcacagtattctctctgcccctcctcgcccggccgccgcccctcctcacccggcggagaggacagaggaaaggggagagagagagagtgaatacatgggagatgggtagataggaggaacaagaagagggtgagaatgacatgtgggacccatgtgggtcccatcatttttatcttttttttttgtaaactgacatgtgggtccacaatttttagtattttctaaataaaattgccacgtaagcgccacatcatttccacgtcatgtgaagaccgagtcaacatagccacatgggcgccacgttagcgaaaaccgccgtccaaacagccatggaacctatatttagacagttgagggaccggttgtatctggttttttggttgaaggacgaaaatcggattcgttcacaagttaagggacctcagatgaacttattactttctagattgggcgaggatcccatgtgaattgggccttcggggattgagcgaggatggagaaagtctattttgctccgttaactatggacgcagtaaaatcagatatgtagtcccctcaactattaaaccggatcaatttgtctatcggacggtttttattgtggttttgccgatgggtcccacctaccattaagtgttccattatctttatctttatctttgcatgtagcctagtagttgcaatgacctgagtagcaccctaagctcctgagttcatatctctatagcagcgaatttcagatttggttgtttgaggggctaagttccaaaattaagaaggttgcatacattcggttggatgtagatgttgggtaaaaaaaatccttctctaaaaaatatctttgttctctctccctcggctggacacaatcacgcaaagatgggtggcatcggagcctcgttccgaggctagtggctaacgaagaccatcggagccgagcagtgagggcatcatcaaaggggataagaacatcacgaagtagcccccaactccaaacctacggctggtgttgctttttttttcatctggcaacggctgtactttcctcttctcatcatggcggccatggacattgtacctgtggacggccccaaggtggtgcagattttgagcggcgtggtgtcgagtgtgttgtgcaccaactagaggagtggcgatggtggtgagggtaggcgcggtgtgcaacgacgagatcaggggcaggtgcgtcgcgccaacaggaggagtggcggtagggtcggtgcaggcgtcggtgctgtcgtggtcattggacggggagaggtcaaggttggagctacgatcaggtgatggttgggccgaggtagaggcagagccagtctccgaccccatcactccttccctttcctccactcttccgcaggaggggaatgacctctgctgctcttgccaatgacgaggaaccaaggaggaggatggaggggacgtcggccggcgcacatccaccactacctaggcatcttctctgttggcggcaacctctcctcaatgttgtcgttgcttgtagtaccaccgccctgcacagtgctatcgtccgtgcaatttgggagagtggaagaaggggatggctttcactgacttgtggtcctagtcaaggctatgtggcgccacgtcaaaggaaaccagtgtcaaaatcactcgggaggtagattgactggttttttttttttttgaggggcacgaatcaaactcaacctatagttgatggtggtaaattggacttaatccaaagagatcgatcccatacgaattgggcctttggaattgccacttgagctttcactgcggtatgtgggcccactgacaacaacgttgcttaaggccgttgataactttacaagaatacatcgaaggagagtggagaggaaaacaacgagctcatcagtgaccagagagccagaggtccagagcagaagataaagcgcacagctgacaacacacagatgccaaatccggcagcacgacgaagcttctacccgatcgactgaagtttagcgatagccggtaatccgccctccagattaaaataaaatcctgacgccttctagaaccccttgtcgcaagcaaaagccccatcctaatctttcccatctgcaaataagaaagaccacacatcgtcggtcggtcctactaatcattcacaccccccccccccccaccccccccgagatctctccacagacacgagaacattgagaagcacgcgcgacaggaaaaaagcactgtccgtgcgacgtcacctcgcccacgcaagacgctgtctcgccggtcgatcgtcatgtacccacgccacgcgagtactaccatcgaacagcacaaccatcgatcggcacagctcggttttacggtcgcgcgactccgaaccatccaagggaagacgccgacggcgacaaaaaagaaacccaggataccgccccgcccgcccgtcccgtccgacgtccgcgtcacgcacgcgcgcctgctcttgccgctcgatccattagagaagtttaattttatagccaactattacttttaaattatttatagtcaaatttttttataggatatttatagtcaaattaataatcaatttatacaatagttatctataaatataataaatatatgctacactattaatttctgatcccacctgtcatacacatattgtttcttaaagttcgtgctacagctgactataaatttgtagcacacgactcttctcttttctttttatcttcttaaaatatatttatggctataaatcttcttttcatctccttagagtctgctcttactgatcggttccgtctccacccaccgttgcgttgagtcgttgacccgcagttcccctttgttttccacgtgtttcttccacaaatcgcttggcgccgcgtccgtgcgagcccccagccgccgccgagcccccacacatccatccactctcgcggactctgaccagctgaccgctgcgaaacccgcccgcacgggcgcacgcgcgcgcccgcgcccgctacaaatatgctgctcccccgcacgtacgccgccgtgtctcatcacgagctcgatcgtttcccttcccccccaacctgagcgttccaacttccaattcaagcgcgcgcgcgagagccgatggatcatggcggcggcgagaggaggagcgccggcgcctacgaggcggcgctgagggcggtgcagaggccggcggcgaagccgtggcgcggcggaggaggaggaggaggcgcggggggatcggcgggtgccgcgggggcggcgccgcccaaggtgtaccgcgtggcgcccagggacttccgggagctcgtgcagaggctcaccggagccggcaccgcggcgccggcggtggccatgggcgcgagccaggctgtgcctgcgcccccgccgccttacgcgggtgtcccggcgcacgggcagagcgacgcggcggcggcggcggacatgttcgactacgcgtcgtggttctccgtgccgctgctcagcccggcctccatgccggccgccggctacgacggccagctccaccatggacatggtgctttactgtagttttagtatagtcgctgtccttgtaagatcgagccaaattttgcagttcgatcgcttcttcttcctgtcgtagaacgcttgtattagtttcttcaaaaacaacaaattcaaagaattcgatgaataaacacatgaattagttctcggcggcataaagaacacaattttcagtgtttaatgatgtgactaccctctttggtttgactattgctgacgtgtaaattattccctggttatcttgggttcatcgttagctaggcctaggcggctgtggttaatagaacttaattaagctatcgttgtcaacgttgaaacttttgttatctagatggctcaaatttagcatgtgagaattcggcttatcaaatttcgcatcttcttgtattaagtaatgtacgctcacagacaaaggtaatggcatgcagttgcttcatttcattatgggcgttcaggggatgcttgactaaccggaccaagttgagtactccatcctccgctccaaaaaataatataacgtttatcttatttaaaaaatcaacataaatatgtaaaaatataagttaaaattattttttatgatttaaacgtcacagcataaataaataatatttatatttttaacaatatgaatagtcaaacgtcgtgaaaaaaaagttaaacagtgtcgtatattttaagacggaggtacgagatagtagttgagtagggatatatttcacctgattttactttcgatggacaacataaaggataaattgtcatcaacaatatcttatcgttaaggtgatcgttgtctactacctccgtcctataatataagggattttgggtgggtgaatgtgtgtccagattcattgtactataatatgctatatccatccaaaatctcttatattataggacgaagggagtacttatctagattagagtgacatatccacccaaaatcccttatattatgggacgaatgaagtacttatctagattagagtgaaaattcgccgacacgttcaattcatcgcttgaacgggctgcggttgatggcacgaggaagtgatcacatagactcagttatatttgaattttataattaacctataggttaatttatccctccccctaaaaaagaaactctagctagagtttctttttctgttgatttatccctccccctaaaaaataatttttggattgctaatagtagaaatataaaggtttaccttaattaaaaattatttgtttgttttttttggttaataggttataaatcagccggtgagactcgaattcttacgaaagatctcagggaaccatgtcccctgaataataatgccacggtaactttctcatgctgatccattggtgaattcctaaagtctcggtacaagtttgatgaacaaccaaggaaattgaaagaaactatatttttctatatactaggtgagatccgagctttactacgaaatgcatatatagatgaattggtgttaaatattataaaataatggatggatatatattaaaatatttgtggaaataatgtgatcaaaatgatttggcatacttatacgagtcatgcttgcatgagatgagattaaaaatgctattgttttgagactattgtcatccaaacttataattaacatttaacatcatagatgagcttaaatgaaaaatttgtccactccaaaattgtatatctcgtctatatctacaactttcatataggttttatcttcatctgagattgtttagaaaatttaaatattcatttatgtaaatagatccgagacattaaaacacagtttcggatatccaaacgaccttcaatcaaaaagtcgtctactataaaattgtaggtctcatcaagctctacaaatttgatataaaatttatcttcatccgactttatatgaaaatgttagataaaaaatacacatatatgagttggtgtcatcataggtgtcatttttaattataaaccggaagaaccagcacatatgtgatgcatatatatactgattcatgataaaaatcgatacctatgacatcacacttatatgtgccggtttttgttacaaacttgtaccgagtgattataggtaccgatttattaattttatacttgaaaaaggtgaaattagttttatacttgaaaaaagtgaaaaaaaaagcttcatgggtgtccttttttggtaaaccggcatctataagaccggtctctatgtgatgttttgtagcagtgttaacttggcatatcagtaaaaccagttatctatactaccggaggacttaatttaacgcagttttataagttaggagttcaatatttctactattacggtttaaaaataccgattaaacttgatgtaaacatgaggggttgcaagtgaacttattatgtgcagaaaccacccccacaaggcgtcaaccttcaaggcctgtgacagtgtctactgtgactgctgggccgtgagctgggcctgagggaggagggagatccgtagagacaaggccacaagtggacgagatagctagttggcgataagtcgcacgcccccctccccgcgcgactagacacatgtcgcgcgtggagagggggcggcgacgcgccgcgcaggtgaggaagagcgagttttccctcttttttttgttttttttacgttttttccgtttctgttcggttagttttcattttttttccggttcggttggtttatctttctttttccggtttctcttctgtttttttccccttttttttaaattttatgaatataaagtttgtattcgtatgtatactaagtttgtatttgtatgtatgcaaagtttatatacgcgtatgcaaagtttgtatacgcgcatataaattttgtatatgttgtgtattttttagtttttttattttttaatacgtatgtatataaagtttgtatttatcgtatacaaagtttatatatgtcctatataaactttgtatacgtcatatatatatataaactttgtatatgtgtatatattttttatacattaaaaatatatttatatatatacgtatgtacttactatatacacacgtgtgtatatatagtatatacatacgtatcagccgtccccacaagtggacggtgcagcatccctggcagggcgccgaggccatggccggcacagcagttcagcagtgacagcagcgactccaattcagtgtcgtggaagacggtatacggatatcggacggagagggtaccgctaaacgattaatcggaatgcggacgattaatcagaatttggcggaaatataacgttttgaaaatatatgtacatagttgataatagttttcccttctatatatccttaaatagaataaccatatatgatatttaaataagtttataatggatagctgttactgtatatctcaattctcatgtagtgatgggttttgttcataatgcatgaaatgaattatcaagagaatgtagtacatagcataaatgaccgtaatcaaggttccaaataacatatgtatcggcttcatcaaatacaaactccaataacgtgatcatcgtcaaaatcaaggaactcatgttcaaactttagaggaagtcagttccttgtcattttacatctttctgccttgtgagaatttcggaagagcaaacttctagtcaatagtagtaaagggcacagctaatgagttggattgtggaatcgacctttgtcaccacgctgattatacggctgattagacggagacggacgatttaatcggtaataattggatttatgcgtttgttaccgactaatgatgaccgcatcggcgtgacgtgacggactgatctccgtatccgtattatcggacgtattaatggccgttaacatcgttttccacaacactgctccaattaggaaaagagaggaaatgatcacaaagaggtaattgatgaccttatttaatttgaaaaccattactcattagcaactacaaattaccccattgacaagtagtgtagcagcattgcagcatcagtaagagaacaagccaagagctagaagcagaggagtaatgcttttcttctctcctgacccacctaaattttgggtgttctctaccactgggcacaggcaagcttaggatgatgaccagcgcacaaatctcacgcaaggaagggaagtcgttttgatcctgggtatgtcccctctagtttgttgaactatttattctaaaaaattaatataaaatcttaatcttgaactcaactcacaataagataaaaaaaaggattattcatagattgaatatgtctttttctgtatgtgtagttgaatttgaacttgttttggtagagtgatagatgtcggtgtactctacatcatcaattgttttgtataactgtttgtatttaatttagaagaaaagaaaaagatgcacgagggacatcactccagtgattagaatccggttccacaatgggaactagattctctgctgttttcccaatcacctgactagcaaagatgtttacacatagctagttctctttattgattcatggcgatgtactataccacacacacgtaccacaaccagctaataaacagagaaaggaacttaaacaagaacacactgcatgcatctgatctgattatagctaattaattaaacaccagaaagcatcacctcaaacttttaaccgcacatatatatatatatatatatatatatatatatatatatatatatatatatcctcttcatcacacaccctacttgtactcttcacagaacccagtgaatccgtggtgccggcgccgatatatcgaactcggcgtttgggagattcagcagtaggcggtgcacttggtcttgcagtcgatggtgcagccgccgccgccgcccccgccgccgtagcccttgccggagctgctgtaggacgagaagcacttcttggggcacgtcaccttcttcctgtagcacgggcccttgtcggagcacaccaccgtgggcaccaccacgccgccgcgcgagtacccgccgctcggcgtgccgtaccctccgccccacccgccgcccatcccgggcacgttgaacccgcccatgccgccgcccatccccgggatgctcccgaaccccgggatggtcgggatgccgccgccaccgccgccgccgggattggtgcccgggtaacccggctgcacggacggcttcctccccgccggctgcttcttggcggatggcgcggcggacatgaggtcgcgggcggcgaggggggctgtggcggagagcccgagcaggaggaggaacagcgcggcggcgacgcgggcggtgctggccatggctaagctttagctagagctagagtgagctcccttctcgtcgatctcgtggagttaagtagggaaggaagagtgagggtgtgttaagtagtctaaagtttttgaaatatacggaacacgtatatgaagtattaaatgtaaactaataacaaaacatattatatattttacctataaactatgagataaatttattaagtttaattattatattattagtatcgcattgtcaaattatagtgtaattagacttaaaagatccgtctcgtaatttatatgtaaattatgaagttgactttttctatatttaatatcatacgtatatatttaaatatttgatgtgatatttttggctaaaattttttagatatagaaaaaggcaggatgggcaataaaggtggcaagatatggaggaggttggggaggccacaggcgcagcgcatcaccagcagtgcaatgtcagtggagtggagttatggcctctctttgaagtttgaagttttggtccggctcgccaccggcggtgctctaccttttgactcacaaatcttccatgtcatcatcatcatcaatgaaggatacattacgatttttcgtttggccgccggccaataacgcgactcacgtgaacgtccgtacttgacacgcccgcgaacgttgtgctacacctgtttttttttttcggataataaaagaagaatattttttattaagaagagtaaaagtatttacaggtgttgcaaaaccaagaatgaggaggagaaagaatacatgagaaaaggactgaagcctactctcacagaacattttgcgaccaaactgtcctcacgttatcggcgttggagctgacatatcaccgtctcttttgccattgccttcccaacctcctccagtttttctgttattgattaaatacatgattatttcgctctttccaaattgaccaagacgtaggagcagcgatagtgtcgaatccttggtgtttggatttggcaattttttttcctgttgtcgcacaaccaaccatgtaaggatcctttattcattggagagcattttgggtgatcgattgtcctgagtatcagccaccaaagctgtctcgacttaggacatgtatccagaatgcgatcgatgcttgcatcatgttgagcgcaaagaacacattggctagggtgcggcaaacccctgatgcacaatatgtccatcgtccaacatcgcttcagagcaaccaatcatacgaagtagtaacaacgcggtggtgcgagcgattttcaaatcggtgctgattgaaaggagactcttgcaaggaacaatgcttggtaagttgattgagaagggaaggaagggggaggggaagagttgggaagtttctcatcttagagagatactaggagatgcggcggcctaaggttggaccatggagatggggcgcaacgacggtatcgctcgagttgtgaggtcagcagcgggagcaaagtagaatggagatgttaggaggcgaagggaggtgctaatagatccgctcaccaaaggtggagaagggtggggcaaatcaactataagagacggatgaggaaggctaggtaggggcacctcaccaaagcatgaatgtgtggtcgaagggaggcgtcaatgtccggccgtccatggtggagatacggaggatgggggtgtataggtaggggtgggcattcggtctaaccgaaaatttcggtctcaatcttcggtctttgaaaagtaaagaccaaatttcagtgaaaaaaatgtcaggaccgacaaattcggtctcggtctcggtcctgaccgaaattcaacaacattttcatatatgcaaagaaataatagaaattttcaacacaaaaatcacaaaaaaaaaatcgtaagcacttatgagtaaagactcttattatgttacatgcctaaaaaaggtaggaatgtgaaaattagagtttaatcctattaaacatagtggattgtaggttgtatttatacattttttgataattcggtctattcggttacccgaggagactaaccgaattgaccgaacaaaattcagtctttcactacctaggaccgaattgatgaccgaatttcttggtctcggtctcggttttttcggttcggtcttttttttttgcccacccctatgtataggaataaggggtaagatctcaaccgttggattacaattgtatggtccaaaaattgccagatttgaacctaattttctatcaaattatatatataggtaatccctctatttttcacaaggaacatatgtttctctttctctatagatttaggtatgtagctaatccgattgcccacccacttagcagcaggttcgacatctactataaaatagagaatccacttcacaaccacgtctctgctaggcagcgtgtggaatggccgggaacggaccaaatggatataatccaagctgagagtggagttacgtgaacagccatatgatggaaaacaactttcatgttcatagagagcagttcttttcgttgagaataagtccttcccacatacaagtctgcaactcagggcctgtttagttcgcggaaagaaaatttttgggtgtcacatcagacgtttaaccggatattggaagaggttttcggatacgaatgaaaaaactaatttcataactcgcctggaaactgtgagacgaatcttttgagcctaattaatctatcattagcacatgttggttattgtagcatttatggctaatcatggactaattaggctcaaaagattcgtctcgcgatttcccccctaactgcgcaattagtttttttaatttatctatatttagtacttcatgcatatgttcaaagattcgatatgatgtttttgagaaaaaaaatttggaaactaagcagggcctcaatggattaacatcccagtcgtgcacgctgtttcgtcacacttgaatcggatgcatggcacgtagtacgtgtggtgtgcaacggtgtaaaaggcatccggtggagcgatcaagcaagtcgccgacagtgaacgtgggaggaattgaaggcgagggagacggcggctgatgctgcggcatcatacaggtcactttctggcaccggcgctgctcctgtgtttcaattcgttcagactttcaggtcatttgggggtgaacatttatgaggctttttatctgaacctggacagtgctgaggctgtttccagattggagaacggaacacccgaattccagatcatttctgaaccatccacattgtaaggccgagtttagttcctaactttttcttcaaactttcaattttttcatcacattaaaacttttctacatacataaacttctaacttttttcttcaaactttcaattttagtcaaacttctaattttagcgtggaattaaacacagcctaaggttggagtaggagttgtagggcctatttgggggagcttctaactgttgcagcttctcccagaattagaagcttccctaaacagtacagcttttgatccagattctaagaagctgtagttgtagaatctagaaaatgaactagaagccagaagctgggaaacccagcttttccagattctgagaagctggctaccaaccaactgtttctcagaatctcaagctcccccaaacaggcccgtaaggccatctacaatcggtatccccaggtcgtgcccctagccgacgtcgtcttgttccaaacggaaaagcaaacgaggcgtcccctcgcaggaccgcgcgacgcctcactgggggacacgcccccagctcgttctcgcgcaggcgctcggggtgaggcaacccattgcgtgggtaggttcttgaggcgacgcaccccagagcttcgatttcctcttccacccctctcccttttgtccccggcccatgtgttaagggcgaggctgaggcgccgctcgccgccggagagaagaagggagggcgaggagggaggcggcgccggcgagcgcggtgaagaaggcaacggcgccatcgtcgatgcggccaccgccggcaccgccacagtctcctcgatgtagccgctcgccgtcggagagaagaagggagggcgaggagggaggtggcggcggcgagcacggtgaagaaggcgacggcgccatcgtcgatgtggccaccgtctcctcgaagcagcgcggccggcgccgctccatccgccggggggccagatccggccacggcggcgccggatctgccgcctccagggtcgccaccgccaccttccacgggagagagagagagagaggccggatctaccgcctccggccaccggacgacgacgacgactgccgcctccaccccgtgcccttgattcggaggcggcggcgggagacggtggaggcggcgggagagagagagagagagagggagagggaggcggcaggcggcggcgagagagagggaagcagacggcgagaggaacgacaggcagagggagagaggaacgcgcgtacaaagggagaaagagagagaggggggggaagagcggggtagaattggaaatagaggaagaggatagaggattttttttggttggaacactcattggactactcagatgtggcctgcattgtagaggtgagtaccctcagttagcgagggcactatagaagtggcttatactgtagatgccctaatttagatcaagcttttaagttccttgtatgaaagtgcaaaccaactcaaaacaatttactgcaagagtctcattctcggaactcacttgctgcagaccaaaccagttgcttgcatccagcggcggtggatgttttctgccataaattgctgtatctgctcggctgaccaaccaaattactgtcctaactcatttgccatgcctctgcatcatcctgcagataggccacacaaacagcaagctgcattccattgggagaaaacagctagatgagtcattctaaggaggacccactcgaccatgctttctgcaaatatatctgtatatctctcatatctaactttcttagataatggatggataggaaatcggcaatctccatcctctgttcatatatctgtgatctaagctaagccactctgttttatagtattcctatccaatatgagctactattgtactactcctctatagtctatacacgtaatgaacaccactcaggaatcgctaacaataacatcatgtcgtcgcaccgaaagcagggggcaagtagataaactcatgagttggaacttgcaagtcacaggctaaccaaaagccaaaagcaaccacaatggcggcctaagtgccttttttcaccactgaatttacatagaagagtaactagtagactagatacaatttgtcaaggctcaggtaacataactaattaactgagtagtactaataactattgttgtggggagatggaaacaggatcaaagaacctctgttgtgttcttcccaattgccatcttctgcaggccaaaaacaccacaaaattcccaccctcctggctaaattcctcagcatggcatcatctgtagaactacaaaactagcagaatatttactgagataaatgtataacacacacacaaagaagggctttagttgcattacgaatttgcagaaggggaggaaaaaaaaagcatgtttaccttgatagcatcaggaatcatcttcatcctccccatcttgcacaaaaccccctcccatctcgcaaatccagtcccagaccttcgccggcacgggcatcaccgacagccgaggctgccggagcagcgcgaactccctcatcccctccacctcgccgccgccgccgcccgccgccttcttgatctccccgagcgccaccggccgccggaactcccccaccgcgcggacgtccaccgcgccgccgctcgctgcctccccctccccctcgtaccactccctggcgacctccacgacgccgacgacgcggcgggaggcggcgccggcgccggagtggtagaagaggcagcggtcgcccacccgcatggcgcggaggccgttgacggcctggcggttgcggacgccgtcccacggcgcgacgccgccgccgggggcgcgcgcctggtcggaccacgaccactcccccggctccgtcttgagcagccagtacttgcagttgccggcggcggcggcggcggacttgggtgctgctttcttcgccatcccgcgtggattcggagctccggcgatcgccggggtgaggcgaggcgggttgttttggcgggaaattgggcggctagggcttgtggttgcgcggggaattcccaatctcaccatcgtcttcccactcccgctgcctctcctgctcccaaaacgtagtagaaagatgcaccttggtatgagctgggccgggctatctataagcgggctttgtccagataggcccattatgggaaggcccagcaagatagatagacaggacggactttttcaacttcaaactggcaaggaaaaagtatactgtgactccctcaactatcgccagagtatgattcatatcctccaaccacaaaaccgggtatatagactcctccaattatcaaaaccggtgcaaacaatgtccctcggtggtatactttgactccctcaactatcgcccgagtatgattcatatcctccaaccacaaaaccgggtatatcgactcctccaattatcaaaaccggtgcaaacaatgtccctcggtggttttggaggcggttttggctgacgtagcgcctacgtggtggtcttgactaagtctttgtcctacgtggtgcttacgtggtggtcttgaccaagtctttatcctacgtagcgcttacgtagtattagaataaaaacaaaaataaaaaaaatatgtgcgacccatatgtcattcacacacaaaaaaaaaagcattgtgaaccgacatgtcatcctcccactaattcccttcttcctcccctctctctcccttatctctctctcaacctcccgcctttctcttcatcttggccagagcggcggcggggacggcagtggggagcggcggcggcggtggtgaggacggggtggtcggaagcggcggtggtggcggtggggacgatgacggcggggagctgcggcggctgtggcagtgggagcggcggcggcggcagtcaagagcggcaacggcggtggcggcagcggtcgggaacggcagcggtggcggtggggacgaggcggcggcggtcgggagcagccgaagcacgagctgctccccgaggatgggaggtggttcatggatgtcttccatgtcaccaaccgcctcggtggcaagctcaccaacgacaacgtcattacctacatttgagcaggttggtaggttttcttggtggtttcttgatggaataagtccatattgcctccctcaactcttgccattgtttgaatcatctccctcaaccgcaatattggctcccttggctgtttggatagtggtttcgtcctacgtggcacttatggacccacatgtcattgagaaaaataaaaaaataatcatatatgtcagccattctaatcttaattatttttcttttccctcacctctctctctcccctctctctcgatctccgacgaagcgacgatgacccacccgcctgtgtgtcctctccttcctcggctggagccagcagttcagttgttcgcccgccgccacccctgtagccctatgccggagcaggctcctacgaaggtcatgacagtgccccgggcgagggacaagcacgcggacggcctcgtctagcccgttgacctcgccatcttggtcaccgacgccgcccaaggcaccatgcccactggatttgtgcgtgacaaggccgagggaggcaaatccggtggtgtcgcgcccctccgccacccggcggcacatgtcccgtgctccctcgccgctaggagtgcttcgagcaagaagagggtggaggagtgcttgcgacaagaagtctacgagaaggcaccgacgccggcaagaggtggcaagaagtgctcacgccatccttgcgacacgattcagtcaagcgccaacgcatatgccaaattgccattcttgcaatgcgatttagctctcatcactcacctctcgtctcgccagcaagtcagcagggaaaatcaccattggcctcttcggcgacgaggtccccgccggtgcgtcccggttcttgtcgcttggtgttggctagtcaagattgtgtggggctacatgcaagcaggacggcgtgatgtcacacccggccatcccggtgactgaccggctagcggcggagatggacgccgcacgcacacgcaatgcagtggggacaggagtggcgtccacggtccacccaactcccgcggcagaaggcggcgaggcagcggtgaccgaacaactgagcttgtggcgcccgtcgaggaagaagcgaccgagcgagcaagcgagtcgtcactggacaccggaggtggagagagagagagaggaggaatagagaggtgaggaaaaagaaaaacaaataagtgtaacgtaggacatgtgggggttattattttttttctcactgacatgtgggtcccctaagtgccacgtaggacgaaaccgctatccaaacagccgaatgaccaaatttgctctggttttcaaagatggaggaggcgttatatctggtattgcggttgagggaggtgattcaatcaggggcaagagttgagggaggcaatttagacttattcctttcttgattctggctcaagtgttcgacggtgttgaggttttctgatggcatagatggcttctttgcagtctctggggacgtggaacaggccggcgcggccggcggtgctcgaggacgaggagccccacgcgtggacgcaccgcggccgcctcggttgccgaaatcgctattcagcgactggtcgcgcgcccttccccccgcgcggatggacgcgtggcgcgcgtaggagggggagggggcgcggcggccgtgtgcaggggggcccacgtgggtttttctcccggttttttgagttttggttttccttgtttttttttctttctttgttttttctggttttcatatacgtatacaaactttatatacgcatgtatatactttgtatatgtgtatacaaactttgtatacgtaattttttttctcttttttgatttttttataatatgaacgtacctatacaaagtttatatacgcgcatgcaaagtttgtatacgcgtatgtaaagtttgtatacgcgcatgcaaagtttatatacatgtatttttttatatgtcaactttttggtacatataaaaattatatatacgtatgtatatactttatatacacataaataaactttgtattttgtattgataaatacaaagtttataaatatgtatacaaagtatatacatatgtatatatacacgtagtagtacagtagtacactagtactgttgtagtagtagtactactactggtagtaggagtagttagtagtagtagtgcgccagcagaagcaatagtagtagcagcaccagcagtagtagcaccggtagtagtagcagtaggagtagtagacaagtactagaagcagcagtaggagcagactggtcgcgcgcccacgctcccgcgcgaccagtcgctagttagggccacccctcggttgcctcgtcttcctccgcaacgaggaggccgacaccgagaggatggcgcgcatcgaggcccacctcggacacctcctccacggtgactccagcagcgtcggcggcagtgccgtggccactgtccccgccgccagcgtcgcgcacgccgagcgccgcctccaccagctcatgtcgcctgaccgtgaccaggaggagcgcgcgacgacgtccccgagacccgccgtgtccgtccagagctgcgtggagcgcggctactcggtggtcaccgtgcaatgccgctaccgccccaagctgctcctcgatgtcgtctgcacgctcaccgacatggactacgttgtgttccacagcaccatcgacaccaccggcgaccaagcgcaccaggaatcccacaatactttttttgttatgtgaatgacatatgggtcccacatatttttttatttttgtttttattctaatgccatctaaacaccacgtacgataaagacttggtcaagaccgctacgtagatgacacatcagccaaaaccatctccaaaaccacagggacattgttttcaccggttttgatagttggaggagtcgatatacctggttctgtggttggaggacatgaattatacttggacgatagttgacggagtcaaagtatactttttcctcatgaccctatcatttggcttattccatgaacaaattatttgcaaacaaaaaataatttgtgaaaaaaaacgaggaaaaaaccccaaaatcaaattgttaaatgttacatttattaaaaagaacttttatataaaagttttttttttaaaaaaatcaaataaactcatttttaaaaattgtaataattaatactcaattaatcatacgtgtgctaatataaaagtttttttttaaaaaaatcaaataaactcatttttaaaaataataattaatactcaattaatcatacgtgtgctaaaccaaattccagattcaaactaggcttaatcaatactactgaactcttgggtagttgggtatgaaactaatttggagctatttacaaaacacaaaactcaatatcacaatggtgtgcccaaaatgatggtttggaatgttcctttcatctgtggatgttgcaatgttcctttcaacaactagggcatacagatacagctacctgaaactgttctaacaaaggctagagctagagcatactaatggaatagttttcacaatgttgtagcttcagcgttctgatattgggacttcttgtaagcttggcagaagttgaatcagcaaaactggcttcacttgtgtttaattatgtcgttccagtttgcccctcttttgctccctcttgctgctgctgctgctgcttctctgcccagtacttctgaagaggtggcccaaatataacattcccagagatcactccaatcctgtaattgtttgtaagacagaatgaccatgaatatcaaaataagcttgacaataacaagacatctgcttataatgcaatgaagcagttattcaatggttaagatagcaaacaaagcgctacaacgaaacagcactagctgagagcaaaatcaattaaaaaattcagagaggattccaaatagccactgagccacaatagctacaggcaatcatctgtaggatatggccagtcctaataagatgtgatcaaaggatgctaaggtaatttctttcgccacactgtttggaacagggaaagtttgccccattcctgccaggtaaatttcaggactatgattatctttattacagtgtagacagatgtagatgagcattttcaaaaataccaggatattaacagtcaaaatgacataaacaaacaatttaatgcattacaggggaaagtgggaaacaagcctatagttggacataatgtgatgtacaagttggcgcctactttagtgtagatcttttcaggcatgcaactatcatatctcatattaaagcgtactgtagcatgttagtgactttaagctgaacaaggatgtcaatttcatacaatagtttagatacagtgaaggtacgttcataacaataaaatatgtcactttttatttgcttaagcttgaagtcacggttacaagtgccgattaccatgaattatctcagccagtcagccctaacatttttaatcagagtacagaaatgtatatgcagttgttccacatatatgcagaatccctaatgcaattgccaagaaaacaggaatacatccaatatcttttctaatgaaacacaaggatgcttattcacataagaacaaggcaccattgtattttccccccacaaaaaaaaaaggtatcgcattccatcatacatggttttacttgcaaaatactactactagtagcagagcttcaagaaacactgtttttactatgacatgaaacggcagattcgagaacaagccttccaaattcaccccatctttgatatcggtggagataatttgtccagcgtaattttgctccatatcaaattactaccgagacacccattactctttccctcgaaacactaacaagtactccctccgtccctaaatatttgacgtcattgacttttttaaacatatttgaccgttcgtcttattcaaaaacttttgtgaaatatgtaaactatatgtatatataaaagtatattgaacgatgaatcaaatgataggaaaagaaataataattacttaaattttttgaataaagcgaatggtcaaacatgtttaaaaaagtcaattgcgtcaaatatttagggacggagggagtacttcacaatcgttggcttggccgcctgggcgagaatcaagcgtgccacctactagaatagtaatatgagatagcaagaaccagatggaacttcatattagaggtcccatcatgatcggaacgcacaacatcaggagccccgaatcaacgcggagtgaatctggttagcatcaagactggtactaggaaacagcagccgccgccgccgccgcagccgccgcggcagtagatctgagcatcagaccgatggtgcggagaggcgagaggatcggagagagagggttggagaaactcacacgacggcgccggccaccagggggaaggagagccgcatcctgaattcctgatcccccctctcgccttctccccgcgggttcttctgtttcttggccctcgctattttttccccacgatttctccggtcagagacggcgaagctgagacagaagagagagagatatttaaccatttgccacatttaaatgtgacaattaactttttgccactggacccatatgtcatagacatatgtggacccacatgtcattgagataggggtggcaaatagttatttgccaaatctaaaagtggcaaatagttaaaagccccgaagagagaacccctccaagaaaggggagagaagtatcgatcgcctcctgcgccgtccgatcaagatggccctgggttattctatatcggacggttgaaatttacatcgaagcatttttcacgatttttacagtattatggagcactggagctaagtttctgtattgtttgattctaaaagaaaatatttgtttttttagaaaataatattttccaggctcccgtcctcccgtttcggacgggatcccctccatgtgcgcacaacgtatgctataagttagtttctcgagtgtgatcctctcatccgctttgctagcgtgcccatatgtacacaaaatttgataatttgaccctttctgaaaactaattttgcaaataaaccgtagctaaaacttatttcaaaaatgactttttttcagcgccaaattgtatggcgctgaatttagacacctcagtgccacgtcaactgccgctaaatgttgtgcaccgcgtatgggaggatgagtcggcatgacaacgtgcattcaacgccgtgctatttggtgctgatatatctaaattcagcaccatacgatttggcgttgaacaaaagagtcatttttgaaataagttttggccgcgattcatttgcggaattagtttttggaaagtgtcaaaatgtcaaatttcgtgcacataggtgaccaggtttgagattctactcttccttgatctcgcctcctcatcttaattactactactatccatggataatagcttactgggcaggcggtacttcatgttgaccattctcctcacacccaagggaaaggtagtgcccgtccatcgaagccacgaagattgttctagaaatacagccagcttgacctgttgctagcgtcatcatggtggcccggtcatcgttgatcatccaccactgtggcaccgatggcatcttggcactcctgttgtagcttggataggcctggtgacaaaccgtgtgagtggtggtggcggtggcagccgactgtttcccctgggttgccatacccttgcgtgggcggtgaaggctgagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9850 - DNA, 5030 bp, Oryza sativa
  unsure (1)..(5030): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaatgacagatgtggtacataaaaaaagcaaaacgcacgtcagtttttcatagggatacactaccacactttgaagcaagcctaaggatgcgtatattttctgtcagtcccgcaaaggactcacagaaaattatattctgtcggtgcacccacagggatatattttctgacggtaaaaccaatttttccgtggatttcgctcctacatagtaggtcgagtctggtagtggaacttgtgtcgtgtgtatgatttgaaaccaagatgacttatcgtagcaaatattggtgcgttcgacaactttcacagcattttgcagcagcacgcataattaagataaacctttaatcgagtaagtaattattaaaaaattaaaaatgatattatttgatttttttttaaaaaaaacgttcatatattaaaattattgtacaaaatataccatttaacagtttgaaaacatattaagggaaaacgagaaagtagacatttaaagttgatgaaaaaaacttagctccagttttacactgattaaagtgccacgtaggcatgcacaggtaggcgtcacgttggcaacataatactcaccgtgccaagattgtgaggagcggaggaggaggatgcagcggttgggcagcacgacggcgagcgttgccgcggcctcccgccggccaccggcgtcgagggagtggagagaatggacgtcgagcggcggcggcatgaagggagccgtgccgtcgcgcgtccctcctcctcgccgcagctcatccaatgccgccgtcgcagcgtcgtccctgacgtggatcgatcggctccccaggcggaggcgtccggcaatcctggatctgacatttggtgggtggcgcccggcaacagaattattcccggccgttgctggcgtccgggtggccagccagacctcagttccagagcccgacgactgatgggctgattacttgaggtggtgttcggacgaaaacgctaatccgcgaccggtcgcgcatcgcgcgcggagaggagcggcggacggcgcgtgtacggtattcccttttttttgttttttttttcttccggcgcgtgtacggtttcttttttttttcgttttttctgttttcttccgtatttttggtttctttttcctttgttttcgtttttttgttttcttccctatttttggtttctttttcttttttttcttttttatcgttttcagttttttcggtttttataaagtttgtatacgtgtatataaagtttgtatacgtgtacataaagtttgtatacgtgtatttttttattttttttatttacgtatacaaagtttgtatacacatatataaagtttatatacatgtatacaaagtttatatacagtacataaagtttgtatacgtgtatacgaatatacgtgatgttttttttagttttttatattttttaatatgtacgtatacaaagtttgtacacgttgtatataaagtctgtatacatcatatataaagtttagacactactttagactagtcgcgcattagccccccccccggtgtttggatccagagacttaactttagaccctgtatttagacattaatttagagtattaaatatagactacttacaaaactaattatataaatgaaagctaattcgcgagacaaattttttaagcctaattaatccataattagagaatgtttatcgtagcatcacataggctaatcatggattaattatgcttaatagattcgtctcgcgaattaatccaagattatagatgggttttattaatagtctacgtttaatatttataattagtgttcaaacatccgatgtgatagggacttaaaagttttagtcccatcaaaatagggtcttatctccaatttttttttagagagagagagagaggatttagtgaatcttttcattgaaattcagcggagtaaacagtggagtcagcaagggccgtatcttttcagcagtttcacttgcaggcggtcctacagtggagatgcaattggtggaccaactgtgggtgatcagaaggaggtgctggaagtctttagtaattcctgtttagcgtccaaactttgcctctttgtcatttggcgtgatttagagcttaacctcagttatctattgcaatcttctctttttttaaaaaaaagggcttatctaatgtaatcaattcaaactctttaaaggccatgctggtctagaagaagcacactactacataaataatctttccaaacggctaaaatgccgcctacacccagatgtctatagggataaggatttctccgtacgagcattataactgatcacgaaaatggaattttcaaaggcgggcatattatgcggcccgactaaaaaagatttttaaacaaaataaataatcataaactctaggtcccaaaggcgtcttccacgcgtcgcgtctagatccaccattgtcatcgctcgaggccgccactgccaccatcgtcgcgcccgaagccaccggtgtcattgtcgctccaaagatctccagtggcggagctgtcttcccgaggccgagagcggtggataggcctctcctgacactggcattgaccgctcccgagccattgggtccgctgtcatccctaccgaactcccacagccgctgccatccccgtgtgctcctcccaaactccccttcgttgtcgccctccccacgactggatgtacccctttcgaggccatggcggtggatctgtccttctagtggctgccgtcaccgctgctttcaccacctccggagcacctaacactgctgcggccttcaccacctcccagagcgcttgacgccgccaccgccttcgcctcctccaccacccaatgcgctgaccgctgcctccgcccgaagcaccactgcctgaaccatgaagtggaggaaggtggagtcgggggaggagaggagacgacgaggacttataatatttaagagagaggggattggcaggcagcttagtggcagacagggcctgttaagaggcccgcttgaaaaaaaattgatttttgcatacgggtttgctgccaccaaattcaggtgtttttgacttgatcagttggttggtgggcgggattgaggccatgctatcttcatttcctgacaaaaaagattatgtcaactgatgtaaacaggaaagaatggtactgtagatcagaaaaggatcatctcacactttggctgatcatcttttctagaaaaccatgtatagctatatgcagagctatgaaacaaaaataagttgtactttgcaagctaaggtatgaaataaaatgctccctatttaggccaacatgtcattgaactatactgataaaatgatctccgcaatgctatttagtatccaaaacaaagtttagctatatccatttgagtttttatctccacaagattcatccaccaacgtctagatatcatgcacgtgcacttgaatcttgcatcatgcattattaccagaggtaagtcaaattaatagctgcatcgataaatttttagcattaatgtcaactgagagtgaaagtgaaccaatccttggaaagggactgtccccgtgggggagcttcattttccaatcaatttttcaacaggttttttgggggcagcataattttagtaagaaaattagctgagataaattgattgagcataattttgctgaaaacaggaaaacaaaaaaggaaactagctattcttgctgatttgttttcctctctcccactatagcacctgttattcaagtattatatgcctgtgaagaaaattgttactttcaagtgcatgagtatatggctatcctctaaacggaagtgatttaaaaggtacactacagcaatatataaggcatggcaactgggcagtaactggattttgactctttctttaagtaaaactagcacggtggcccgcgcagattgcgcggctagcatcattatattttctctcatataatagcatatatgttttcttattatattattaaaatatattacaatgataacataattttaaattttgcaataacttttcaaaactactaatgtgtaataactactctagtctcctcttctaatattccttatttttttaattctgaatttcagctatttctaaattgtatttctatatgtactttgctttttcttgttctctgattaatgtgagaatttctaggccatgagagcgaacgtggaggctcctttttattccgaattttagttggttttaaattccaatatgaactatatactctacttctaatattccttattttttaattccaaatttctattttttttcttaattgtatttctatatggactctatactctacttctaatatttcttatttttaattccgaatttcggttatttcctaattgtatttctatatggattctatactctatttataatatttcttatttttaattccgaactttagttatttcctaattgtatttctatatggactctagtctcctcttttaatattccttatttttaattccgaatttcaattatttctaaattgtatttctatatggactctagtctcctcttctaatattccttattttttaattctgaatttcagctatttctaaattatatttctataaggactctagtctcctcttttaatattccttattttttaattccgaatttcagctatttgtaaattgtatttctatatggactctgctttttctttttctccgactaatgtgagaatttctaggtcatgagagcg

SEQ ID NO: 9851 - DNA, 1774 bp, Oryza sativa
ttcctttcgagaggtacatgggcgttttgaagaagtatgttcgtaaccgtgctcatccagaggcaagcatcgccaagggttatggaacagaggaggtcaccgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcacgccaggaacatcggtaagtccgatgcatggattacacagcatcacattgatactttccccacgtggctacgacaacatctcatgggtaacgagtcaatcaaccaacaacttgccttcctggcgaggggaccgtctgggtcgatcgcgacattctagggatatgagatcaatgggtacacattctacacgagagcccaagacatgaagagcacgaaccaaaacagcgctgttcgtgtcgatgccatgggacacgatggaacaactgccacgtattacggtgccatcgaggatatatgggaacttgactatggtcctctcaaggttcctctgttccggtgccaatgggttaggttgactggtggaggcgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcataatttactatcattcatatgctacatttaattgactatcattcatatgctaattataattgactagagaatttttaaaagtattaaattattcatgtggcatttacagatgttaattagagtttttcacaatttaatttactatctttcatatgctacttatatatgactattcgaatttttaaaaggtttaaatcatgcatgtggcatttacatatgttaattacagtttttaacatttaatttaatataattcctacgctaagtatatatgatgattataatttttattaattttaaatcatgcagtatgtacatacatatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatgcattaacttctattttagaaacacatatgtaagcgaaaataatatgcagtgctataatctttagtcccggttcttaaccctaaccgggtttaaaaataatttggaaatagcgggaaaagatctttactcctggttgatgag

SEQ ID NO: 9852 - DNA, 3898 bp, Oryza sativa
tcatcaaccgggactaaagatcgagggctatatatattcccgatgcgcgccctcatcttctccaccaacacttaacgttttcggccgatcgatctctctcggcctctctccttcgccgccactgcctacggcaaatccccgcgccgacgccgccgtatctcgccgtcgtctcgagctcgtcgtcctcgccgccgcctccgcctcctccgccgccgccgcatctctggggtgagagccgccgacgcctctcccttcatcgatctccaatctcgatctctctctccgtcgcgccgcccgccacgagacgccgcgccacgacgacgccgcgccacgccgacgccgcgccacgctgccgccggcacgccacgccgccgccttcgccgccgctcgcgcaacgccgccgccgccacgccatgccgccgccttcgccgccgcgcaacgccgccgccgcatgcaacgccacgccgccgccgcagtcgccacgccaccgccacgccgccgcgccaagcgccggcccaatgccgccacaccgccgttaacgaacacgtgaacgagaacgaacacgtcaacgtacgtcgagaacgtgaacgagaacgagaacgatcgaacgaacgagagcgagaacgagaacgatcgaacgaattaacgtgaacgagaacgacaacgaacgtgaacgagaatgaacgtgaatgagaacgagcgaacgaatgtgaacgtgaaatgcaatatatatatatgttacttcgcatttatcctaatacatattttttgtatcttgcagaaaagacatgttgtcggagtcgtccctcaagccggagtggaagagctagccgtagaaggaattcgtgcaggcaagtgacataataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattaactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttaacatatacgcacaaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatatttcttatatcaacagatggctgactgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttgtacaaaagagggcacgcgggcaacgaggtgtagcgaagaagcttgagggtcggcacatcataacgtaagtgaaagaagatggacgtcctagtgccccggccgaagccgccaagaactatgtacgtcacagcggttgggttgtgcgggataacgtgactgtcaatacggtgtactggcgaagaacaagggcacgcggagatcatgagagctttgtcccagattcggagaaagagatgctgtggaccacaatgctcgagacattcacccttcccacgggtacagaggacaaagtgaaaaggtggactctgaagaaaatggcagaatagtttcagagctttaagggagagctgtacaagaaatatatcctgaaggggcagacaccgaacttcaacacattcccaaagctaagggatcactgggacgagttcgttgcatataagacaggtgaacaagggcaggcgatgatggaaagaaacaaagaaaatgccaccaagaagaagtaccatcaccacttggggtcaggaggctatagcgtcgcgatgccgaagtgggaggagatggaggctaacttgattgagaggggtatcgaaccggcaaccgccaattggccggaacgatcgaagttctggtactatgctcacggtggaacgctcaacccagctgatggctcactggtcttcggcgatcagatacgagaggtgcgcgatgactaacagatgcagtggaagcctcctctcagggcacgttccgaccggacagagatagggatgagctgacactcgccctgcagactccagagcatccaggacgaacacgagggaaaggggtgattccttggaagattggtttcaaggtggacatccacacgtacaggagtcggatgaggagtaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagccacatattccttacaagaacttatcaataaaggtaagctcgtagtttatatattttagatttagccattccgctagttgctgcttatatatgttgattactaataaataatctctcacaacatgaaggtggcgtcgggcatggccatcccaactaacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgatcctccagcaccgtctccacctcaggctccagcaccgactcctcctcaggatcctgcaccgactcctcctcgggctcctacacctactcctccgcaagcttctcttccggcaccttcaagtcaagggccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcgtactatgagcga

SEQ ID NO: 9853 - DNA, 1398 bp, Oryza sativa
gagagtaaatgtcgcaatgctcgaccaatatccacaagaaacagaggacaatctcgtccatctcctgaaggcgcagcattacaagacgttcatactattgccgtacaacacagagttagtttaattttactgtcttcctacatactaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttaacaaggttttcgaacttatacacaggtaccgtcataagttcctctgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgatttaaatacatacaagtgtatattaattagatctctcgttgtttgtcatttatttgtagtgcgtaaagcaaaagcagggaactaacttgtgcggctattacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactatgacggaaacacaattcaccggtccttagtttctgagctagcagcgagtactactactacgtcgaaatcgtagctagctaggacatataatggattataattaatacatgactacatatgtttctatatgcatgtgtacacattttctataatgtaaatatattttggtcatatatatatatacacatatgcatttgcataacatatatatgtataaatatatatatgcatgtacatatgtactgtatatatatatatatatatatatatatatatatatatatatatatatatatatatataaaatatgtatgcatatatatgtattgaaacatatatatgcatggtttatatatatatatatatatatatatatataaaccatgcagcaacagggccatgcaaaaaaaaaaggtcagctcgatctttagtcccggttggtaacactaaccgggactaaagatcgagcggaccttttttttttgcatggccctgttgctgcatggtttatatatatatatatatatatata

SEQ ID NO: 9854 - DNA, 7115 bp, Oryza sativa
gttcaatgctttacagattgtaagcaataatggtgcgtttgaacgcctcggtgtaatggtttggcctagccagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgtgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggacgaattttattaaaccgtaccgcgcggtacgggtaaccgtacccccgcggtacgggcggtaaccgtggtaaccgcgcggttaccggcggtttttcacaccctgggcctagctaccatagatgctcagaaccagttttggatgacaaacaaatcctaaaatcaaggaggatatgaacaggatggcgcaaaggagggggtgatccatattttagttttctatatttaccatttcagagtggtatctctatatatgtaataactagatttgctcttcataatttaataaaagattgttgttcctcatataatttgtacttgcatatgcatatcatgcaaagtctgttcttaagcaagagttcattctgattgcatttttcaactgtatcgccacaatgttcattctgttgtacatccgcaccttcccctcactaaatcgtcttaatttgttccttttgtgatgatgttacagtttttaattttttttccctttcctttgtactatatacttgtatgcagtgcaacaacgcttgtccatgattactagccttttaattaactagatgtcgtcattaaacaagagaataagcccttgttacaattattattttttgaataaattaatcgattggaaggaggggatgcttgttgtctaaatatagagaagggtagacacacctacaccttatactacctacatccttcaatatatggtgctagttagttcaaaattaaactaaccaacggcttaataaaatcagagggagtacatactatagaaacacactacatatggccaagctcctaccttatgttattacgcaccgacacacgtatttactctactatagaaacacattacacatggccctatctctgcaggagctcgtacgtatgtctttttctcacataaaaagagcatcggtggaaaggagagcaacatctctttccaagtccaccgcaaaatgaattggaaaaatgtgttttgtgttggctctaggaatccaagcataaaaaggagaggatcaagataacacggaatatgttttctaggtgactggtaggaataggaggcatgttgaatcctatcggaaggaagaatgcaatattcgtgtaggaaactccaagtcctcgcctagcaatctagcatgaaggaagaatttgcattattcttgtcgaccatcgcagattagcagagagggctgcgtgtaggggccctagtttgcattacttttgttgaagaaaaacagattggatgcagtaggaataaacgacagatcgcataggctacccacttaggcccctaattaatataagtgccaatgagcaagccatgaagcactaggacaatttatcgagcatcagttgttcattcattttatctacataagttttatattgaaattgccaattgattaaaaattatagtagtactaatcctgattttaggaaatttaggagctctgttcaatcgcggcctctggctgcacccgttaatctacacttaattaaaaaaaatgtaaggctcccgggtagaattttcgtccgtcaacgaaaaattcttcctcgcgtgtgcgatcgatcccgcttcaatccgtctccgatggcaaaagaaaaataaaagaaaaaaatcgtcgcggtgacaaccttgcttctggccctgcccccgtgcgccttgattcgagtccgcataaaatttggacctaaatccaagagaaaactactaaaaaaacacaataacagatttcaacaacaacaataacacaagaatatcaatcacaaggacaccaagaaaacaccgacgtcggaagaggagggtgccgctgtcgccgccgaacagccacagggacgctaggtcgccaccggctcccctcccgctggattcggcggaggggaggggtgccaccatcgctgggacgtcgggccgccaccttctcccctcccctcccgttggatccgagatgtcgtaccaccgccgcctcctctcccgctggatccggcggaggagagggcgtcgtccctgcccgccgcctcccctccggccggacgggagggcgctgctgcctaccgccgcccgccaccgtcgagccgtcccgcggccccatggcgagagagaggaggcgaaggacggagaggcgccgccgccatcgccgcctgctgccgtcaccgaggagtagctcgcgggtagagggagagggagagaggaggcggagagaatgggagaggagaggagaggagagtagaggataagggagagcagctcgtgggcggaggggcgccagtggcagctcgtctggtgctgcatctcggcgccaacgacagcggcaccggacgagcgcggaggggcgacggtggcagctcgtgggtggagggccgccggcgacgggcggagcagctgctgcatccccaagcctagcggcggcaccgggtgagcgtggaggagcaacaatagcagctcgcaggtggaggggcgacgacgacgaagcgggcgcgtatcgtggagcccgttggcaacattgggcaggagcttccagatctggtacatccctctctctcaaacctctccaccgctgttgaggactcactttcgccggcggccagcgacgatgacgatgggcggaggtcgttccgaaactccggatgggggcgggagctcgacccaaagtggcggttgcgatttggcgtggcgttcctctctcctgttttagcgatccactacttttggtgtagccgatggagtatccgctggaggccgatttttcactcccatccgctatttctcagattttaaatgctggggatgctcctagtctctgttagccaccctagttggagtagtttattcgtttttatgttcccattaatatgcctgttttttgtgctcacaagctggattctccttcaaagagggagttgtagtagaaaaccgaaaaagtggactcaatgatgactcatcgtgaaggcatgtctgatacataaaacacatacttccttcgttttataatgtaagactttttaacattgtccacattcataaagatgtgaattaatgtaaaaattcatatgtctaaattcattaactaggaagttctatattgtgaaacggatggagtagtatatacgtacctggtgtatctatatggctcccctggcggcctggcctctgagagtgtatggccttcgtgcaatcgtgctactctttgcgccggtcttcttgcactgttggatcaaaaaccaacggccgacataactccacgtgtccatggatcgccgtacaattaaatcatttctgcaccaaattcccgtcttgggcccaaattggcatgggtggaaatttccaacggatagaaatccatcagtttgcctcgcggaggcacgacgataagatcgctttcattcgtacagtgtggacctcctaccgttcaatcaattaacaaaagaagaaaatagaaaagaaatcaatgtagtgcaaatcctatatacatatgcaaatcatccccactactagaaattctctgcttcctggtgcttccacgtcaccccattttatccccaccgttcgatctcaatcaagcgatcgaccttccacctggctttcccccatcccgcatcgcacatctcctctcccgcatctcgctgcttcgccagccccacacgcatcgacccctctctcccgcatcgctcctctcctctcccgcgtctcgctcggccgcttcccaccggatctctcgccgcaccacatcgacccgagcccccaccaccacatctctcttagcaccgggttccgcttcgcctcctcctcctcctagcaccactctgcgcgccggttccgctttgcctcccccttctaccgctatcgattccctcctggcccctgccacatctccggtcgtctttgccgaaaattaatttgtttcccacggtttcttcctcccctcgaaccgtcggcctcctagcctcctccacttcaagaaattagaagggcattcgcctgcttggtcggctccaaatgggaaatagcacgctaaaatcacctcctgcagccgcaggtaatgtccacgtccaattctcctcccacagccgcaggtatggttcttcctggtctggaaccagataggtcttcatctgcttattttttcttcttatttagaaaagtattagtcacacaattttgtttgctacttaccctcacagtgacacaatatcaagtgatagatttggtttcggtattctccagcctattgcgaaaggaattttggttccctctatttggtcaggtattgaaatttacttaatttgtttacttccttgaattttttacgaggactcgaagatcaaatgtatgtaaacctaattactctaagactaggtgtattactctaagctgcactgaacctatcatttgttttgctttgccttcagattgcaagtcattaccctcggcagattatgtaccaacactgtagaatctaatggcttcggactatgttcacaggatttgcagaaatataatatctatgtccatcataagatacaagcttcataagaggtaaggcaatttctttcgtagttcaagtttcttctcacgtgaattatgacaattaagctcaaaggtcacactgtgattagttcagtgacaaacttataaggtagagaaaatcccctgtgtacccttgaaagttcactaatcccttctgtatccctgaattttgctcaatcccttacatacccctgaattttagtttggatcccttctatgccatttccgctagttgaccgttaaattcttatgagaaagtccattttgccctttggtataaagaagcatataaattaatagagtatattgttggagcatagaaatttgttatatgagactattatgtttatgagatagttatgcaccatattatttacgataaatatacttttagatatgacataaaaaattaatacttatttattagttattaaaagatttttttagcttatgtgttctgaagtaataaacaaatctgttgtattactatgaaaacacatatgctacataaaagaacttttaataactaattaataaataagtatcaactttttatatcatatgtaaaagtaaatttgtcacaaataatatggtgcatcacatactcataaatataatagtctcatccaataaatttttacattccaacaatatacttcattaatttattatgtttcttcatagcaaagggcaaaatggactttttctaaagaatttaacggtcaactagcggaaaaggacatggaagggatccaaactaaaattcaggggtatgtaagagattgagcaaaattcaggggtatagaagggattaggtgaactttcatgggtacataggggattttctctataaggtatatattcttctctattttccattgtacattcagtcttataagctacagtttagtgattgatgttacttcattcttcaggtcggtgttcttttggattggactatggtggatgctctttgtgattgcagcattcttctatattcactcaaattttagatctaaaggttagtgcagctacttatcttcggttgtacagatttttcattccaaaatacttaaagtggtttcgtttttattaatacacactttgcaccccggatgaatgattaaatttcttatcagccggacttggattatcaatacaatgtagtgaaaattaagatgggtaggtatgttaatagcatatagatttggtgctagcggcaagcacatcatgttttttttgtcagagcacaaaagaagaccatttacaaataaacagggagtcaaggacattgtttaggtatttcacattgcccatttgcaaatctatttccataatatttctgcatatttcaagatattcaacctcatcatcttttgtcttttcaggacatgtatgtaactactttgtgtgcaggacctcttcaaacaagggaaaaatgttatgagagttatacagctcgagggtaatggcaaaacacatttcaccaagatgaaattggatctttgcttttatttaccctacctattatatatgctgcccttttttcgtactagaagcctcaagcttcaaactttgagtgatttagctcatcactgacacttggatgctaaggataaagaacaatgctattttttttgtgtttgtggcttaacatagccttttcagattaagacataattactaggctttatctaacatggtctagctaagatacaaggatcaaatttgataagaaccgctatgtgtttacttgattttcaaaatgccacaactgcttagggcatagggtgtttggttccatgaagttatcaaaaatcaattgaagtcagagccttactttttaattgaagtagaatgtacagttcaactattactttgtcatataagcagattattcaaattcgcgattgtgctttgtgttttttaccaattctctgttttttcctacttaaatcagtcaaccaatttaattttttaagtttattactataaattcccgctgcaacgcgcagggtatcatctagttacatataaagtgaaaacctcaaaactatttcctctgtttcatattataagagtttctagcattacatcta

SEQ ID NO: 9855 - DNA, 41901 bp, Oryza sativa
  unsure (1)..(41901): unsure at all n locations
atatactccctccgtttcaaaatatttgacaccgttaactttttaacacatgtttgaccgttcgtcttattaaaaaaatgtaaaatatgtaaaactatacatgtacataaaagtatatttaacaatgaatcaaatgatatgaaaagaataaataattacttaaattttttgaataagacaaatggtcaaacacgtacttaaaaagtcaacggtgtcaaatattttgaaatggagggagtatatatttcccgtttatcaacggccttaagcaaaagatgaacgttgttgtcagcggtcactgatcagttgtgctgaggagacagggcccacaactccacatacaaggtcaggacctattccaaaggcccaattcataaggggatactctaccaggattgggtttcgttcaggttctctcgggcaagtttacgtacggtgcgctgcgctgggccttgcttgctttctggttgggcttccgaccaaaacctcccatgcaattccggtccatcatagcccatgacatgtcgtccgtcgcagcgtgccgtcgcgatcgcggatacgcgatggcatggcttggcatgccaccacgcgcacggcctcatctcggtttcttcactcggacgcggtgttggctttaatcagcgcgcgacagtggatagctttgccagtccaagtcagacgtgtaccgtgtcgagaagtcatcatgtgatctttttttttaattattactccctccgtttcaaaatatttgacaccgttaactttttagcacatgtttgaccgttcgtcttattaaaaaaaatttgtgaaatatgtaaaactatatgtgtacatgaaactatatttaacaatgaatcaaatgatataaaaataataaataattacttaaaatttttaaataaaacgaatggttaaacatgtacttaaaaagtcaataatgtcaaatattttaaaaacggagggagtccgcagcactatattatcggttgtcaaggatgcttacgtccgcgggataatcgatatcggctgtctccgtttctctactacacgggggctgctattcttctctcgtcgtccacactcgttgtagttggagtagtttattcgtttttaaatatctttttcaaataattcttccgtctaattttaaatgtaactatgagtttctgtgttttattttagttgtccgtcttatttaatttatttttataattagtatttttgttgtaacgagatgataaaacataaataatactttatgcgttacttacgtttttatatttttttcaataatatttaaataagacggatgattaaagttgggcacggaaattcatggctgctcttaaaatgggacggattagttttttcattcttaggagggattcttcttgaaagagggagtagaagaaaaattggtcagaatgatggttctcacttcaccatcgtgaaggcatgtctcatgcacaaaacgcagatcagtatacgtagtgtatctatattgttgaatagtcccatattggttgtggaagggcaaaggacctaagatataagtgggggagcccctcacctcaatggctagcttttggggtgggaaagatcatttacgatcctacaattggtatcagaaccaggctaggttaacatctctggcttgatggacacgtgtgaaggcctgatggaccgtgggcggtagggcccggatacggtgaaggggcggtgaagagctgagagacaccaatgtgtgaagggttgtggaagggcaaaggacctaagatataagtgggggagtccctcacctaaatggctagcttttggggtggaaaacgccctttacgatcctacatatgtagcactgctccgtgagtcttatgacattcctgcgatcgtgctactcttaacgttggttttcttgcactgttggatcaaaaaccaacggcacacgtaactccacgtgtccatggatcgccatagaattcaatcatctactctttctccccttctgccccaaattcccgtgcaggccccaagttggcatggatggaaatttccaacgaatagaaatccatcagcttgcctcgccggggacacgacgataagatcaattatcaaaaaagaaaatagaaaagaaatcaatccgtttgcccattcgcacagtgtggacctcctaccgttcaatcaattatcaaaaggagaaaatagaaaataaaacaatccgtttgcccatttcaagtcaattcgaagaagaagtcttccaaacaaaattaaactacacaatgatttgcaagactaacacaagggtttaacccaactttctctcacctcatctcggaatttcactatttccattctcctccatctactattaaactagctaccactagccgtctaaaccagaagcaaagcttcgtcaaggctgcatcccagcattccggcttgcagggccatcgcccatggccacggccggcgagcggcggggcgcgcgcaagtcccgcgtcgcgggggcggccgtgctgcgcgctctgcgccgcgcccgcgacctctacgtccggggcgccaggggcttcggcaagttcgtcgtggcggcgaaccccagggcgggcgtcgtcggccggccgacgtcgagggtgttcggcgtcggcgagctcaactccgagcaggagctgcgggagctcgtgcgcggcgccggcgccatgtgggcgacgcgcggtgcggccgcggacgcgggagctggcggcaagaaggcggatgctggggctggcgcgccggcggcgtggcgcggccgcgggacggcgccgctcgggaggatcgaagaggacggcgccctcctcgtgcatggcaccaagtagctagacagatggcataggggagtggattctaatccctcgagaggatatctcctcgtatacctttttcttttaaattcgatgcaaatagttgtaaaaatttctgaaaaaaattgacaatgtagagtataatgatacctactagtccactaaaatttatattcaaattcgatctacacatcgagaaacaaaaaagataaatttagatataaacagtacgctactattcatacgctgaatttgtcttttttatatctcgacgtgtgagttgagtttggacgtaagattttgtgaagttgcatatatatgttgtataaatgttgtcaaatttttccagaacttttcataacagtttagatggtttttgagcaaatgagggtacatcccctcgagggattagaatagtttcccatggcatagatgttccgaacaaaagaaaaaaacgagaatgtttcaaatcggttatcagtgattactactgtaccatactaccatatcttcagtgatttgaggtttatacaaggagtttctttacgtttctctgtactcatgcagcctgaaagattttcgatccgggacaaacttctctgttactatcacttattataaaaagttttatcgtcactttattcaacaatattaaatttaatgaagtttttacccgttatccctagccgggctgtggctccaccctatagatggccataaaacccgagaccccgacgacacggcccgagttttattgggccgtgccttgaccatagatagacacggcccggtcaggcgtgtaggtcaggctgtgccggcctaactgaccttgtcctagaccccgtcgtgcctgagccatgctaggccggacggcctataatccagccctgatcatactactgatccaaagagtaaattctaggcgcacttggaattgattaactagagtgcagcggcaagtgatcttttcttttcggggtaatccttattatttgacgaagtaaaactaacggtgtactatgccctagtataataactgagggaataaaaaaggcctttgcaaatacatgcgtcatttttagcaggcactctccagccaaaaattaactttgttcagtaccatactatacatgcttcacaaatactaacctatacatgcatgtacacacaatgtcatgtaaaattaaaccaagaaaattatctcttaacatgtcatctgaagtaacatattttttcggttctccacacaaacttacagcaccaaaacatgctaattgtaagatgatctcctaattacgagctttcataatgctcccctgtatccaacacggtctatacataaaagatgcatacatgtcttgaatatacaaatgatcataaggttttgggaacgtactacccaaattttgaaccttcgagctattaaaatgataggcaagtcctctttgcatctcttggttcagaaagataacttctttatagggatggaatcccaagattgaaagatttctacggcatcgtacttcatttggatttgcagcgtcaagaatatatatcatcgttatcggagtcccattcaaatttatttactcgtactaccacttctttcacatctttctcgatatcaatgatttctgtacgaggcattgtcatattcatagcaatatctccgggtgatgtatccttgtaagcttcgtagtactcctcagcgccattttgactggaatgtccaaagtagttcttgtagtgcaaagtccacggaccatcattttgtatacagatttcctgacaccctagaaggaaactaagatagatccttgtcatgcttaagttcccatgtcatctgaccacatgacttgttgaggaacgaaacacgtagtcgatgctcattatctattaatgcatagtgcacacccctcattgatctcccaagaaaatagtttttatatggagatacttcattattcatgggtaacttaattacttggaacttattatctggcaaggatattatgcattaaaacaatataaatcatgaaaccattgaaaaaaaatataaagaaagaagagaaagcaatggtaattaagcacacttgtgtttggaaccccatgttcccaatccctccctatcgtttttcgtgcgcacgcttttcaagctgctattcgaaagttgcttaaaaaatcaaattaatctattttttttaaaaatagctagcacttaattaatcatgcgctaatggattactccgttttccatgaggagggaataggttcccatcccctagatatctgtctggcaaagtacaaaagaatgatgaactcgtacctcatgacaaaatctgtctggcaaagtacataaagtgctccctgccagtagactccattgtaacgatcatatagatattctgttaccatgtcggcaattgtaccggcagcatcaccttcccgtgcaaattaaccatctctcttcccattgcccagtcctcgatgagaacacctgcagtaggctttgtgatggtggccatggcatgctcttaaccagaggatatagctcgtaggatttactacggatccgtgggatttggaagatctcgtagtgtggtgatacggtggggtcgaacacgagatagttgtcaaaccggtacaaatctatccagatgtgctgaagttgaggtagatgccggcgagcgagagagggaggaggtcggcgcggagcaggcggcgggtgtcgacgatggcgcgccatgccttgcagacgcagtgggacgcggcgatcgagccagcgcggcgcgaggcgcgcgaggacgtccgcgagcacgtcgtcggataggagctgcgtcacgtcgtcgtggtgctcctccatcgaatctctctctgctcaaactgctgctcggtttttagatgtcgtctcgtcgggtaatacttgcaggcggtctgttaatctatggacgagaattcagtggcggagccagaaattatacaagactagggctaaggtagggctggactaatggagtttcagttttctgaaaaatttacatggtgaatcaacaaaatttaagcaagtttttggagacaggcctagggctcaagtcctagctgccctaggcttgtctccgcccctggacgagatggcatccgattccgcgttggttttgcattccgagagaagtgaagcgcgcgctctgttccgattctagaaagaaacgggtggagtgggagttttgcctgatacacagagttttgttactccctccatttcacaatgtaagtcattctaacatttctcacattcatattgatgttaatgaatctagacatatatatatctatatagattcattaacctcaatatgaatttgaaaaatgctataatgacttacattgtgaaacggaaggagtacatgttttgatgtcatagttgttaaaagaaaaagaaaagaaaagaaaatacatttcaaatcgattatcaattattactaccttttatcttcagtgattggaggtaattctacgagattgaaaatatacgattttcttaatttagttgggaaagtctaatttgttgctagtattggtatgagaaagaaaggacaaaagaaaccatctaaacaaaagatcctatccacatttgaaatttatgaactagagtgaaatttatgaactagagtgcatcggcaagcaattttttttccgaggcaatcctgattatttgacaaagtaagtaaatgatatatactccctccgtatcaaaatataagcatctttagactctgacatggtctccaaccaataatatctataaaataagatgttttaaataaaaaagagttgcatattagtataatagtttgtttaatgataaatctaataacatcagttatacatgattgatcttttttacttttttgctattaatagtcaaagttaaaaatgtatgacttgtcactattctaaaaatatttatattttgaaacggatggaatactatgttctggtattataataaaaataagtcctttgcaaatacatgcgccattttctatcaggcacgctccagtcaaacatcaactttggtcggtaccatatatgcttcacaaataaaacctatacatgtatacataatgtcatgtacaattaatcgagataattgtctcttaacatctcatctgaagatagcatatttatttaggtcgccacacaacttacaccaccaacacatgctaaattgtaagacaatctcctaattacatgctttcatagttctcccctagatccaacacggtgtatatataaaagatgaatacatgccttgaatatacaaatcatcataaggttttgggaacgtactacctaaattttgaactttcgagctattaaaatgataggcaagtcctctttccctcttttggttcagaaaaataacttctttataaggatggaatcccaaaattgaaagatatccatggcattctccttcgtttggatttgcagtgtcaagaatgtcatcgttgtcggagtcccactcaaaattatttactcgtactaccacatatttcttgatatcttcgcagtgatttttgtaccagacactctcatattcatagtgatatttcctaacaatgtgtttcttgtaagcttcataatagttgtccatgtcattttgtctgggatatccaaagtagttgtggtattgcaaagtccacggaccatcattttgtgtacagatttcctgacaccttagaaggaaactaagatcattgtcatgcttcagttcccatgtcatctgaatcatataactcattgaggaaccaaacccgtagtcggtgctcattatcgattaatgcatagtgcacacccctcattgatcttccgagaaaatggtttttatattgacatacttcagtattcattggtaacttaattacttggtacttgttatcagacaaggatattctgcattagaaaaaaaaacaatatatgggttataaaaccattgaaaaaaataaagaaagaagatagagcaatttaagcacattaaaagaatgatgacctcgtacctcatgacaaaatctgcctggcaacgtacataaagtgccccatgccaatagactccattataatgatcaaatggaaaagccaatgccatgtcagtaactgtgccggcagccacaccgtctcgtacaaacaatctctccccattgcctagtccttgatgagaacacttgcaacacgcacagtgagggtggccattgcaagctcttaagcataggatctagcacgcgaaatcctgtactaggaactcgtgggattttgaagatctcatagtgtgtcgatatggtagggtcgaacacgagatagctgtcgaaccggtagaagtccttcatccagacgggctgaggtggggcaggaggagaaggcacccactgtcgggtagcagggttagccacgccggactttagcagaaggagtccgttgcaatgatcctcgactaggttgtcgttgggcgtgtagtcggtgaacatgccagagatggcggggcgtgtggagctgggacgggataggaacaccgaacggtgcatctcgtggaagttgatgtagatgccggcgagcgagagagggaggaggtcggctcgcagcaggcggcgggtgtcgatgacggcgcgccatgccttgcagacgcagcgggacgcggcgggcgaggacgcccgcgagcacgtcgtccgggaggagctgcgtcacgtcgtggtgctcctccatggaatctctctctctgttcaattaattcgttgctcgaaaggttttcgggtgcgtgtacgtacgtacgcgtacctcctacctgtgggcggtctgttaatctatggacgagagatggcatccgattccgtgttaattggttttccacgcactccgagtaaagcgagcgctgggcgctggagtgggagttttgcctgatacatacggagtcgatcgagggattcttatcggttggacttggggcgcgaatccgttctgctcccagactcgggcacaagaccactgcaatactaacacccagcgtgaacaagccaacaaaagattggacgcgccgtcgataccaatggacgagccatgagcaggcggccaccgcgacaggttcggtgttggcgcgcgagctcaattccgagcaggagctcgtacgtgcgcttcatggcgcgccggctgcatgctcgggaggatcgacgagccgcggcgagagcgtacgtggttttggagtcggagcgcgcacagggcggtttgcactgcgccaatggatcgaatgtctggatggatgcattatattgcatttctagttttttttttccctttgggtggggggattactgatggtatactgtggagtagttgttaagaacaaaaagacgaaaaactcgtcacactcccaccacccgggcacccgccatctgcgccacaccgctgggccgtcgtactatacgcctttcgctgagagagagatgtgtgtctctgcggccacaaaggctgcccctcctgtgccgatcctgcctcctatcatgcacagctgctcggcaacccgtcctgaaaactagctgctgcttaattattttcacttgttcgtgaatcgtgaccaatgcaacagctaagagaatgaactagctcgttctcgtccctactctacaattatctatgtgactgtgtaggaggaaacgggcgatggagaaaccggattcctggatgccaaccagacaattagacaaacatgccgctgctgcacgagatatggatcgaggcatcgagctgctaaacgcatgcccctgccgagtgaccagctagggtttctcctgagagtcgttctggcttcgttacacggtacgttagaggcaactgttttgatcgtgcagttttcttgagccacttaatggcttccccgaattaaatggtttaactatatattttcaccacattccgcaaaagacactgcctgaaacacaaaagtccgttgtattgcaaacattgcagatagagacagacaaagatatgatggccgccgcctcgccggccaccgcttctaggtctctagacccctccctccgtgcccgtttgtcttgttgatcctttgcaagattgtgtctttgttagttgaaaagcatgctttttgcttcttctttttttttttgctgtttaaaccacttgtttactaaaattagattgtgttgcctcgtctttccctcccccagcacagggtgaggattacccggaggatcagacttgtgaagcaaacaagctggcatcacagttaattgattcttgcgggaatgggtcttctcctgatgttaggtgctgcgagacgattgtagtggtagttgatctacccaattgtctttgcctggtgtctctgcgccccaagattaaggagtcccagttttctgcttttactttgatcacctcttaccgagcatgttgaggtctccgtgccgtcaaacagaaggatgcagccctgtgctatggcttcaatggttagaatgtttctgtggttctctaatcaataaaatttcaaatgatgcgttcttttgcatgctagctagtactaaattggtactgtttttcgtgtgcagaaacagaggatgagcagccaaatcttccgcctccggctggaaatggcgttggcacagccacagtgaagcagcctaagatgatacttgatcccggggacaacttcagcaactgggatcggtacattatggcaatcttggaggtggcgactggagttcagatcatttacgcgctttttcgagagatagtaaatcgcttgccgaccatccttgcacggaataatattcctcgtcaagtgtaaggggtcaatggtcgatccatgtatctctcaattgtagctgttgcctgatgcatctgagttaatcgtaggtagcagctacatatgtatccctgtttatgtatcttggatccctggatccctgaacttgaatctggtacttattcgttgaatgactgtattaagcaatacgaagagcgtgatattgttccttttcttctctgccattcgctgttcagatggcaccaccttacatctttgcagtactcagctgtccacacaaacgattacttgattactatgcgtcgaaggtggtggcctatgaagccagctagagttggaaggtgttgactactacaagtctctaccactgatttcaaggaaacattatgttatggaaaagtaacgtaaaataatcgactatgctgttggaaaataaacattaaaaggtggacagctaagttaaaaattgaacttaaaaatgccatggttgaagtagaagcgactgattttattgggaaataaatccactttaggtctctcaactagcatgcgccagctcaattggaccgaatagaggtattccctgttacatttatatgaacgaggagtgaatggcaaaaaattaaaaatcattatcaactctagctactgtgttgccagtgcaacgaggcaaattacaaacaaaatacatgctactataaatgatcattactcataaccaattatatcaccaagccatgtccacaacgactagggactagggagatgtgtgatatccttattatccgtacatagtcattgaatatatagcttttagttgagggtccctttgaatcacaggaattaaaaaatagaggaataggaaaaacataggattctgacaggaatgtaagtgtaaaacaggattgcaaaacataggaaaaacgtaggaatgaccgtttgattggaccacaggaaaaacacaggaatttgaggagagataaagactcaaatgattttttccatgaggttctacctcttgctaaaattcctccaaaacttgtatgggaagaggcattccataggaatttcataggattccataaggtccattcctttgattcaaagggctttgtaggaaaaattcctatagaaatgaaatcctctgaaattcctttgaatcaaagggggcctcaatcttatctgtccatgacaaactattcgagctcaccccttgtaagatgaggacacaaatgatggggatcgatgccaagtaatggcacgattattttcgatgaattttctgcactaagtaagaaatgtcaaagtcagtattacacatcaataagtgataataccatatgctaataatgcattgcaaataaaaatgatatcaatgaatagctataacagaactgaaagaataaattcatgatacaaatcatcaagcatacgcctttagccttttgcagcccgaaaagaatccttttggctatcaactattatcaagcacaccatatagcagcatcaaaagggataaaaaattagaccaacgaaatggctgcaaagtggaaaaggggataacaaattaaaatatgctttttttaatctccaaaggcacaggtggtcctaaacgaagaacaacaccatctaaatttcatgataccctaagtataaaaaggtatctaagttataaccttacaattttcacgaacagcaaaagtgatttggccttccattcctggaagtacaatgtgtgcaacattgatcgagtaactggcaataaggaagagagagaaatcaaagcaagaaaaatctttgttactgccttactggtaaggaatattttctgctggcagtcgtgcagaattgtagtgctgattttatgtaccgatgagactctcttttttttctgagttgctaaataaacatgttttcatctagaccagcatggttcgtgctagcatattataagggatatgtttctcaagttgcagttgttatgtaccatgcaaaattaatttcacttaatcaaacaaccctaagggacactgatttgattaaggtaatgaacaaccaaaaatgtgcgtggattggagaagaggatgatcgattttaattaccttagggctggaagaatctgagagcgaacttgctgtgctccaagaccggcttctggtcatcgatgagcggccagtccaccatgagtgtgtcagtggcatgcaagcgcagtcaaatgagataaagtacataaacttcttttttcagaaccaaattcgcattcttgaatgcaagaaggcgctgctggaagaacaggaatcgttcatcgtacaggttgtcatgacaaaccatcagaacatatatcaaggaagtttaccaattaaaaattatattcagaagcctagcagggaagacagacattatattcatggacattattcatcgtgataacaatatctgatcagctaaaatattcaaaattgacaaaaaaaaactattttcttgtcttccctaacctgatcattagtttttggcaaatgaaattgacaacataaatattcctactcaaaggagcctttatatttctatgcatgtgtgttttattgttgtggagtgtggatgaatataaagagctgttaagtttcttagaactggcatttggaaaaaaaaacatatcctagctatatgtttagtatgacaccaagaaaatggaaaacaaaaacaaagcattatggtcatgatctatggtagcagctaagaaccctggatgtcatgttatctgaccttaatatgctctatggtttgccaggtgatggtaaaaagtatgtcttttaaaactaatgacaatacaatgcatgtcattgatatactcatgtctcgtgttaagtgatagtatcttgaacggacgggttaaataaattgataggctaattggcaacttggcatgaaatgaagtaatgaactggagagaaatgtaagcaacataaagaagaggtaagtttatatataatagccaccggtgctacagtacaaaatcatccgttgtggcatgttatttttagatatcctaacaatgccatgatattcagcaagagggatagctatttttgttcagagcttggctttaggattcatcacgacaattgatttttgctctacctaacccgaatatgcaatctgtaaccatgttatttgggaatggtagagacaagttaaattctaattgtgctcacacaaaaaaaaaatgcagtgcggcacatctaaagagggggaaatgatagaactgaaaagcatttcagaatattcagggcattcgccatcatcgggtaaaatccatcaaacaaaaacaacaacacagtgtttagcctgcacatctcaagtctcaaccatctaattggaagcaaaacaaacgcagtgtacgattcaaggtgacctcaggcgtgcagatcgttcggtctgggcctccatggaaaccagctcctgttgctctgttgctgttgcctgttggcgctctttctggtgcggccgggtctgcagggtgaagttgggcttcgcgttgagcctgatgccgagaatgacgacggtgaggaaggaggtgaggtagcagggaagctcccagtccacccacttgcagaactcccctgctgacggcgacggccgcttgaagagagccagggggtcaaccacccgacccatgccccttgtcgtgcctgctgcagatgcgcgccgcgccgcacaaccgagctcgcaatatccatgctccttcgccggcgcaggcgcgttcgcagatgaagtgaagagggaggttctgtgggctagggtttttagggatgggaattggcgaggtgcagcggtggccaacgtcggaggcggttcgcgaatcgccggagaacgggcgagagaaggggagaatttccctagaatgaatgctaacattttcactaaacacccttggaagatcaaattttgcagttacgtcctttgaaccatctctaccgttgattcataatccaacagatgcgggtgcgaaccgagccttggaatagcacgcggccacgtggcgcgtttcaaagatatgtaaactttgctcactacaaaaaaaaatcgatttttcatggtgtttacctatttttttctctggcggctataagcaaaaaccgctagggaaaatttgacgagagatgaggtgctaagaaccgccagcaaaaaaccattttcactggcggctgggttaagaggaccgcttgcaaaaatagaggtctttttacaagcggtcctcttaagtgatcgccagcgaaagtttttcactatactaaaacaccaagtgcgcacggactcttcttatccactcactccatcttaccctattctcctcaccccacctccatcttatccactcacgcccacgcctcccctgttcttggctgccatggcgaagaagacggcggacaaggcaactgcagcgacggcggacaaggcgactgcggagacggcgacgatcggccttctcctctccttggcggcgttcgccacgcggcgagctcggggccggatccaccgccgccaacgaccggggaggccggatctgccgccgccaacgacgggtgaggccggatccaccgccgccaccgctgactagagatggcaacgggtgcatacccatcgggttctcttgccccatacccatacccacgatgtctaaatactcccacttaaatatccacacccatcacgggtacaaaattgtccccatacccacacctatgagggtaacaggtatccaacgggtacccatacccatataattgacttgtaatatttatagttttgtactataattagccatattagagttgtaaaccatcaatattttctctagcagcaatgctattaatattagtgttcaaaggcgagtaaaaaatttatacaaccacattacatactcaagagatcaaataataatttcatataactagactaagcaatgatttaagatgtgaaaggagttttatgctatgatttagtagtcgttgagagttataatgctcatagttttagactcaatcaacgggttttttctacccacgggttggtgggtacgggtgggtaaagaacggacccatacccacgtacccaatgggtaagagttttcgcccgttagtagacccatgggtataagagttagaacacgattggctcctaatagagtaaaaacccgtcgggtctcgggttatgggtacccattgcatctctaccgctgacgggagtggtcggatccgctgccgacgccgacgggggtggccggatctgccaccacgaggccttggcagctagggctggatgaaaagctcgtggctcgtgagtagcttggctcgactcgactcggctcgttacattttcttaatgagccgagctggcatctcagctcgttacacataacgagccagctcgagctagctcatgagctcaaacgagctgatggaaagtaacaggccagtggcccaaccagccggtgcagtccattttccaccaagccgtctcaaaatattaaccctagatgacacccaatcctcctctcaccctcccagccacacaagcggcggcggcggagacgaatctggtgcgcccatccccttttgttccttccttgctctctaccgccgtagcaaaccggcagcaaatccactctgtattctgtggtatctattctatggtgcgtcgtggctgcacgactatgctggcactcgtgaaatccgtttggagaatgcgccatggcatcgtttgcggagtccgcgacggacaggaaggcaaagcccaggcatcagagcctcgaagcagcacctggatggatggttcacaagtaaaaatcgtcttcctaatcaccgagagattggttctcagtgagttagtgttcttcatgtgtttgctttgttttgtggctgctctaaattccgccagcgaaaacctaaaatggccgcgtcacgaaaaatggtttacgtagtagtggctttgaggtttagccatgtggcccaatgagatggtagtgtttgcaccctgaaatcggtattctagatgttggattttgaatcgcgtccctaaaccgcaataccaaatattacacatttctcaaattacaataccgatgtaccaatgtacatgaggtcctaggaactactgtccggttttagctagcatgatggttgagtcaacgtgaaacccacctgagccccacgagtaagctccctccccctcccctctctccctcccaatgttcctcgtcctcattccccctctacctctcttcctagcctccaaggcagtgggctggcagtcgatagggagaggggtagctgagctccatcatctcatcgcgagccacaacagagcacccagtcgtttctaacaaagaagacagggttcccagcgagacaaggcggcacgacaggaagaaccggtcaaagagtgggacgagcatggcgaagtacgcgagaaggagcacctgttggggtcagtcggactcggccccaggaccacgaccatggccacaccggatgccctgaggtgcaacaacacatgatttaatttgcagcgacgacattgatgggcaggctgaacccaaacggagcctgacgcatgtctgctagtcatggaacccaggcatggacgggagccccatggagaacaccgcccgtagatcatagatcgggtgggaacgtgaatcccatctcggtatcggtgcacagttgctctgtgtcagatagccccgggagcacagccatgcgacagcactatgctcgccagcgcgtggaacgagtggagcccatggtgcggtgaggccgacatcgacaagggccccgccatgacatgcatggacaaccgccgaagctctgccaaggacaaaccggccatttgacggtccgcgtccaccattgccactatctctatatgtcgatcgtccctagaaagtggactagtaagcttcgacaatggctatggtggcgagggggcgtggtgagtggagaagaaaggcatcgcccttgagactaggaagagagggagaaggggaaagaggaagaggaacgctgggaagggagagatgggaggagaaaagctgacatgtgtggggctcacgtaagtcccacgctaactcaggcgccacgtcaaccaaaactgaggactatactttctaggaccttgggaacaccagtattatgagttgagggacgttaaagatgaggaatgtaaagtgaacttattcggatgcaatttatttttttttgtaagggttggttcatttatattccaaacatccctttttgagctcaacaagattaatcctttcggcctgtatattccaccggttttggggaaaagccagccattcgtagcggggccgccgatgcttatgcctatgatccaggtcagcgcaaaggttttggtggcataggttgaaactaaaaggaataagtctattatgcttccttcaactcttgcacctagttgaatcacatccctcaatcgcaaaaccaggtatagatagccaaaaggtccacccggcacggcccggcccaggcacggcaaggcacggcccaccagccatcgggccggcacggtctgatcggcacttcgtgccgggctgtgccggcccatcagctccacctttggcccaggcacggctagggatggcaacggggctacccccgtcgggtttagccaccccgtccccacccccgatgtgagaaaaatctcccgtcaccattcccatccccgcacacgggggaggtttttaccccgtccccgtccccatgcgggtacggcgcacccgccaggtccccacacccgacaatcgaaagaaattcatccagcagaccaacagtgcagcggtaagccatgaggcactaatccacaagcaattcaccaaatcaccataatccagcagcaacaataaattgataatggttgaatcagtgaacaatctgataattcatcattagtcattactcattacataatgtaaggtagcaactagcttgttcatcacagatgtgttagaggcggccacgtggaatgggcgacggaggcgatgctactgtgtgcgcgtggtggcgacggcaactacggcgtggagtgggctgtggctaaaagacgggaagaaggcggcaagatgcgccgccgctcaccgagcccggcgcggcggctccctggcgacgtcgacccccccccccccccccgccgattggatctaagggtgagataggggagcagaggagtgggagagagacacggtgagatgagaagacctagggttttcttgggtttatataccaacacctccgaattgggcagggcttttactttcatgtgggctaaggcctgcatatatgcctacgtcggggtcccatagggatacggggccagggagctagcgcccgcccccatactcggcccacccgacgggtgaggaaaaaggccgataacagccccacggatagtatttctctcccaactagagaccctaatagagtttttccccaccgggatcgggttacggggctccattgccatccctaggcatggcccaccagtagtcgggccgtgcagggccggctcgaaggcatgggtggcccatcatgctttttttaaataagtctattttccctcccttctctttgggaggatatatatatctacttctacttctactattttctatttaaaaagtttaaaaaatttccgtcgtccgtatatacataaaaaaaagcgaaaagaaaagatacggcaaaaaaaagtccgattgtgcaacggtaaaaaggaaagttccgtccataataaaaagcccgtaaaaagggccaaaaaaaacaaaaaggcgcggccaaaagaaacatgaaaagggtgaaaataacaaagaaaagaaaaaaaaagattttcgattctaaacgtcgccagtaaaaaaagctgaaaaggaaaaaaaaccgccatccctaataaaacggcgaaaaaaaggtaaaaaaaaaagcaaaacgccgtaagaaagatttgaccgcatatatgtctaaacgatccctcaataattttagagatcaagaaagattcaaagatttggccgcatatatatctaatcgatccctcaataattttagagattaagaaagattcgaccccatttgacggagaggattgactctgttgtcatgcgggcatggtactatgcgagctcgaccgaattaccggatttgatgggaggatcggctccgtcatggtacaggaacgagtttgttcgagctgggtctatagctccacttgtgggctgagccggtagaccgggcacgggtctgttcgagttgggcctacagttccacgtgtgtgctgagccgaagagaggtagactgagcaaatagaggtagcagactaggctaagactagaactgaaaagggaggaatgaatgaacgttcgcttcaaaaccaagcaagcattaaaatatatatagctaaataagtctattttacgtctctattctttcgactttggcataaaataggtctatttttactccctattgtttgtgtgtcgggcctggcttgcggccccatcgtgccatgccgggccggcccaacgtgccggtggaggggcccaggcacggcccggtggtcaggctgggccggtacgggcccaacccacatcgggccgtgccgtgcttgggccgggccaaaatgccgtgccgtgggatgggccgtcgggcctcaggccttttggccatctataaaaccgaggggactacctatacatttgtcgacaaatttttccccaaaaatttgacagatgtaattatagtacaatcgtagtgtaattacactgtaacttatatgtaattacactgtaacttgcatgtaactacactataacttatatgtaagtttaacataattttgaatcgttagatctattacacgatttgttttggttaggaagaaaacaaatcatagcacacacatatgtgaaagaatttgtttccacgacctccattttaccgaaataacatgttacggagagatttttgaaagttacatacaagttacatacaagttacagtgtaattacactacgattgtactgtaattacatctgtcaaatttttggggaaaaatttgtcgacaaatatatagcaaaatcgaaaccgagtataacacctcccttatttgtaaaaaccggtataaatcgcctccttaagtgatttgaaaggtggttttatctaacgtggcagctttgaccctattgactagctgactcagcttgtggaccccacccatcaaggaccacttcatcttcttcctcgcctctcccgtctctcgttcctcttcctcctccatcacctctcacagcagaacgcggggcagagctcgtcagccgaccacgacgcgcgcgtgggaaggagcttgccggccgtgtcgtgcgcgggccgcgggggagggaggtgtttccggccgggaggagctcgtcagaagcggcgcacacgggtggaggggtcgccggcgcggtgcgcacgcaggaaggaactcgccataagcggcgcgcgcgtggggagcggtcgcgggccagtcgcacgctcattaggagctcgccggccgcggcgagcccgcggggaggagcttgctggcctcgacgccagtcgatcgcgcgcgcgggagggctcaccggctggtcgcacacgcgaggagggctagccggccggtcgcacacgtgggtagggcttgccagtgttagctgctatttcagagtttttcaaagttttagagaatcacgagagagaaggaatttgtgggacaattttctaggttctttcattcaactgaattgaaaaacttacaaatggaaattttagctactgctacttatactctaataacagaaaaaacgaatccaagcctacaatcgcgccatcccacgatccggaactcctggatccaatgccgtgcaaaactcacgcccacaacgcacgcctgacgcggtcgtctactcctgcagctcgccacatctctcgtgcatgcataacaaactcaaaactgaattattcatccagccgttgcaactgccatcgcctggatcaccttggggccatagctgaaataacagtcaacaaactcccccttaattctgctacagcccaaaatcacgaacacctagcaggtgccgtgctgtcgccaatctcgctgctggcaacccttttgttaacgcatccgcccgctgctcctcaatccggacgaattcaatctgaatcttcccactttcaacacactcacgaataaaatgataccgggtatcgatgtgcttacttctcccatgaaacacagggttcttcatgagtgcaattgctgatttattatcaacatacagcttcaccggcctggcttctgcaccaatcatctcaatcaacaatcccctgagccacaaagcgtgacacgctgctgcagtggctgccatgaactcagcctcacaggacgaaagtgccactgttttctgcttttgtgaactccacgagaccaaactgccgttgaagtaaaacgccatgccgctagtactccgacgatcatcactgtcgccggccagatcactatctgtgaaaccagtaatctccactgcaccattgcctccagaaaacatgagtccacagttgattgtccccttgagatatctgagaatttgcttcaccgccttgaaatgcatcactgtcggtcgttccatgaatctgctcgccacgcctactgcgtaggacaaatccggccgagtatgcaacaagtaacgaagacaacctatcactcgcctatactccgtgggatcaactgtgcttccttgagcatctttgtgcaactgtgaacgatgttcaataggaattgaggtagaattgcaatctagcatcccaaactaggtcagaatcttccttgcataagcagcctgcttgatggcgatcccgtcagtgccttgcaacacttcaattcccaagtaataggtgagcagtccaagatcgctcatctcaaactcccccatcatctgttgtttgaatgcagtgatgtcgcttgggctttctcctgtcacgatcagatcatcaacatatactccaacaattatcccggtactccctgtacctctagtgtagactgcttgttcttgtgcacaccggctgaaaccaagctccttcatgctccgatcaagccgtgtattccacgcccgtggcgcctgtctcagcccgtagagagctttgctcagtttgtacacaagatgttcctttcccttctcaacaaaaccttctggctgagagacatatacttcttcctcaagatcaccattaaggaatgccgacttgacgtcaaggtgatgcacctgccaccttcgatcaactgcaacaggaagtatagctcgcaccgtgtccaaccttgcaaccggcgcaaacacttcatcaaaatccacaccttgccgctggacgtaccccttcgccaccagccgcgccttgtgtttgatcacctcaccggcagtgtttttctttagcttgaacacccacttgagccctattgccttgtgactggctggcagcatgcacagcgaccacgtcttgttcttctcaatagcctccagttccttgttcattgcgttcacccacgccggctcgccggctgcttcacgataggatgtcggctcctccatctctacgagcagcgcttctgtgtcgtcatcatcctccaccaggtccacccgaggtgcttcaatcatgatctccgccaagcttctgtaccgcaccggctcgtcgtcactgccggccgtgcgcggtgacgcctgcacctcggcagagtgcgttgaggatgagccgagtgtaggcgtgctaggcaaggttggtgagaacctcgccgggcttgccggaggcgttccccgctgttctgccacttctggctccttgccggctcgccttcctgccggcggcgcccggtaccacggtaccgagcctgcctgctctgctggcgccggctgctctgcgccaacgggttcttctacctcgaactcagtggaagtcacctctcctgcagcagcactccactgccaaggtgtgttttcatcaaaaacaacgtcacgacttacaatgatttgccgacgacgcggatcaaacagccgatgggccttgctcccttcttcaacccccaggtacacgaccggattgctccggtcgtccagcttcttcaagtgcggtgcagtcaccttcgcgtgcgccgtacacccgaacacccgcaggtggcccaggtgaggtttcttccccgtccatgcctcgaacggagtgcgatttcccatcgccttggtcggcagccgatttaggaggaatacggcgtgacgaactgcctcgccccacatcctgccgggcacggacatccccttgaggagagaccgcgccattgccatcaccgtcctattgcgacgctccacgacgccattctgctgcggtgaatacggtaccgtcaggtggcgctcgatgccggctgcatcgcagacgcgcgcgaactcgccggacaagaactcgccaccgcggtctgtccggagtgtcttgatcgttcgtcctgccgtgttctccgccaacggcttgaacttctcgaaggccgcgagcgcttggtccttcgacttgatcacaaacacccacatccaatgagaaaaatcatcaacgatcaacataaagtatcgattaccggtgaacgtcgatggagtgatcggcccacacagatccatgtggagcagctcgagcggcgcctctgctagatagtttgccattcctgggaacggctgccggacttgtttcgccaccagacatgcttgacacagctggtttgggtggtggactgcgggcactcctgccgccatctccttgtccaccaatagcttcaacgcatggaaattcacgtgtccgagccgggcatgccacagccacgccgggtcatcgagactagccaacaggcacaccggtgacgccagctgcagctcgatgcggtacagccgatttgaggatcgccgcaccttcatcaccaatcgccaaggatttttgtcgaacacctcgaggtcatctccatccatcacgacacggtggccagtttcagttagctgccccaaactcaccatgttgcagtagaggctggggatgtagtagacatcgtcgagcaaccactggtcaccgttcttgcatgagaaaaggatggatcccttccccattatctgcactgacgaggcgtcgccgaacctgacctgccctgtcacggtctcgtccagttcccggaatttccgatgatctcctgacatatgattgctggcaccattgtccaggtaccacagatcaccagcagctgctcccttctctgccagcatcaggcgaggccacacacgctcctcgtgcacgaccagcccgcagagcgcatcctggcgcgacgcgttctgcaccgcctctgtcacagcgagcaacaaagttgggccagcatcctccgtttgcgcaagatgagcttcagccttcttcttcttggggtgtggacactgcgtggagtagtggccaaactcctcacagttgaaacattttatgtggctcttgtcgcggccaccgctgccaccaccagagccgccaccgctgctctgcgtcccaccgcgtccgcgacccctgccacgaccacgcccggcctggccgcggttcgccccctcaccagagggcttgttcttctgtggcgacgaggtttctcccccgcctttcttgaagcgcgcctcccactcggcctgagtgaggagaacttgcccgtcagcggtcactcctccggtggtcgccttcttcttccgcatccgctcttcatacgccttgaggcgacctaccgcttcttcgaacggcatggtgtcgacgtcgtaaaattgctcgatccctgcgacgaggctgatgaacttctccgggacagtgtcgaacagcctcttcaccatggcggcatcgttcaacgtcgcgccaagagcagagtaccggacccccatcgtggtgatccggccggcgtactggtccagcgtctccccggcctccatcaccatgttggtgaactcttccttgagtgtctgcaggcgcgcatcgcgcacccgatccgccccgatgaatctcgtcttgaggcaatcccaaacctcctttgccgagcgtttctttgcaacctgcatcaagagatcctccggcagcgactggagaagatgagactttgccttcttgtccttcctcgggtcaacggccgccctagccgccggctcgattgcttctcatacgccttgatcctccatcatagcctgcacacgtattacccaactagtgtagttggttgacgtgagctgtgggtaaaggaaagcacttcctgagctccccctcgccgggtccgccgtcgccggaaccaacgccatagtgctagatccgccctcaacctgagaagctctgataccacttgttagctgctaatcacccgatcgaacactttgtgcgcacactgcacatgtccggcacggcaacagacaaaaaaaaactgaagaacataggaagaaattcagaacatagaagcagagtatttcagagtttcagagaatcacgagagagaaggaatttgtgggacaattttctgggttctttcattcaactgaattgaaaaacttacaaatggaaattttagctactgctacttatactctaataacagaaaaaacgaatccaagcctacaatcgcgccatcccacgatccggaactcctggatccaatgccgtgcaaaactcacgcccacaacgcacgcctgacgcagtcgtctactcctgcagctcgccacatctctcgtgcatgcataacaaactcaaaactgaattattcatccagccgttgcaactgccatcgcctggatcaccttggggccatagctgaaataacagtcaacagccagccggtcgcacacgcgggaggggtcgccggccgcggtgcacccactaggagggcaagctggccagtcacgcacgcggggaggagctcgctggtctcgatgccggccggttgcacgcgcgggagggctcgccggccgcgccgcgcacgcgggaaggagctcgctggcctcgacgccggcaggtcgcgcgcgctggaggtctcgctagccggtcgcgagggcggggagggctcgccggccacggcgcgcgcgggaggagcggtcgctggccggccgcgacgcgtgcgcggggaggaactcggtttgtcctccagaacctcgcgagaactccgcggtgccaccgccgtgtccgcgaactctcagtattccttcctccttcaccttccgcaccgaggcctagtcgccaccacgcatcgcctcttcgcgcgtgtcagctcgccgggacgacgccgcatctggcgctgcgtgaacggcacgcgtgtagggcggagagatgcgcgaactcagccgccaatgccggattgctgagaggtggtcggccctacatccttttttccatgctccctgacatttgggaccactgtatatggttttccacatctcattgacatgtgggccctagatgcaaaaaccacttttgaaaccaccaaggagtctatatttaccggttttggaagacagaggatgcgctatacccgatctcgtgaatgagggatgtgattcaatcagtaacaagatatgagggaggcaaaatagtcttattccaaactaaaaacatgggtcttaacataaaacaaattagttacaaaccttaaatccatctagaatcagtatttatatgatttttgatagatataatatcttaaattttcttcctatatttctggatgaaaagttattgaccatggtatcaataccaatatcatccaacaatttcttcttcattgccccatttttattctctcaatttattcacttgtccttttttttttttgctgcttttctctcaacaaaaatgatgtcaaggatatgcaaaaaattgaaaaagaatatttaacatctgaactcatatttttacctattataaaaattgaagatgattccatactcaccataattgtataaaattttcgtccgtcctagttgttgggatacttttatttgactgtttgactagcaactgaaccagtcaaaccgctcaacctgtgaattgaatttggtgtataactataataattgaatttggtgtataacttgtaatttttttctaggaaaaaaaatccaagcaaattcttagaatgagtttcaccttaactaaacagtataataataataagattaaaatagtcttcaccaattgcaacgcacggatattttttctagcataaatataaagtacaaacataactagaaaagcaccagatttattcaaacaaatctaaatctcactgatttgttgatcgcgggtgtgcaaggcaacacgcacgacggctgcttcgtccaagctgagaacctcccacaaggaatataaataaacttgattaagccaaatgtgtatgtcactcacaacatatgtcaatggtcatttggcaacgagctgttgctgctcctggttacctcctagatatttcacaggccgatgagcagatcggcgagtagtcaacgtgtcttgcagttgcggagccgcggcggctgttctgacgaagcggcctgccggccggggaacagtggtcggtgctagcgtcgacggttgattatagacgcaaatcgctagtcgcctagtactcgtctcggcggaggaagggttgcgtcgtcgtcaatgtgctctctgctctcctttctgtctgagaaccatagaaagaggcgcttaagtcttaactccgtgtcgcctactactccgactctccggtatatgattcgtggttttttttcttttttcttttttttgaagttggttgcctcttccgcttcgcggcaacgcaagagaacagccgcactctcctactcggggtcggagttgagaacacagacggaatcggatgccatatcctctataaaattaatcacggaacacaccgaacaccaccaaagaacagatcaggaacggccggagcagagagagatggaaaagcaggacgacgcaacgcagctcctaccagacgacctgctcgccgaaatcctcggccgcctcgcgccgcgttggctcgccgcgtcccgctgtgtctgcaaggcatggcaagccatcatcgacagccgtcgccttctccgcgcggatctcctcccgctctcgctcagcggcatctacttcaacttccatgatgaacggcattcggtgttcttctcccacccctcgacgcgccccatcatctccggcatgttcaccgactacacgcccaatgcggaccgcgtggaggatcactgcaacggccttgttctactctggggtggcgtagctaaccccaccacccgacaatgggcgcctttccctgagcccccacctccatgcaccgagattaagggcgtctgccagcttagtaactatctcatgtatgaccctaccatatcatcgcactacgaaattttccaaatcccacgtgcgcttgatagatatcacgacgagcttgatcctatggatgacacctcgcaatggccaccgtcaccaagcgtgttgaatgtgttttcgtcaaggaccggagaatgggaaaagagatcgtacgtacgggagggtgaggctgccggtacagttgccgacatggcattgtcttttccatacgatcatttcaatggagtctattggcagggagcactttatgtacattgtgaagcagattttgtcatgaggtaagtggctatccactcttagcattataattgctttctttctccatttaaagattgcttggtgatctgatggtgtccacaacgtcgctttttacttttgcagaatatccttatctgacaagacatatcaggtcattatgctgcctataactacggaagtatctgaatataaatcgcattttttcgggagatcgaagaatggggtgcactatgcattaatggatagggaccaacgactacgaatttggtttctcaacgagtcatgtggtcagaaaatgtgggaattgaagcatgacaagaacattagctttctactgaaaaggcatgacaaatatggacaaaatgatggaccctggacactgcactattttgactattgtgaaaattatgaccagaatgacattgatgcccattatgaaggttacataaatgaagattataacgaagagtacatcgccgcccaagattgcaagcattttgaagctgcctcctatgaagatcgtaatggaaatagcatcagaaacgtgatagtaccaataaataaatttgagtgggactctgacaatgatagcattcttgacattgaaaatatgaatgacgaacatcgcgatacatttttttcaatccttggatttcatccctacaaagaggttatatttctgaaccgacaaatggagagaggattggcttatcatttcaatagctcaaagattcaatacttgggaaaaacgttcccagaatgttatcattcggaagttcatgagatgtatgcgtcttttgtgtacactccctgctggataggggagctttctgaaagcacataatttatgatatcatcttacagctctccaaagaaccgaataaattgatgttacagctaggatgcatatcctcttcttctgttacaacaaagagacactgttacagcagtgtcttgactcaactgcagtagcttgctgtggttcactgtacaaacaataaccttgcgtgtacggtaggttagacagggtactatatcacattttactatagaagccgatcctggaggcgcacgacaatgtttgtttggatttaataggtgcaaggtaacgcatgcataggaacgataataattggttactcatgtactcccttcgtttctaaatatttgataccgttgactttttagcacatgtttgaccgttcgctttattaaaaaacttttgtgaaatatgtaaaattatatgtatacatataagtatatatttaataatgaatcaaattataggaaaagaattaataataataacttaaaatttttaaataagacgaacggtcaaacgtatttaaaaaaatcaacagcgtcaaatatttagaaacggagggagtatatattactagatgaatacccgtcacgttgctgcggaaaattaagttgcataatatgtacgaataagatgcaatttgaataacaaaactaaaacaatttattacaattttaagtcaaaaaataattgagattgcgtgtttttaagagagaagaaagaagagacaatttggaccatagatctatcatccaaaggctagaaataattgaggtgatgtggcttaataagagaagagagaaataacattaactacgtttagtggggatgaactatataagtatataggatgtacgaataagatgcaatttgaataacaaaactaaaacaatttaatacaattttaagtctaaaaataattgagattgcatgtttttaagagagaagaaagaggagacaatttggaccacagatctatcatccaaaggctagaaataattgaggtgatgtgacttaataagagaagagagaaatatataacattaactatatttagtggggatgaactatataagtatataggagcttgaaatcacataagtgaaaaatgaatatcaaaagaaccgatttcttccataaatagaaacaatacatttttaaatctacaatataatattacagttacaatataaatagaagctgttatatcatccgaccacaaaagaagaaacaaatatagcttgttcagtcatacaaaagaagaaataaatgtatccgcattaatccttgtagcttgtcagcagcatcacatggatcaaggtatcttctcctcaacaaaatgtaggaaaaaaattagtgatatcatttagggttgaacaatcgagtatatgaaataacaaatagtaggacacaccagaattcaaactggctaaatgttgggcaaacaatttctttctgcacagtgtataaatatccaaagtttagtagctgcctagctggttatatgaaatatgtgaaataagctactgaacagtaaagacagattttcctctcccctaattgtcatttcatataatgcactataaaaaataaaacaaaaaaaaaacaaatgacgatgtagtgagtatagttattagaaccggaccggaccggcagtccgacggtgtcatggttatggataccacatacctaatagtagttgattaagctcgatagggcctaccatataccgtgtcttatatggaatcatatctcgtgtatagaaggggttccggataagtaatgataagtagagttctatgtcatggcggcctcccggctcacgcactcactttgacttccattctatgccccgacgccgacgcctgcggccacggcatcgtcttcttcgtcgccagccagtacatcggcctcttcaacgacatcagcaacggcgacgccacgaaccacctcgtcggcgttgagctcgacattgactagaacaacaagttccgcgacatcgatggcaaccatgtcggcgtcgacatcaccagcgccggctactacgacgatagcggcaactccggcgaccatggcttccataacctgacactggcgagccacggcaaggctatgcaagtatgggtcgattacaacggcacggccaagcagatcactgtcgccatggctcccctcaagatggccaagccttccatgccatattgccattgctatcttctacctacgacctctcccgggagggagaaacgggacatgccgtcgatacggcgtcgtcatcctcgatggctcgatctccccttcctctgccgcctctcccggaccgcctcgacggcagccatcggtgacgccaccgccgccgcatcggccctcggccctcggcacattgctgttcatgatgtagtgggagagtgttggtatttcttaacgacattactataaataaaattcccagcaagggtgcaaaaatactcctgatatattatggttacagagttcatccacaagcgcacggatatatcattgtagcatttcacccgagagtattccaagggtatcgtatttatttaatcccgtgagaagatcatagtagagagaaccggactaataatttatatgttacttgtaataatcatagtctaagcagggattaagataaatcaaagggtagagtgacacacaagcagggagcttctcattctcatactaaaatatctaagctaagtggaaagaaaatagaaagagaatctattcctatatttctagtatacataatatatatatatatatatatatatatatatatatatatatatatatatatatatatatatatatatatatatatatatatatatatattatagttatctgattaactagctaataccctctatgcgatgccctctggtacttcgagaagccacccctaactgccgagttccttacaacaggccgtcatgaccatacaaccgaggctaaatacggaggagtaccttactcaggaaattcacttaggactatatacacgcgtggaggaatacccatactgagctgtcaccatcagcggcacacctctcatccgcagcatataaccccaaataacaatatcccgtaatctagacaccacgcctaaactaccagatactactctaatgtcattgtcatgacatatagtaattgcataagcaaacattatacccataccaatgcatctaccagataagctagcagtatgatcaatataacatgaacataatgtaaagttggcattcatatactcgaaaagtatttcaatatcataaatgtataaagaagagtattctaataaaagtacaaagcttacaaaagaggaaaggagagctactagagccatacccgaactcttccgaatgtttccggactccgatttctactatattcctactccactagcttaagaacactaaactaaacttgagagaatataagagagctttgcttgaggtgtgtgttgaaatggagagagtgaggggtttatgtagcctcctagtgacggttggaatggtcggaaataccctccaaccgtcattgggagctaaccacatcgccagccgcaacccggcatccaacagngcgaggangggnnnggcngaaccccntggntaggccgacacatgggttgggccatcccgacccatcttcggctgacggcctcttggacttctcttctccgcagacttgtgaattttggctcaattggtcgtgtcatttctgagttcttggcccattcatacataagtctaattctcgacatcgtccgattgatttatcgtctggtcgatatatgtcgattctcctccactttatggttattctctgcaaaaggttagtaaacctaatactagtataatattattattctaacataaatatgtattgcaagcataactagctctcctctattttggtaatattgacggtcgaaactgatcgctaacgaccgtcaacagggagaatgcgcacgggcgggcgacgccagcgctggcgttagcgtggggccgtgacgcgatcccgtgcccgccgtccgctgccgtcgacccgctccccgccccgacggagctctgcctccagtacctcaccatggacatctcgccgccgccttgctcccctgcgcccgcgtcgtctccgccgccaccgccgccacgttgccgaccgccggaccttctctcccacctcgcaccgtcggtctcctccccacccgtcggccggcggcgccgacctgcctagagccccagagagaagagtgagagagagaaagagaagggagagaagaggggaaagaaagagaggctaactggacaggctgacatgtgggggcccacgtcggtcccacactgactcagcagacacgaaagataaaaccgggatcaaaaccaccgagggatctattgtgaccggttttatatagttaagggaccctgtatatctggttttgtagttcgaggatgttttgtatcccgatgacaagttgagggaccttcggtgtactttttcctttcgtggactgccgccatgggcttggcagtgtctgtttgtgcaacactttatggaactgcctattcatttgtccggtgatttctaacaaaaaaaaatcatctagattttttctaccgttcgatttacatccaacggactaaaaaaaataacaaatacatatttacttacgatatttttatcaaaattacagtgcacttacatgtcatatcaattgaatttacaaatgtaattttagttatatatggctgtaattttatattttttaaaaaataacaaatacatatttacttacaaaatatttttactaaaattacagtgcacttatatgtcatatcaactgaatttaataatgtaattttagttatatagaactataatttcctgcactaatcttggtgcatgcctctacggccaaaaaaacatcaaatatcagagaaaaaaaatcacgtttagcaaaatcgacaccttacacctaaccaaaccgagctgcacaacatgggaaccagatcctctaacgtagcgctggctacgtcagagggacgtccaacggctctcgtccgttcattcggcatcggacggagtcgagcgagcatagcgattagactcagcccatatgttgcagaaaaatcggcccacgcgacctacagccaatcagccatcgacgccgcctccgagccacaaccgccggcgccgctaggaagcaagtcgtcgccgtcggcgtcaccgccgcagcctgcgcctcccagcgaggtcccttcattgccaccctcctcttccccatccccgtcccccacccgcctccgtgtcctccctcgagcggaagcctccgctgcgtccggcgtcccgtcgtggaggtcgcggaccgtgcgcgtcgacgaaaccatgactcctggttggaggtcaacatgtcatggaagatacagcaggaaagaagcaacttgtccaaagcaacaatgcattgttgtgagatttattgttaagagcatcttgagtgctgcaatttctgttggagttaatttatttctagaacataccagcctactctctaactctctctactactccctccgtcccaagaaaagacaaacactgatttccgtgccaaacgtttgaccgtccgtcttatttgaaaaaaatatgaaaaaaattaaaaagacaagtcacgtataaaatataaataatgttttatcatctaacaacaattaaaatacgaattataaaaaaaattcatataagacggacagttaaaattagacacgaaaacccaagatttattattatttttttttacggagggagtactcatgaaacacaaaagtcaagcagcaagtcgtgtagacacataagactcgccacgtgcaccgacctgtctgcatttccgctcacccgcgtcgtctcactcgacagcgacttctgtatcagtgtcactggtccgctgcatagggtggcgctgttgttccacagcgccatgcccccggcccccgctgccttgccaaattctgactgccacgcgccctcgctgcaacggggtggcggacgcagtttaaaatatataggtgagatgaagaacgaagatattcgctcaactagagcaatcaaaatataacctactttgtatttatagtttaatcgtataactaccatacctcgatcatagtttgtgttatgcgtgcgttttgcagagacgtattaatctgttggtcattctcacaccttaatttatctaattttgttgacccatgactactataatgggtaagagatcttaaggggtgggacggcacgggtcgtaacggagtcggtcgacccaccctgcccccggtaccgtaaatcaatattgtatataaatatgctttacgtcgtaaatatagtaaactattgattcgaaaaatacaataagcatatataaaatactacatacccgccgaatatgtgtacgaaattatagtagattaattcaaataaactaatatactaactatcttaatcagctgtgctagcaggctcggattgtgctccagatatatctgaggaaaaagtacaccgaaggtccctcaacttgtcatcgagttacaaaatcgtccctaaactacaaaaccagatatctggcgtcccttaactaatcaaaaccagtcacagcaggtccttcggtggttttggccccgattttgtcctacgtggcagctgagtcagcgtgggacccacatggacccatgtcccggtgtccacgtcaccaccctctctcttaatctctttcccctcttctgcccaggaccgccgcgcctccctcccggtgctcggcgctcctcctcaacttccgcgtcctcgccgccgtcgcagggtcccacttctcccccgcggtctcccgcctcgcggcccgcctccgcctctccccgtccatggccgccgtcacgctcctcgcgctcggcaacgacgcgcccgacgtcgcgggcgaacgacgacgcgggagggacggcgaacggcacggcgatgagcgcgacggccccgacgacgaacgcggagatgaacgggcgtcggcggccagcgacgggcgatgcggcggcggagacggcggcgaccagcgggtcgggaggaggtcggcgtggcgaggagggagaggagaaggtccggcggctgactcgccccgccgccgctccgctccactccgcctgccgccgcgcgctcgcgggcctgctccggccgttcgcttgccgccgctccgctccgctggcagcgcgctcgtctgccgccgccggtgctccgctccgccggccgcgcgctctctgcacgctcgtcgctgccaatactggctcagcatcgtccacaaccacaagaacaggctcttctacctgctacgctgttagcacacaagaaaacactcttagaccgagacgtactcacacctggtgaatacacatgcaggagagtaggcaaagaacacaaggtatttgtgctgcacaaccgcaaccttttctggcactgcacaccgcagtgttttttttcaatgcacataatcaacctcaaagtacatgcttaaatagaccagctagcagcccaagttatgcatacataagaaaacatgcaaaagcaaaatactaagtctagattatttctaacatacgctattgcggctccatcttctcacctcaccgccgatggcggcggcggcgtcgtcgtcgtcgtcgtctccgtctccggtagcgcgaaccatcttgcgctcgccgccgcatgcagccgcagccgcatcactcctctcctctgatcccaaacccacacagtacctcgccgtcacgccgcgcagcgagctcctgcgtgtgacacggcggtggcacgagacgacgatcatcactccagcggacgcatccaacaacagggcgcacctgaagcacgtcgtcttcacgacgagcgttaaggtcgaggaggcttcttcgccttcgcgaggcccgagagcaaaaccaggtcgagtgttgctatcgcgtcctcctctgccaccaacgccgccgcggcttacacgtcttcttcgccgccgccgccgccgaccgccgtcgtggcgccgccctcctctcccgcctcgcctcgccccgccccgccgacaggtctacaggcagagagagagagagacgaggaatcgaggaagagaaggggagagatactcagcctaacatgtggggcccacgtgggtcccacgctgacttagccgccacgtaggataaaaccggggtcaaaaccaccgaaggacctattgtgaccggttttgattagttaaaggacgccggatatctgttttgcggtttggggatgattttgtaactcaatgacaaatcgagggaccttcgatgtactttttcctatatctgatcagcgtgcatatatagcccatagatatgtgtgtgcatatgtacttatagataacttaactatgtgtacgtgtactatcgtgtataggtttcggtgcataccgatgcatatgatgtacgcttagatacaatagattaattttaaaaaaattaatccattagctacataactaattaaaaggctctcatgcgaagattgtggttgggccgacaacatacgaaaatggtgatctttaaataccttttcgtacaggcgggtgacataatcgcatacgaatatcggttttaagcttttggcaacctgcaaaaaccatttattagtagtatacattagctcataggtttgatgaagagttcttttttttaaaaaaagaaatagagggcaaaagttttgtgtagtatgtattgatatagtagggggtttgatgaagaacttttaccaccgataattataacaatatgttaccaactaattaccaaaatcctctatattcatatgtttcttacattcaacctactcattaccaactaattaccaaaatcctctatattaatttgtttttttacattcaaactactcaataccaactaattattcaaactactcactaccaactaattaacaatatctaattattaccaactaattagctaaatcaccaggtaaagactatataagatgagctagttattagtgttaattgcacaaaccatgtctacctctactgtcattacagcggtgtttctgttataccttgttttccccgtgcaatcagtagagttcttcaagaggtacgtcggaatgtataagaattatgttgtttgcattctactccctccatccataaaagttacacctattttacatttaagattttctaaataagttgtttctatttatagtctttatgcattcaaaacttaaatgaggagataaattaaatgtttaattagaacccagggagtcatctaaatactcattggttacatccttgcattcacttcttgattttgtaacatccaagatagtttaatttctccttatcttggtggcaaaagtaataggtgtaacttttgtggatgaagggagtaatataattcttatgtcttagctccatttgtttttttttctgatttcttttctccttttcagtgttgggtgggctccatatcatgttttggattacgacttcttcagaaacagttactatgtcaatttttacatgtttcgagacgatgtaattgctacctcaagtcagctacagattgataataggtatatccttagcgaacaaactcccaatcgtgcgccagtagattggaagatgggacatctgattgggagaggggatgacaatgcaatgttgtcaatccgagcagataacttgtatgtaaccggatttgccaacagaaccggtcattggcatgtatatccaaagtttgcagatcaaattcccgaacccaaaacactcctgacttttggagacgactaccattctcttctaggtgatggttccagccaaaatctacccaaaataaatctcggactgcatgccacattaaatgccatcgagactttgtccaactaccagccatcctcagataacacggccatcaaaatagcattaaccacgctaattgttaccctgccagaagccgtacgtttccggcctatccgataccggttattggatggatggtttacagggactcgtcttactagtcatttggcaaaggaagtggttagctggcgagacatgtcctgtgctgtccttatttttgacaagtatggaaggtggtgggcaagtgcagaggccggaatattgcaggggaagttccagattcgaagcaaatttgataccctccaataccttgatgtggtgctttggcctagacctaagaaatgctccctaccaatcttagatgaccaacatattcagcagattagggcacggatggataggagggggcaaggaagaggttaatttgtagcccctgattaactgctatctatatggaatagcttgttgagaaatttccttttcatatacaataatgttggtgaatgaatcttctcatatcagttgcattttctgtgtttgtgcatgtatatttttcattcattttcaaagactctgcattctacaatgatatactaccctttaaacaaaaaaacactaacctttggattcgctaaatcacgcattcaacgccccccaaccccttctcctcgatcttccttctcccgacctcaccgccggcaaggccgcccccagctgctactgcgccacctcaatccccagcgacatgggacggatggtactgcacgagtcgctcgacggcgcggggggcgcgaccccgggagggaacgaagcagcagcatgtcgggcgggcggctcgacaccagcgtcgccaacaacccaaccggtgaccggacctcgcatgcgccgcgctctgcgtcgccgcagccgcaggccgcagcggacgactggctcgctcgtctcccgatcctgcgtgctgctcccccatcggacaactacccttcttgtttgcgcccaccggtgcgccgcctgatcacgtcttcttcgaccacctcggctgttccatctacatccacaaggtacgttactataaagcacaattaacaacatttgcaacaagcacagataattcttttcatcgtttgacttcagactcactctgttacttcgcttccttgattgaatttggaagaattgcagcaagcacatatattctttgtattgtttcacttcagactctgttagtttaaattctcaagaatttcttcttgtcctggtttgcttggtggctaggttttaacatgcgatctgctttaatgcttttgttgatattttcagatacactgaagatgaagatgatatgattggctttactggtttttacaatgtggatattttcttttcacatgatcccaacagccttcctaggggttatgagaaacacaaaaacaagttgggcaaagaaccacatattatgacatcaaagtcacttcaggtagaggtttttttgatcatcagtatccatgttctatatttaactgtcaatgtgtttttatctgctcaatagctgtttatatctcaggaaaggtagttaccacaaattactcaattcgtagcattaagccagccatcctttgggccccttcccctacagagaactttataccaatttctcctcttttccccctacagtgtctgatgtcaaattttaagatttg

SEQ ID NO: 9856 - DNA, 25047 bp, Oryza sativa
cctttgtctgctcaatttcggcagccaacatcgtagcttcagatttcgatgcatttgatgcgctcttgagctgctctatctctgatgtcaccttcttgatctccatcagaatgtgtgacgaatcctcgcgccttctttgcctatcattcagcgtttgcagcttatgtgtacgcgatccaattcaccctccagcgaagagatcaaggatgtgttggagcaaaccttctctcgacttctctccaccaagattttctcttttgctatctcattgcacagcgactcaacggaggctcttatctcggctagatcagctgtggttctggtcaagtacgcttttgcctgctcaagctgcattagcactgaacttggaggctgcagattctgtgaatccaggccacccaattccccatcagtttcaacattttcagaagagcgcctctcctcaggccctgcacctggtgcttcagtttggcccgggtgtccagtgatggctgaatcattctgcacttttagcttcaagtccgaaatgatccttttggaggactctaattctttgagcacatcaagcgtctggctttccttgatgatgagctccttctctagctgcaaggtctgcccattcatctggtcatgttcctgcaatcggattagtagcataagacaaaagggagcatacaaatactgatgcagatttgcaagctgattttgctaatacaacgaggacaaaactagtagtacaaaacactcccaactgtactgaaacattaacagttcgttcgacactcaacagcacggtgtttggacttgggagaaatggagaacgaagcacgaatattgggaagattactgtaggaggcgtcaccttcgggggagtgagcatgcggttgacgaggcaggagctccagacggcggcggcgccgccgccgaagtggtcgacggcttcgcgcaccgactcgaagggcgccgacgtgtcgatctccgcccttccaccgccgccgccgccgctcccggccggagcctcctcgccgttcatgtcgagcggtacagtgccaatacagtgctgcaaagatgatctgttgttttgtctctctctctttctttcttgggtcttgtgattttggggaagagccaaagcaaaggaagagaagagaagcaaagccaaaaatgccaaatggcatggaaggtttggattgtttggaagcgagtggttttagacgaggaggaggcgggagttgggatgctttgaccgttggcctgtcattgcagaacgcacccgccgcaaaaccattattcatatgcgttctcgttgcgggattagactcacgagagctctgctccaccgcatttgatcacttttggagttcaataatccctttttttctctgccgggttggcccggccgaacgagttcaattatttcaggctgccatctttctaagcattgcgaaacagtggctgtagatggggccgcgtctgaagcttagggtctggtactctgctgccgccctggatcattcatttccccggcggcaaggggcgtgccgtggcgagcctgttttggcgcacgtcacgaggaaacagtgagtgccatttctccgccgtggcgcgccaccatcacgttgtagcgtgacaacgctccttgaggaacacactgttgatgtgatcaccccgtgcaggacttgggggatttactacgaactcgggccatgcttatctgccatgtgggcccagtcctgatgggcttacgcagttttacgcttctgtaaggtggggtttcgtagcatcgagacgagtactgagtactactagctgggagctgggcccctgtgttggatgttcttttatctagttaatctaacttaattaggccgtatgtgagctgagtatcaattggctaaacaggcgggccgtaattaagctgcccatcaactcatttaatcagccgcatgttagttccagagttctacagcactaaccttgaaagtccggagaggagcaaggcccagacgtccgtacaaaaatgttttagatgtttcaccgaaatgttacaataaaaatatttaagatgtttcaatattcggtaaaaatgtttcagcggttagagaaaaatgttcaaccaaatgcaatatttaaataagctagtcgcaacacctaagaattaaagtgcgcaacatacaattaaaatatagtaaaacattcaattacaccaaggcgtaacatgcatgggaaaataatagcttgcaacatcctcacaaaaagctccaaaaagaaaaaataagatatggcctacctcctgcatccttcctccactctgacaaatggatctgtctcccttattgtaagatctttcaatctttggtcgctcaccggagattgtggggatggcaacaaacgaccttgggccccctatgtcaggccgacgaaaaatatagagagagatagggaaggggtcaaagaggcttgatgtgttagatggaaatcgcgtgaaagagagacaattttgctatatatttgtctataaatttcctcttaaaaatttgacagatgtaattaagtactatcatagtataattacactgtaacttacatgtaattacattgtaacttacatgtaactataatgcaacttgcatgtaactttcacatatttcttgttggggaataaccacatacttagagtgtcgtataaactaatgtataaaaggattaaaatacccccaagaggatgttgtacatatatagtaaattaagggtaaagatgtaatttcccgttacatatgaataaaataagccctccaaggacaagaggatctcccccccacacccccactccattctcggccatccaaactttatcctctttctctcaacctctctcctaaagaactcaagcatgggctctctcctatagaggagagggcccttgccatgcattttagactttgttccaacaattttgaaccattagatttgtttcatgtgcaagtgaagaaggaaaaaagtcactacacgcacacatgtgagaggattcattcccacgatctccgtttcaccaaaatagcatgttacgaagagattgttaagagttatatacaagttacaatataatcacatcacgattgtactataattggatgcgaaatttttaggagaaaatttgtcgacaaatgtacagatgatcccataagagatgggtaaatgatggtggggccgaacacggtcgaatgtcttacacgaagcgttttcatgaaagttcatcatgcacgcgtcgatttattagaccgtaaggcctaacttcctcataattgggccgtatatggcccacagaatactttagtcgtgaaatgcgtctatgggattatgtactagtcgtcgcctaggcgattccttacaaactatcaatttatcgatttttatgtaatctatctaaaaaagaaatgcgcccacgggattatgtactagtcgtcgcctaggtaattccttgcaaactatgaatttatcgatttttatgtaatctatcctaaaaagaaaaacatttttaaataatggccactgaatgaagttttgaatagaaaataagttttttttatacaaattgctattttgatattaggtcaataacaacattcccaatgtgcgattatggagttctctctacaactcaacttatgcctgtgcatgagggtatatcgttgcaggtaagatgcaaatctagttcaacttttttatattatttttatcttatttattgtggtaaatatgtttgtatttttagcacgattgacgattggtttgtgctgcactattgccgcaatactcgtctcaccagagacataaatttcatggctgcactcataccgcgacttcaaatacaacatgactatgcaatgaccgagacagggacacgcatgtgaaagcacggcattgagagtctaaatttgggttgctgcataattatgaactgcttgatctctaaaattgtaaagtacttgatctctgaaattgtaaagtagtgctgcctttagtcctaaaattgaagttacttatattcagcaagatcatatgcggctctatttgatttttctattgcttggaagtaagaaaaatgtgtttttcaaatgattcctgctattcatagtttataggccaaagttgtactaaatttaatgtgtcattttatgcataaattctgatgaattcaaacaagtaaaataaattttaagattcatcagaattaattggttcaaatatatttacttgtggatttaaatttttgaaagatcaattatttattatatttagagtttttttaacatatcctgtgtaacaaaaaaacacaatcattttttagctgagtaggtattaatgatcctattctgtgatataagaaaacaagattttctttttttctttgttttggattttttttgcataataatgttgggtttaccgtatattctagagttatatgaatagtaccgagtagacgtaggatatttaaagaaggaaaatgaatgtaaattcgttattttagatttgttttttcttaataattttaggtttattatatattgtagagttataggagtagtaccgagtaggcgtggtatatttatagaagacaagggagtagaagttcgtgtggttggaaagagaagatctggaagccgaatctatatgtgatatttttctctagattttttctcacatatgattgttaggtgtttgttctctagtataaatttataatttttctccaaggtaagaggcgccaagtggaccaatcaaaagctagcaaaagtgccagctttagattatgagattttgcagtaaatgggccggaatgttccgctttcggccctacaacgggacgggatatacggccgtaaaagagcctgctgacaggccataaaaggcccacagagtatcgatacaggggcctgatggtccgaaatcaacataaaggagaagggataagttcactttaggtccctctatttgtcgtccagtctgattttcgtccctgaaccgtaaaactggatacaacccgtcccccaacttacgaaaatgggtaaacgaggtccctcggcggttttgatagtggttttggctgacgtgacgcatacatggctaatttgactcggtcttcatttgacgtggcacagacgtggtgcttacgtggcaatttgatctaagaaaaataataaaccttgtgaaacccacatatcagtttcacacataaattaataaaaaaagtgggacctacgtgggccccacatgtcatcctcactcctcccccttcttcctcctctttcccctttcttcatctctctcccctcctctctcacgcgtgatggagagggagcggcacgcggcggcgccgacgggagaggaagcggcgcacgccctccgccgcaactagcctccaccactgtcgcctcctcacgctcttcgacgccgccggcagcagcggagcggtgcgcggatctagagaaagagggaggggagagaggagaataaaacctcgccgtcgcccctctcttctccaccgccaccaagctcgtcagcggccgcccgccggagcgaggagcttccccttccccttctttcacccgggcggcaccatcacgcgccccttcgtccccgacgcgccgccgtctgccaccggccttgtcctctcccgcgacgggccgctcgacgcctccctcgacacctccccaacctcgtcccgccaccgccgccagcgtcaaagctccctgtcattgtctacttccacggcggtggcttcgtcctcttctccaccggcagcgtcttctaccacgcctcgtgcgaggccatggccgcggccgtgccagccatcgtcatctccctcgactaccgcctcgcgcctgagcactgcctccccgccgcctacgtctccgccgtgctctggcttcgcgacgcggcggcgggggacccatggatcgacgcgccacgagggaggtcgcgggtgcgggggctgtcgccgccaggtgccctgcccgctcctgcccgtcccactccgaccgccaccgctccttgcccaccccacttcggcggccgccgctccttccccacccactccggccgccgccactcctccctgccgctccgccgctgccacccccaccgctccggatggagagagaagagggaggggatagagagaaggggtagtgagaatgacaggtggggtccattagtgtgtgtgtgtgtgtgaaactgacatgtgggtcctgtaggttttattattttttttatcgaattgccacgtaagcgctacgtcactgccacgtcagatgaagaccaagtcaaattagccacgtaggcgccaccttagccaaaacaggggtcaaatactgcccagggaccttatttaaacggtttcgtaagttgggggaccagtcgtacccggttttacgatcaatggatgaaaatcagactgggtgacaaattgagggacccaaagtgaacttattccaaggaggaaacagagagaaatatttcaagtttcaacctatgtctaaagcacgcgtttaaatatttgcggcaagtgattgaccaaaccgtgtgattgtgatccattgattaggtcaagcatcgccttgatacatgcctctgttctaaagcagtggcagtttattaacctgcaaaacaacccaaaaacagctgttccataaagcattttatacgcagtgctggagcatagattatagcgttcggatggtttcttatcgtgttaaactggctcattataaaggaggatatgatcagtcgattttgctggtttctgcaagaaaactatgctaacaaacttgcttaacaaaagtagttcctcattattttacttatggacgatggctcatattcaattcggtaccaaaaaggttcatcaggtaaatatccgtgtaataagtaacattttgttaagaaaaagcctgtattatgtttcagaaaataaacaaagaaaaatcctgtaaagaggtcggcattactcgcaagaaaccagtagcactttacatgcctgtcacaatttggtaattgataagatggagaagaaactgatctcttctttgacaagcctcgcattgacgcattctgaaagcctggatttgcattagatctctatcatacaccgaaaaaaagcaccggttgttaacctggctaatagtgacgggtcaatcgcacatatttagcccattatataagcacacagtctcatcagcatcacactccaaaccagcacattcgaccatctcactagctaatcgctggtactggaagcagtagtagcagcttgccaaaaatggcgccatttcttgttgtgttcgccgtcatggccgcggcttttgcgtcggcctccggctccggcgagctcaccccggacttctacagcgagacgtgcccgcaggcgctgacgaccatcaagctcgtcgtcggcgccgccatcttgaaggagccgaggatgggcgcgtccttggtccggatgcacttccatgactgcttcgtcaatgtgagctagctactaaatcatgcacgcttcaacttagtggttaattgctgcagattttacaagcagatgagatgttttggtgatgaacgaacgtgatgcagggttgtgatggctccgttctgctggacgacaccgacgacatgatcggggagaagctggcgaagccgaacaacatgtcattgagagggttcgacgtgatcgacgccatcaaggtggcggtgaacacggcctgcttggggaatgttgtctcctgcgctgatatcttggcagttgctgctcgtgattcaatcgtcgcggtaagttcagtacaagtgtaaaacttatccacgttacacatactgtcgattgaaaggtactactagtagtagaaagctatctatcgaacagggcaacgtcatcgaccataagacaaaccatgctccttttgaaaatctttcttcaacctaaacccaataaccggctttcatgacatcattttcacaagagaatgagtcgtgattcacttatctgaaaaactgcggcacatcctgatcctgttgacttggtgaggccaaaatgagggtttatttagttggcaaaaaaatttgcccctgcatgtcacatcggatatatagatatatatttgaagtattaaacgtagtctaatactccatccatcgtaaaatataaggcacaaccacttttacgtattgtagattatgtcaggaaactgcgagacgaatttattaatcctaattaatccgtcatcagcaaatatttattgtagcacaacattgtcaaatcatgacgcgattagacttaaaagattcgtctcataattttctggcgaactatgtaactgattttttttacatttaatactacatacatatgtcaaacatttaatgtgacagcacgaaaaattttgtttgggagtttagggaactaaacagaccctgatgtcaatgcaacgtgacacgtacgattcattttgtttgcagctcgggggaagctcgtacgaggtgctcctggggcggcgcgacgcgacgacggcgagcatcgacgacgcgaacgacgacatcccgaacccgttcatggacctcccggacctcgtcgacaacttcgagtcccacggcttgtcgctgcaggacctcgtcgtgctctccggcggccacacgctgggctactcccgctgcctcttcttccgcagccgcctctacaacgagaccgacacgctggacccggcctacgccgcggcgctcgaggagcagtgccccatcgtcggcgacgacgaggcgctcgcctcgctggacgacacgccgaccaccgtggacaccgactactaccagggcctcacgcagggccgcgcgctgctgcacacggaccagcagctgtaccagggcggcggcggcggcgacagcgacgagctggtcaagtactacggcgagaacccggacaagttctgggaggacttcggcgccgccatggtgaagatgggcaacatcagcccgctcaccggcgacgacggcgagatcagggagaactgccgggttgttaaccagtgagtgatcgatcgatcctggtgtggtcaagcgacacacgacacgagtcatcgccacgaatttgcatggcacctgtggtagctgctgatttcttgaagggtgtgcttgcatgtacttctgattttgtgatggcctgctcttgtatttgaattgttttgaaaattatgttccatttcaaccaaaaatttaatatctgttcagacctttcccttttatttttgaaactcggatccgacggtggacacaggagtactagtgtgaatgagctacttccttaatgggacgtgacccagttatactgggctttttcatagaagcaccgacatgttacgaacgagaaagttcacggcccaataaaaaatgtctcatgtggagatgacccagcagcccagccacacgcattctgatcccttctgatgggtctctcggtctctcgtgtggaatactagtagcttgtaggaataatatttagaagatgagtatagtataatcctccgtgcctttgcaccagaaatttcgttacatatacgccatgcatatgcccctctgtcctctgtattccatgcacatacagatggaacaagaaacagagcaaggcaaatctgcatgtaccacatctccacgtacacattgctattcattcagtcgtagtggttgtgggggtccttattttttcacgcactccatcgtcttatacgtgcataactgcatatactgctacaaacgttgttactacttactgcagtgtctgcagggtactcgcttacgagttcaccttggagcagctgagcctgatctggccgtttgttcccgtcttgggcgcgatgttccccatgttcaccatggccgtcgcgaaggcgctgctgaactccgccgcgttggacgcgaagttcctcaccgtgttgtccgtgctgccgttgttgaagagcacctggtccgagtgcaggaggcccttgttcgacagcaggttggtgtagtaggcgttgtcgaacgcgttcgccgtcgtcgtgtccagcggcgccaggttcatgtcgccggatgtccgtgggcagttggcctggcgttgcgtcgcgaaggccgagtcgatgttggtctcgttgtagatcctgcccctgaaggttgagcactgcgcctgcccgatcgtgtgcgcgcctgaaataggagtgcagaaaattaagcttgcttggtttgatggtttgtgagcatatatggtggatctttacctgagagagcaaccatgtcggttacgctaaggcccttcttggcgaatgcgtctacgagttcttggaggctagcggtaaaaggagggaggtcgctgatcgcgagcgccgcgcttgcacctgtagagtcccttctccccagcgggacagtccacgttggccctcccagctgcatgcgcgttcatatgattattactccattggttaagtacaaaagccgaagcctaataatgtcatatatatggatcgggatcatctgacgtaaaaccagaggaacgtgataactgatatatgagttccaccactgacgggctcacctgttactgttagtgatcacgttaggaagaagttcacgttagaggatccgtttcccacgtacaaccatacaggaatcgatcgagaggagagttcgagaccaagcgtgcaggctatgcatgcagggaaagtgatcttacagcgacgacggagtcacgggcggcgacggtaaggatgtcggcgcatgagacggtctgattgcacacggcctctatctgcgccttgatgctgtcgatgacgccgtagcctctaagagaatccttgtttggaggagcatcctgctcgtttcccgacaacagaacagacgcgtcacaaccctgtacagttagtcaaacaggaagaatgtatggttatttgtcttgcttgtcaattgtcatctaactgcatgcacacatgtacaatatatggttatttgtctgaacatgtcatctaactgcatgcacacatgtacaatatatatttaacttttctagttcaattcaaatatcactcaagttgcttgactagagatatactgcagtaacgtttaagtcaaaatggaacaaaggcgctggttatgtgtggaacttgcttggacaaaacagtcatggaagtgcagcctgagcagcgacgcgcccatgcggggttcgctgttcacggcggcggtcacggcgctcttgatgatggacatggctctggggcacgacgtgtcgtagaacgtcgccgacagctgcgccgacgccgcggtggccagagccacgaccacaagcaaggaaatgcaagttgctttggccatcgctaagctaacaattaaccaaagatatatacgtttatctctgcctagcaatgagctatctgcacttggctgtggcttgcgaggagagtgctgcatcccatgcatatttatagctagagatttaattagcccacttggttacctgcatatctctgtacttctccagcagagacaaaacattcagatttgatgccttaccagtccagggttagtcctcacaatccactgtcgttgtgcagccattttgatcgtgggtatgaacagtattgaccaacgtgtgttggcattcgacgtgctcacgttgtgtggtgaagtaatttggcttgcatgcacccaagagagacatgatcgggtgacagcgcccaacttaaattgcaaccgccaacactaacccctgcttccctctttcaccgggcaaaattatagtatatccttggaattgtcaggcatcgcttgcaggaaaagtctgtgaaacaatggcgtaacatggctttgtcactttagttacagctgtgttcgtgaactttctatgagcaagtgagtggaaaagtgtggaatactacatccgttttttaaatagatgacgccgttgactttcttttcttacatgtttgaccatttgtcttattcaaaaaatttacgtaattataatttattttgttatgagttgttttatcactcatagtattttaagtgtgatttatatcttatacatttgtataaaatttttgaataagacgaatgattaaacgtgtgagaaaaagtcaacggtgtcatctattaaaaaacggagtgaggagaacagaacagccaccatccctggtcatccatttcactaaacagtctttgggctaccagtatatactcgtaggaaacaaataacagtacagtgcactactactgtaggtagcaccagaacagtaactgttgtgacactgatccaagagaatgtcctaacagttaggacaccacgcctcgccttaaaccatgtaacagttgaatgttcagctctcgcatccatgataatgagtttgtctgccatgcaatcaagcagagttcatttcagttaagctggggccgaactccattgccatttcgatctatcacatacgtgggcatgttcggatgtgattgctaccataacagccgttattgcggcagttcaaaatggctgtagcttgcaacggttcaactacctcagccacagcgtctgtagcagcaatcgcagccaatcaaggccagtactgaattaagttgtaatgacaatatattgatatttcttctgctctcagtatctgtttgtgattaatcagaatctgtacacccgtacattatactagttgatcagcaaagattcagaagaatctgaagttgtaagttactttcacggaagagggattctaatcccccgagagaatatcaacgcgtataaccttttcttttatatttaatataaatagttgtaaaattatttaaaaaattactaatgtagagtataaacagcatataccattctaccaaaaattatattcaaatttgatccgcgcattgagaaataaaaagacaaattcatatgtgaatagtaccaattaatgctggatttgttttttaatttcatttctcaatgtgtgagttgagtctttacttgattttttttagagtagttcatatatatgttgtgaatgttgtcaattttttttggagaattttcaatatacaggtaaaacttcaccgttcagaatctagattagttcaaatatatggactgtcctcgagaagaatggcagaaacaattagtcaaaatttaagcactcattatgattcttaaactgaaatcaaatactggaaatacaaacacatgtatttacaatatcgtgtccagcagcatatgaatgatgatttagaagaagaaaaaacataaagggttcgcgaagaaaatgaaaaaaggacgtatacgagaaacattcacccaatatatttcatgacaagtgcaggtccaacataatccaccggatgtgcactcggtgtggaactccgtactaacagacgaaacacaaccctagatgaatcgattggtcagcatttgtccaagataattctctccttttctgaccgttgtgcagtcattttgctttcctttcaccttcagaatgtttaaaacgacgttgacagctttttttagttttcaattcattttttttcctgtaaaaacaaatcatttcattttctacccgccaaaaaaaagcatttcaatttctgccgctggtgaattttaatgggccgaagtagtggcagcctgccaagtaaagagtaggcctttgcgccgcgaaaataagccggcccacgccccatccaccacgtagcacgctcaccggcatagatgggccaaatcgtcaccttcacgggcctttgcaacgtggagcaaaatatcgccgaggcggtggagatatcttaactcgcgccggcggcgcgcgtgtggtcaccggccgacggcaatccagaaaacaaaaaatcttgctactgcaagatggaggacgaacaggtctagcaagattgcaagagcgggagtcctctctctctcaaaaaaaaagagagagggaaaaaataacttgtaacaggagtggattttgtattggagagagaagtcggtacagatcaagaagcatgcaaacctgctaataaacggacgcagattcagtaacattccccgtgacattctcggtgacatcttcactgaatgctctacgattttaaaggactataattgcgtatgctaatacgagcgtacctcctccgttccaaaaaaaaaaaaatccaatcctaataacgaacatgtgtcaagattcattgttaggattggattctttctaagacggagtagtatgtttcacctgtaattaattgcaactggaattctttccttgatgcattcgtgcactggtaattaatcatgttgtcgagtgcccagcgtctggatatatacaaaccggtcgatcagatcacgagttgacggcggagcagatgagcctgatctgtccctgtgtcccggtcagcggcgagatgttccccatcttcaccatggccgtcgcgaaggcggcgccgaacgccgccgcgctggacgcgaagctcctgaccgtgttgtccgtgctgccgttgctgaacagctcctggtcggagtgcaggagccccttgttcgacagcaggttgcggtagtaggcgttgtcgaacgcggtgggcgtcgtcgtgtccagcggcgccaggttgccgtcgccgctgcccggcgtcgccgggcagttggccttgagcgccgccgcaaaggcggcgtcgatgttggtctcgttgtatagcctcgtcctgaagcccctgcaccgtgccataccaatcgtgtgcgcacctgcataattgaaacaaaaacatatcgttttcaaatttcaacacaagctgttgtttactacacttccatggttgattaggagatcgatcgaggagttatatatattgtgtgcacctgagagagcaaccaagtcagtggcgctaagtcccttgctcgcgtacgcgctgatgagctgtgcgaggctatctgtagaaggagcaaggctgctaatcacctgggccgcggtagcggctccggtggagtcccttctccctagcggaacactccatgacggacctccaagctgcatgccaaattaaaaaccaaataaagcaattcagcatcacagaattcgtaatcgcgagctcgatatcttgtgtcgttgatatatgcatgcatggttaccgcgacgacagagtcgcgggcggcgacggtgaggatgtcggcgcaggagacggtctgcttgcacacggcctcgatctgcgtcttgatgctgtcgatgacgtcgtagcctctgacagaaaagtttggggctgcattcctctcgtttccggccagcaaaattgaggcgtcacagccctgtgttgattcagacaaaaattaagccacgattattttcttgcaacgctgctaactcacgtagtctgacagacaggcaaacctgttagctacttttcggccttaaatcaaagtaaaaaaaaaaaacagggtggtttgtgagatggaaacgtgcttggacgaagcagtcgtggaagtgcagcctgagcagagacgcgcccatgcgtggctcgttgttcacggcggccgtcacggtgctcttgatgatggacatggctcgggggcacgacgtgtcgtagaacgtcggcgacaaatgcgcggtggccgtggagaccagcgccgcgagcatcagtaataggccaagagaagaggcagaagccatcactactctttggaacagagcacactgcagtttcttcctagcaagtactcgtagcaactactcctgtctaagcagctcttgcaagagaaaacgctgcattgcatgcatatttatagctcgcgattttctcccagcaaaatgagcctgcatattgctagatagtagatacattggagataaacagccaacaagtatattcgggagttatgtcttcacatatgccagcaaaagtgcaaaatcttggtcgttctctacttctctgtagggactccctaatattactagtacgcatgtgtccaagtctgataacaccagacttgatttgctagaaacgatggctgctacaagccaacatatgcagcattcgtgtgggagagggccaaatctgtcaacgtttcgccagagctgcattgctgtaaagtaattttgcattctagttcctcttggctggataaaccgatgttgacaattttaattatcttttagtttctatacctgtccgacataagtggttttcactttaggcacagatttctgtttagagtttacaggtaggttagccccattttaattgctgaaccacccccccctatatttatttgaaaaagctaatactctctctttcccaatttaatcatcatataatggaatccaaaatttttcaagttgatcatcatataactgcatggacacgaattttatcagaatacaattaatacatcatgggagaatgtagggagtagaaaggtaacagtattttttaaaaacatagtacagtcgtgcaaacgctcatataaacacacaaactaaatacttcctcattcctaaattgatcatcatatatgtttatgcacgaggaccaagtataatttaaatcacattaatcaaaacaccatgcacacattctcccataatgtatgtatcgattaaaacaccatgtcaattacatcttagcatgtacacattctttcatgctgtattaattgtattttgataaaatctgtgtccatgcggttatatgatgatcgatttaagaaattttaaattccattatatgatggataaacatgggaaggagtgagtacatcattgcttttattatctggttctaattttatcttccatgcatgtattaggattcaaacattaattaattgggcatgtagacaataaattgatcaaaatttttaattaacgtgggagcttgtgcactactagttgatgatatatctataagattactattttttggtgtacgtgatcatcttccatttggccaccatttctcttctcactcgtttggaaaagagtttggacagtatttggaccacaactatttccgaagtaaatcttctaccagaaaaaatagacgaacacacattttctgataaaccttagccagtcgaattatttgggtgatgcacaagcagttgaaatgatgaaccgagcgactgacaggatgaggtcaacagtcaacatgctataaattgttatgccaaaccgaacaaaactatccgtgtgcgtgtttttttggacgccatacaaccctgctatacacatgcacatggcgatttaaggcgtacacaggaataagtccacttattccctttttttttcaactcattttcctctttttttcatatgcacgcttttcaaactactaaacgatacgttcttttcaaaagttttctacaggaaggttttttttaaaaaaatcatattaatttattttttaaaatttttaaattaatacttaattagttatacactaatgattgtttcgttatacctgccggagaggaggggttcccaacccctcctcccgaacacagccggggatctgtcctcttaacattgagttcgaattacattctcaaattggacatggctccttgcatcgcatcgggcttggccgcccttctccccacacacccgctggacgtcggctgccaaccttatccacgctgcttgcgacctgcttcctggttggggattgggaagagaggagagagcgggagagaggaggaaagagttagttactaacacacgggctagcatgggtcccacgctaactcagcacaactgaccagagtcaaagcgccacatcggacgaaatcaggagccatactatattagaacgaaagttaacacggttttacgagttcggggacaggctatacttgatattgcggttcagcaacgaattttcaaacttgccatcaaagatgcgggacgcaaagtgaacttattccagcgtacacaagcggactacaatccactttccagaccagtagcccattaactaggcgtagttgggccacatcacggggacactaaaaggtgcagcccatttcagctctccaggcggacttcttaagttcatctaaggtcccttaacttatcaacgaatccgattttcgtctttcaaccgcaaaaccagatacaacgggtcccttaactatcaaaaccggtgcatattaggtccctcggcggtttcgatggcggttttggctgacgtggcgcctgcgtggctaattttgactcggtctcgatctgacgtggtatgacgtggcgcttacgtggcaatctgacccgggaaaataataaaccccatgggacccacatgtcagtttcacacacaaaaaaaaataataataatggtggaacccacgctgccccacatgtcagtctactcacccctcctcttctgcttcctctctctcattctctcctctcttcatctctctcttgcactaggggatgcggccggcgacgacgacggcggcggaaatggagaagagtgattgccagaggcataggtgtgacgtcgccgggggcgctttgaggcggaagtagactcttacgacgtggccgttggaggtgagcgaggtcgtcatggactcacgggattggcggtgtcgtcggcagcggcggagcaggagttgtagttggagtcctcgtcgtcgacctcgagttcatcaatgtgctcgagcatcacccaccattagtagtcgccgacggcggaaggtagcgttgccatctcctgttgggtttccatgggccgcggcgagcggatcgatatgggttcctcgtcagtccggccggaacggtgttttcttgcccaaaacaatgatcatttattcattcatcaaccccgtcataacacaagcaaatgatgatgacgaagcaaaatatactccagtcagctagtactagtcgctatttcttctacctttgtatgattaggcatataaacgcggagcggaggtcgtcggctctggtgccccagccgaggccgtggacgaagagcttcctgctcacgggatcggcctccgccgcgcgccgcacggtcgtcatcatcactagggtcgtcttcgcagccggccgcctctcccctctcccgccggcgaggtggccccctcacccgcccacgtggacagccacctccgaggatgcgcgcgtgtgtcggccggtcggcgggacacgttcatcccgccgccgaggatgccgaggtcgacgtcgacgtcgtccgcagccacggccgcggcggcgctgcctccgccaccgggctggttcccttctatccgctagtttccctcccactagccgccgcgccgcgccccttctcccagccggacaccgtcctctccccgccgcccgtgaaccggagagaagagagagaggagaggggagagagatgaagacagagaagatggggaagaggagaatcagaatgacccagcgcaagagagagacgaagagaggggaggaggagagagaggaagcagaagaggaggggttaattagactgacatgtggggtccgcgtgggtcccaccattattattattattgtgtgtgaaactgacatgtgggtcccacggggtttattattttccggatcgaattgccacgtaagcgccacatcagtgccacgtcagatcaagaccgagtcaaaattagccacgtaggcgccacgtcagccaaaaccactatcgaaaccgccgagggacataatatgcaccggttttgatagttgagggaccaattgtatctggttttgtggttgaaggataaaaatcggattcgttgacaagttaagggaacttagatgaacttattccccagaagaaaccatcgcagaggccagatcgccagagcagagaagagcagagaggggccaatacattcgaaactagcacttcacttggttaacacgacagttgaaatctgtagctgctaggattacgacgaaagagaggtccgtaatcctcatgcctttgcatggcaactcgttacatgacatcacacatgcatacacctacactctctagtctgttccgtgcacttgctgatgaaaccattgaaccatgaaagtgatgagatggccacagctagctgcacgctattggcagcaatgtcggggcctagctttattccctgagaccatcacgtactcgtcatcaccggctagttaaccttggagcagttgagcctgatctgcccctgggttccagtcaagggcgagatgttccccatcttcaccatggccgccgtgaaggcgctgttgaacgccgccgtgttggaggagaagttcctgaccgtgttgtccgtgctgccgccgttgaagagcacctggtcggagtgcaggaggcccttgttggacagcaggttggtgtagtaggcgctgtcgaaggcgttgggcgtcgtcgtgtccagcggcgccaggttgctgtcgccgctgcccgtcggccgtgggcagttggccttgagcgccgtcgcgaagctggagtcgatgtttgtctcgttgtagagcctgtccctgaagttctggcactgcgcctgcccgatcgtgtgtgcgcctgcaagttctcatcgtattatgattcttatcagaaaatttgtaagagaatcaatcactgatataatctgtgtacatatatatgtacctgagagagcaaccatgtcggttacgtcgagtccctttctggagaaattgccgataagttcagcgaggctagaggaaggggcagggaggtcggtatttgcttggctttcgttcgcagtggtggagtcccttcttcccaatagaaccgtccacgacggccctccgagctgcaaatataaggattccaaaccaaaccaagagcgattaggagtacgtactactacagtctacaagaaatatatgcatcatgtagtaatctcatccgtgatcttaccgcgacgacggagtcacgggcggcgacggcgaggatgtcggcgcaggagacggtctggctgcagatggcctcgacctgcgtcttgatgttgtcgacgacgttgaatccccgaagtgacccagcgttcgggcctgcattctgctcctggccggacagcagaacagacgcgtcacagccctgcatcatcagtgaagtccatagatacatcctctgttattaatttccttgtctcaaagtacagtctaaggagaactacttgtacagctgattagattaggtgatcaaaacttgcttggacgaagcagtcgtggaagtgcagcctgaccagcgaggctcccattcggggctcgctgttcacggcggccgtcactgcgctcttgatggtggacaatgcgtttgggcacgacgtgtcgtagaacgtcgccgacagctgcgccgaggcggctgaggccatagctgcagccacgagcagcattaagctgacagaagaagccgaagccatgcagagtgagcgatatgatgcgccgtgcgcgtatgcttaatcctacctaaataactgcagttttttttaagctttttcgctggccgtggcttgcaagagaggctggtgccacgctgcatcttatatagctagcttagctacaggcttgacgccatcgattggtgccgagatgagacgaaatatgcaggtacattaatcatacgaggggagctgggcaggggaatgtattttaatctcaataggaatatcctattgctttgtacatatctctactaccttaaaatcgaactcgtcattttttcatccctcctcccaccacgcacagagtactatctctaattttctaatagcatatttctacttatatgagcctggcacattacaacagaaggatatgtttctagtcatctaaatagttatgtttttactaacaaattgcaagttgaattttaacttctataaattacaacacaaaaacaaatatgagtgtgaatgtgtgcatactaactagctagaatttaatttgttcaacttcaatatatcgaatttgaatctgtattttttaaagtgacatcatatataatttattagttaactttattagtgctactagactactagtacttacatgtgtgtccaacataagtttctacgtacggcctacggccaacatcatcacctctgcattattcatgcaatgtagggtcagttcggtccatttcgcttgaccttaatctgttaaccattaatcacgcgttgcttaagccaaaaaaaaagagcacccgtgccatagaatagcacatgaacatacaaatgccgtcgataatttgtccctttgttaaagattggtatgtatgcactatcgtcgtacagagtttatgaaaataactttaccttattaatactctgctaattgatctcgggtataatagtgcgagaactattcagctcgtgacgagctagaatggtctatcgcaattcatcttcttatgtacgttcggactaattgtctaatttaagtgcaaacggtgtgttacaagacaatatatgctgttatagcattacataccgttgtgccatcattttcgatcaatctccagggaaaaaataatagatctgcgagagctttcgcatcagcgttgccatgattaaaccatgcatgttggtgatatgattttccattcgaacgtaattagctatcacaagttgggccgacatttctagctctagctagaatggtggttgttgcatgtgccgtatgttactcttgtttcttaagccataaaatgcggatagtaaaataattaaattatcgtatagttcctttgaaaaaaaattatggttaaccgagtttcacggctaatattatacagttgctgagtgtttcacaaattattcctttttgaatgaaataaaatactctcttgatttgcaacttagattaaaataaacacaatagcacaaataatattatcgtgtacagtggtccacctagtaggttggtggcctgttcactttgtttacaaatttactacctcaattctaaaaaagaaaaatacaattgtaatatttaaaagacaaactagtatagtataggaaaaatactcgaccactcatcaaatgagggacagttgggaatggtggagtagctaggttagtaatatatgggtgaatgagtggtggttggacgaaaaagcaatactatagagtacgttatatgttggaataaatttaaaatctaaaattgtattctttttgaggaggagggaatataactttagtttttcctaatttttccattactaaattttgctaaggtaaattactgaattttgcctaattgattatggcatgtttgatttgttgcttatcaaaatttatagtcgataaagttataaataacaacaaaagtgtacgttagtttccctccggcctagccgcctacaggtgacacgaactaaatgaaaggccggcctgctcagcgcccacgggccaccatccctggtctgacagacactgcgagcgaaatgtggcgtcacacggtccaaaggcccaataggtaggtctcggaccattcgggcgtaaaacggcccaagcggaagggcggcgcttgcttgcgtcggtgggagtttgggacggtgcggccgcgcgggatggcaatggcacgtaagacggtaggagtacaccgtttgataattgatactcaaagagtcaaagttcaccgtgtcaaccaacatcaatagcgaaacagagctcgatgtgcaggggtggaaaaaaaatcgaacttacgagctagctcaacttgtgtaaaactcggctcggctcgacttaactcgagtagttaatgagtttgaacttttactcgtttacttaacgagccaactcgagctagctcgtgagttactcgattagctcgttgagctcatgatacactaagatagaagttaattgttcatattttacaggtgtaaaagtcatatactcataattatacattgtagtacaatcttatgagccatgatacatagcacgccaatcataatttttgtcatagaatcacaaattatattgcatatgaatttcaaaccatgttttttggtgtaacacgtttaatgagtcaactcggactttttaatgagtcgagtcgagttccatttttaactcgttatgttaacgagtcgagccaagctagctcattaacttaatgagtttttacgagtcgagccgagtcggcttgttagccacccctatcaatgtgtgtgccaaacacgacatttatgccaaagcggggattgcgctccctaattctccttgtcgtctagaagatacggaaggagaggaaccaacaaaatttctaacaaggagaccacgacaataaccctcctagcaaaaatagaggaagaagacttggactatggcaggaacaaaatgacttagagagttattacctatcagtatataatttgtaaagacgggctttttcttcttctttttttcgctcctaggggcaggttgtatttattttttctctatctaatgaaaaaacataatctagtgttgtttacttgaaaaaacggagcttgatgtaccgtaaaagtctggagaagttgtgaacggacatgtgtgtgaaggtaacagttcattaatcctccatgcatgccttcgcatgaggagcttttattttggtatactaggtgctaatgccatggctgctctgctccatacacttgatggattgctagagcgagctggctgccatatactttacgtgtactagtacaacaccaccgtacctatacttgtggttatactacatatatgggtatatgtggtgtggcccgtttatgtcgtcgtcgacacgatttgcttccagcaacgaacgcatcccgtcatactactccttaattaggagttcaccttggagcagctgagcctgatctgcccctgcgtcccggtcagcggcgagatgttccccatcttcaccatggccgtcgtgaaggcgctgctgaacgccgccgcgttggacgcgaagttcctgaccgtgttgtccgcgctgccgccgttgaagagcacctggtcggagtgcaggacgccccttgttggacagcaggttgctgtagtaggcgttg

SEQ ID NO: 9857 - DNA, 22673 bp, Oryza sativa
ttgtagatcctgtccctgaaattctggcactgcgcctgcccgatcgtgtgtgctcctgcgaaataattaatcgcgctctcatcttatcagaaaatctgcaacacatatatacatggtatcctaatctatctatatatatactcgtatataatactccatatcggattacctgagagagcaaccatgtcggttgcgtcgagtccctttctggagaaattgccgataagttctgcgaggctagaggaaggggcagggaggtcggtatttgccaaggcctcgcttgcagtggtggagtcccttctccccaacagaaccgtccatgatggccctcccagctgcgaaccaagagggagctagctctatcagtgaaagaacaacagaaagaaagtcacgggcgatcgaagggctgtgacattcttaccgcgacgacggagtcacgggcggcgacggcgaggatgtcggcgcaggagacggtctggttgcagatggcctccacccgcgccttggcgttgtcgatgacgctgaatcccctcagcgaccccacgttcgggccagcattctgctcctgcccggacagcagaactgacgcgtcgcacccctgcagtgattttagatatatgttctctgttattttctcgtccgaaatatactataatttcatgaaaattagtacaattggttgtgtgaaacttgcttggacgaagcagtcgtggaagtgcagcctgagcagcgacgcccccatgcgagcctcgctgttcacggcggctgttatgacgctcttgatggtggacaacgcattggggcacgacgtgtcatagaacgtcgccgagagctgcgccgatgccactgacgccatagctgcagccaccagcagcattaagctaagtgaagaattagttgcagaagccatggctagcaagctactactgattagctgcctgcaggctaattgcactttctgcttggccgttgtggcttgcaagagattgctgcattgcatgcatatttatagccagagattttgtacgctgccacgagcatgccactcttgtagggatataaacatccaaactttgtgaccaccaagtccaacttgtccacattggcatacaagcgtacgtacaagacgttcaacctgaacaatagaagtttcgtcatctgcatacatgcccccatccggcagttgtgatagcgtcagacttaaattgctacatccaacaccaactctgtatatcactcattcagtgtagggcctgttcgatacatctctctccggacgtatacaatatttgcagcatgaatatgatatatgtatgattcggaatggttgctgattaattagcccattgtgctgttgttggtcaagataaacaggcggcatgcgtcggacggcagatttttcttcctggtgcgccatggcatgataagctggaatacattatacatgcatcccgcaaattatggctcaatccccttggcaagttgcctttctaggctcatcagaagacgcacacgcacacatagcactatataatacatacaatcagtactgtgaaagacgaaatatgattgttagtcagaattatacggaaatttggcgttcatgaatatatatgtgcacatcttacaatattatggccttcttttgagatttaaatgtatacaacaacaaaatcagaatatattagtgttgtttttcaattgaaagccataacttgacattaacttaaaatataacttccaacacttgcagttatacacaaatagtgacaaggtttatattggataagtagaacataaaaaattgcaacaaaacataaacaaagtcccacaagatttttttaaaaaaatcatcgtcgagtgtaatatgcggatgattaaaaaaagttgattaatcgctaaatatggtgatattgaagacaagaaattttatagtttttgagaggtaccaaattttttaatattcgagacgagaaattttcgtccctaatagatatcaagaaatatcaaattttagtgtaaatttggtatctcatgatactgaagactgaaggcacagagacgtgctaaattttccttgatacactaaattgctaatctaggtatgtttggtgatacattttggttacttatagtatactacatattatatcatggatgagctagaacagacaaattaaataagctctggatcggaaagagccatgctagtaggcgagtatgattaattatggagtaattaatagagtaatatataacagcagctatataatggcacgtcattttcgtgtagctagctggacatcaacatgtaggtccatcatgatcatgactgattacgtacaaaaggtccgcatttgtccaaatacaattctatcttgctctgaccgttatgcaaccattttgctctcccagtccaaggaaaatgaccaccagttgttgcctcaactgtctaggctttattctggatcatctctagtttgacctatatgcttaggcacaacggctctggtttatggataaatatacggtgaaaatcacaacggtaaaaactatgtaagtaacatcataaaaattatcaagaaaatctaaaaaaaattgacacatatagataagatgatatttgagaattatactcctttttaatagatgacgccgttaacttttgaacacatatttgaccattcgtattattcaaaaattttatgcaaatgtataatatataaatcatgcttaaagtaatttgagtgataaaacaactcacaacaaaataaattataataacataatttttttaaaataaaggcgaatgctcaaacgtgtgataaaaagccaccggcgttatctattaaaaaacggaggttttgtacaatattgcaagaccaaactcgactttatttatgagttgtatgaatgaaaagtagtgaagaacaagacaaaaaaataggaattatgttttttcatagacatttgataattttatatctcatgaacgaagttgaatttggtcgtgcaattttatatggttctttaatatcatcttatctagatatgtgattttcttaaagacttttatacgatagttttcatcaaataggtggttttcactgtatattttcctaggatggtgcagtgtaatatgtatacaccttgtacattgaaaattgtgctatttctatcatgtgtcttcatttgtgactattagtattttgataggcgttaaacctttttttaattattttttggccaggatggccgaagaaagggccatccgaatgtcattaagattgagggcatcaaactaaaatgcccctagcagccaaacatattgaagcaagggacagttagagattatcattcatgcattccttgataacttcaaaaccatactgatcggtacataacatgggcttcctgatctgtttcaaacactttgtgctgatcagagaaaacactcttagcaaacatttcagactagtaaaatactactactgtgacatatatggcccagccttattcccaaatttgtgtttgcttttgtatccagtttgattctttacttaattattagttcactttggagcagctaagcctgatctgtccctggctcccggtgagtggtccgaggttggccatcttcaccatggccgacgagaaggcgctgctgaacgccgccctgttggaggcgaagttcctgaccgtgttgtccgtgctgttgccgttgaagagcacctggtcggagtgcaggagccccttgttggacagcaggttgctgtagtaggcgttgtcgaaggagtagggcgtcgtcgtgtccagcgccgccaggttgctgtcgccggtgccggccgtcggcgggcagttggccctgagcgacgccgcgtagccggcgtcgatgttggtctcgttgtagatccttcccctgaagttggtgcactgcgcctgcccgatcgtgtgcgcacctgcatcatccatcatgtcatatcgcgatgtagagtgagctatgacttcagaaaattcagaaaccgatcgattgatcagtttacctgagagagcaaccatgtcggtgacactgaaacccttgtcgccgaacgccttgatgaggttctcgaggtcgaagaaaggaggaggcaggtcgttgttagcgctgtccatgctcgccgtggttgagtccctcctcccgagaccaaccgtccatgacggccctcccagctgcaaccacaagaagaaattaattaattccttaattaatcgtcgtgagtttcatgtcgcacaagcggccggtgcggcggcgaggatgatgatctagcttactgcgacgacggagtcgcgggcggcgacggcgaggatgtcggcgcaggagacggtctggctgcagatgccctcgagctgcgtcttgatgctgtcgacgacgttgaagcctctgagagaattcttgttaggaagagcattctgctcgccggtgaacgtggccgtgtccgccagcagtacggacgcatcgcacccctgataaattgacagttactactactttgtcagtcctagttgcaaaataaaataataataataataataataataataataataataataataataataataataataataataataataataataataataataataataataataataattgttacgagtactaatagtcaattgttatcaactcctactctctctttttacttgagtcaaactagagatggtcaaagctaagcttggaaatggaatctcgtatcagtgtcagtgacgagtccaaagctagccttttgacgttagtaattctgtcagtccaactgaattgacagtgtcacataacttagctaattctgaacacagtgcaatcagacgcaaaacgaaaactgaacatagatttattaattactgcagctaaagttagccatgagatcgatgagatcagggacttgcttggacaaagcagtcatggaagtgcagcctgagcagtgacgcccccatgcgaggctcgttgttcacggcggccgtcacggcgctcttgatggtggccagcgccctggggcacgacgtgtcgtagaacgtcggcgacagctgcgccgccgcggcggcggcgaggcacaggagcacggccactgaaagagaagaagccatggcgatcgatcgatcgatcaagcagcagtagactaccagagcaccactactactactcttgcagatgcaatgcgatgcgatgcaatgcaatgcctgcgtcgcatgcagatatatatagccctccatatcgtaatgtcgtttttggccacatggccatttcgtgctattttgatagcagatatagaatcgtagaattctgcattctgtggagtgttgtgcatggagtcaaatgaacatctgaaaaatatatacgatatatctatgattgcttcttcaacttgcatgacagataatttgtctgtaatgcacgatagacggattagcatatatatatatatatatatataagctatagtattttgcagtattcgatatgtcggctgcctttcgtgtgtgcctcaagtcttgaccgtgaagcaaatgtgcatgtcaatatgtatagtgttttttttctgttatgagcatggctcatataattgatattccctccgtcctaaaatataacaacttttagttctcagaatttgttctaaaatataacaacttatctaccaatgttctcttcccaacccatcaaaaccctctactattcacttctacctactttcttaataaccgtatccaactctaaaacttattatattctggaacgttgggagtactagattgcaattttccgaggttccttgctagatatcagcctcaaatctaggcaaaactcacatcaggcaattacatgacacggaatgcaaattgaaaatttgaaattggcaaatgcccatgctgctagatttccagtttggagcattcgatctaattaattctctaatatatttttttacagctgtacgtgttccagtcaacaataactatgggttttaattgattgattttggacatcgactgtgatttttgcagatgggagcatcaaagaaggtcatgcaaatcttcaactggttctttgcatcatctggaaggataaggattaagtcactctaagtcgaagttatttcgagtcaactaggcgagctaggacatacacatgcctggggagcttaataactgcagatataattaatgacaggcgctgtgcagtgtcaggccaagccttggaaggactcaggctccaagagggagggctgacgataagtctgaagaatctgaagaactgaagatggacggcaaggcagatgacgcgctacagggcgacagggaggaggcgcctatcctgggctgggggcgtcgtcataagaagcccagtgtgcgtgttgtcgggccagagtgggtcaagtaactaagtccatcctgcgcgatggcgtgcgtgagttgtgctgttccgacagctgtcatgaggtgttgagactgatataaacaggagaacgaacagaggagagggtatgaactgagatcacttggaggcgatggcggcggaggcctgatcctgttggattaggataatacaatcgtgatctcgaatatctgagtccttagctagtttgctcttgttagtaaccctaacaaaattggtatcagagccaaactcgcccctctaatctcttgattcggctgtgaaattccgggggaaggattggggctgttcttcggatcagaccccgcgaaaaggcaacttgccttcctcaggttagctgaattcggagcgtgggtgagttggtgtgtgagatcgagacgagagtggaggtatggcgcaggatagtaagttggatttgctgttgaagtcaatggcggaaaacgagaagaaacgggaagaggctgaggcccgcatgcgagctgatttcgcagaacttaagaagtctctggagatcaggttgcccgcggtggagaagaaggtggatgacctcgggatcgatctggtggcgctgagtaacaaggtggagcaattggagcacaaccccaatcagcctccttcaggagatgaattcgccggcaaggtgacgaccgtggcgttacccaagaaggagccgatctacaaggcgacaccaccgaccaaaggtacgcgtgagcttgaccccacttctcctgttcatcattcaaatgagggttggggatctcagtttgaaaacacggggttcagtgccaggatgattggtaatgtaccgcccatgtcctgtccgcaattcaacggagataaccctcacatgtggaaatccaactgtgaagtgtattttgatgtgtatgggattcatcctcaaaattgggtcaaggtagccactctgaatttttgtgggaacacagcgttctggcttcagtcagtgagggctcagttgatgggggtcacttggtttgaattatgtgacagagtttgtgctagattctctcgggacagacagcaagctcttattagacagtggattcatgtttctcagacttcttctgtggctgattatgtggataggttcgatagtatcatgcatcaattgttggcttatgggggggcaaatgaacctatctattttgtgaccaaatttgtggatggactcaaggacaatatcagggttggtgtgatggggcacaggccacaggacctggacactgcatgtactttagctcttttgcagaaagaagctttggaaggtgtccaggctatcaatgtcaagaaaaatgactctggaacctttgttaaatctaaatccacctcaaatttttctcagtctgtccttcctagcaagagtacagccttgataaatactgaagagaaaaggagtgcagagtttagcaggcccaaggatgataagatatcggccctcagagcttacagaagatcaaaggggctctgttttgtttgtggtgagagatggagtaaggatcacaaatgtgctacatcagtccaactccatattgttgaggagttgattcatgccctgcaatctggaggtgaagaaaatagctgttctgatggaactcctgaaattgatgacgattctttgatggcaatatcatttcatgctttgcatggtaccgattctcctaagtcaattagactcagaggctgggtccagggtacagagttactcatgctggtggattcgggtagtactcattcttttattgacactaagattggctccaaattgcatggtgtccagaaattacttcagaccattaaggtacaagtggctgatggagggcagatagcttgtgatatgtttttgcctaagtgcaactggtggacacagggtcataattttaccagtgatttcaggttattgccactgggtaattatgatgtgatattgggaatggattggctggagcagtttagccctatgcaaattgattggattcataagtggcttgaattccaacatcaacatcagctggtgaaacttcagggcattgttcctcagactgattgctgtccaaccataacaggagcacagttacagggtatgtccaagaatggatctatcatgtgtatggttcagctgaatgctgtggaagttcctgaacatgctgtcatccccactattgtacaacccttacttcaagaatttcaggaactattctctgaacctactgaattacctcctaagagaacatgtgaccaccatattcccctcattgaaggagccaaacctgtcaatttgagaccctaccggtataagccagctctgaaagatgaaatcgaaaaacaagtcactgaaatgcttaagactggagtcattcaacccagccacagtcctttctcttctcctgcccttcttgtcaagaaaaaagatggatcctggcgtctctgtattgattatcgacagttgaacaatatcactgtcaagagcaagtatcctgtcccagtaatagaagagctgttagatgaattatcaggggcccagtggttttccaagttagatttaagagctggataccatcagatcagaatggctgagggagatgagtataaaacagccttccaaactcattctgggcattatgagtacaaggtgatgtcctttggccttactggggccccagctactttccttaatgccatgaatgacacattgtcccctgtcctaaggaaatttgtcttggtcttttttgatgacattttgatttatagtcccacattggaatcacatctgctccacatcagaacagttttacaattactctctgctagtcagtggaaggtcaaactaagtaagtgttcctttgctcaacaagagatatcttatttaggacacgtgataggagttcaaagagtatctactgacccacgaaagattcaagatgtagttaattggacccaaccaactactatcaagaagttgaggggctttctgggcttagcaggttattatagaaaatttgttaagaatttcggtgtgatcagccgacccctgactcaattactcaaaaagggaataccattcaagtggactgaggaaactgaaactgcttttcaacaacttaaacaagcattatgctctgctcctgtactcgcattgccagatttttctaaatcattcactgtagaaactgatgccagtgaacttgggattggagctgttctttctcaagacaagcatcccattgctttccttagcagagctcttggtcctaaaactaaacgcttgtccacctatgaaaaggaatacatggctatattgctggctgtagaacattggagaccatacctgcagcatggggaatttactatcctcactgatcatcatagtttgatgcatttaactgatcaacggttgcatactccttggcaacagaaggctttcactaagctcttgggtcttcagtataagatctgctatcgaaagggttcttctaatgctgctgccgatgctctttcaagaagggagccatttaccagtgagatacacgctgtgtctgaatgtgtaccgctatggatgcaagacctgattcaaggttatgatcaggatcctcacaccaagcagatcatttcggagctaattgtcaatggtagcagcagaccccactatcaattgtgcaatggagtattgaagtacaagggcagaatttgggtgggagacaatcctgcattgcagcacaggatcatcactgaggttcactctactcctttcggtgatcactcaggttttcctgtaacctatagaaaagctaaaggcatgtttgcttggactggaatgaagaaaatgattaagactcatctgcagtcctgtcaagtttgcttgcaagccaagccagacagggctaaatatcctggactactgcagccgttgccagttccagctggagcatggcaagtgatttcgcttgattttatagaagggttgccacgttcatctcattataattgtgtgttggtggtaattgataagttctccaaatacagtcactttattcccctttcccaccctttcacagcaagtgcagtagctcaagagttcatgaaacacatctacaagctccatggcctacctcatgtgattatttctgatagagataagattttcacgagtcaattttgggagcagctcttctctaagtctggaactaaactgcataaaagttcagcttatcatcctcaaacggatgggcaaaccgaacgagttaatcagtgtctggaaatttatcttcgttgctttgtgcatgctactccaaggaagtgggcatcttggtagtatcttgctgaattctggtataacaactcctttcactctactttgggcaaaactccttttgaagtcttatatgggtacactccagctcactttggcattactatagaggattgtcagatcactgatttgcaggaatggcataatgagcggaagctgatgcaacagttattacagcagcatcttcatcgagctcaacaacagatgaaacatcaagctgataagaaatgcagtttcaggcagtttaaagtaggggattgggtgtacttaaaactacagccttatgtacagacgtcggtagctcaacgtgcttgtcacaaattggctttccgctactttggcccatttcagattcttgacagggtgggatctgttgcttatcgcttacagctaccagctggcagttccattcatccagtgtttcatgtgtcccaattacgagctgctgtggggttttctaaaccagtgcaagaggaattaccatcttccttgggagcatttcagattcccctccaattcttggataaacgtctgactaaaaaaggtaatcgcgttgtggttcaattactgacgcattggtcagattcatctgcagaggattccacttgggaggatatggaggatttatgcaatcgctttccgcgagcattggcttggggacaagccaattttcaagaatgggggattgtcaggccaagccttggaaggactcaggctccaggagggagggctgacgacaagtctgaagaatctgaagaactgaagatggacggcaaggcagatgacgcgctacagggcgacagggaggaggcacctatcctgggccgggggcgtcgtcataagaagcccagtgtgcgtgttgtcgggccagagtgggccaagtaactaagtccatcctgcgcgatggcgtgcgtgagttgtgctgttccgacagctgtcatgaggtgttgagactgatataaacagaagaacgaacagaggagagggtatgaactgagatcacttggaggcgatggcggcggaggcctgatcctgttggattaggataatacaatcgtgatctcgaatatcttagtccttagctagtttgctcttgttagtaaccctaacatgcagaaagtgtgtttgtaggtttgaaattgaattatactgaatgatgtagtagtagtagttaaaaatcgatttcaaaatttgaatgacgatggcgacatgaacacaagtggacgacttggtacgctgcacacaatgagcgcggagagggatggacgacagtgcatactgcatgtgtacatttcatttttattccaagttgttcttttgcaagctagctacggcaaacagtgcaataagagttcaaaaaatgtttcgatcggtcggcgcaaaatgtttggatggttccttcaaaatttctgtataaatccacgaagcaaattaacgtacactcctgtgagtgtgaataagcatagcgcagagatcaacaattgtggctgtttgaccaataatctgcggcgtgcttcaggtacacactgcgtatttttcagagatacacagcatgtgtacgtacgtatttgtggtttataacttcatatagaagaaaaatcaatccagcttgacaatattatgtttgttgcaccttttgtgggacgatcagatagtctgcaaacgtgtgaccggtgcatttattttcatgtcaccaaaaagatcataaaaaatatattttttatacagatgacatatcactccacaagcatatatgtttgaatttaaatttattattttctcttatttatatatatattgaatttaaacttacatatttataaagtgttacagagttggtcgattcccaacgtccgcctgcgcacttccattttttctctactgttgcacgaatcttggaggtaacccaaaggctagaaaatcgattagttttgttaagagccaatttttttctctcctatccccgctgcacgaatcttggaggtaatccaaaggctagaaaattgataatatttataaaaaaactgtcgccaaatttttagcacttctttttttataataacgttttaagcaatatgtacaatatatggggagctcagtgaaatattccaaccatgcagcgttttgcaaagaagtaaccgagcacaaggacatatttaggcaagggagttaatctcgcgggcatttgcatgagggctcttcagaattcagtgtacacgatcaaattcttgcaaacacgccactttctcggacacaatttgatccaagaaagcgtgaacatgatcactgatcagtgcaaagcacaaatatcgatttcagtggcatatatagccttattattgtcccctcatgcactcagaattttcgttgatgatcaccgctaattaattcaccttggagcagacgagcctgatttgtccctgcgttcccgtcaacggggcgatgttccccatcttcaccatggccgccgcgaagtcccttctgaacctcgacggcccggacgcgtacgaccggacctggccgtcgacggcgccgccgttgaagagcacctggtcggagtgcaggagccccttgttcgacagcaggttggtgtagtaggcgttgtcgaacgcggtgggcgtcgtcgtgtccagcggcgccaggttgccgtcgccgctgcccgtcggccgcgggcagctggccttgagcgccgccgcgaaggcggcgtcgatgttggtctcgttgtagagcctgtcgcggaagttttggcactgcgcctgcccgaccgtgtgcgcgccggagagcgccaccatgtcggcttggctcagccccttggcggcgaacgaggcggtgaggttggcgacgtcgaaggacggaggtggcaggtcgctgttcgccagcgccaagctcgccgtcgtcgagtcacgcctcccgagaagaaccctccatgacggcccacccaactgcacacacacaagttcagttcgccgctcgccgtatagtacgtatagctgcgcgctcaaggatgggcatgatcttacggcgacgacggagtcgcgggcggcgacggcgaggatgtcggcgcaggagacggtctgcttgcacgcggcctcgacctgcgccttgatgttgtcgacgacgttgaatcctctgatggatccgacgttggggttcgccccctgctcgccggtgaagttggccgtgtcgttcagcagtacggacgcgtcgcacccctgatccatgtcacccacgatgcacaacacacaattagcacgttgagttaattttttcaggttaattcagagtagtagtaggaactagtatgacttgagagcaaattcggtggccatagtctctctaatccaacgtcaacacagtgctacgagtccattctgttctgacgcagcacattaaactggaagagagactgaaagagtgtaaagaactgaaactgcaaaggctgcgaccacaatgtaattgactgatggatataaaaatgtaagtcaagtagtgtggaaatgcacgacttgcttggacaaagcagtcatggaagtgaagcctgagcagtgacgcccccatgcgaggctcctgcgccaccgcagctctcacgccggccctgatgatggccagagctctcgggcacgacctcgaatagaatgtagccgacagttgttgcccggagactgaacctgcaagtgctagacacaagagcaacaggactgacagacaagaggccattgtcaatctacaatgcaaacaactctgtgtgtgtatgcaatggcctgaattgcatgtgttgcatatgtgcatttatatgtgagagctaaatgtgttgtcatttttgcgcccgtgacagtctgttggtagcatgtcagccatatgctgcatattttttagagatgtgatgtacttatgatgcgttttgttcatggttttagtatggttactatcacaatgcatggacatggaagccacacgacggcaaccctgctagctggtacgatatggttatgggagagaaatcacgatcatcgctaaaaggttgagaatattggttggtcatgtactcctgtctgataagcctgaatatagaacagagcatgcatgcttgcttgggtttggctttattaagtggacatggagaatgtaaagaagatgtttgctttccttgataatggcagttggcagttccttttgtttcaaagtgttcatcagtagatgtcgctaaagcctgcagacctacccagtttatgcgaagggcaacaatcttgcaagttgcaaatcacctcaccatcactaatagcatggagatggatttttcatccctctcgttttcgtatgtcttttatatagccatgaaaaaaatattcaatatgtgatgtatcacttcacaaatatacaagtttaaatttaacttacatatgttgtgaaaaaaaacaaaaatgatgctaaatatgcatactattacatatttgttataacttgtatatgccaaatttaaacttccatttgtgtgaaatgatatattaaaaatgctctatcttgtaaaaaaacttttcatattttttcatgattatttggatagcatgcaaaaaggaacgatatatcttcttaaggatgaaattacttcccttataacacgggttgagatcctctgccttaagtcaggtgattttatagtcattgatatgtgggtccatggcaaagaaggctcacatatcaatgactcaaagtcacgtgattttaagtcagatgatctcaatccttataacactggtaatgcttgtctgtagatcaatctgtcttaaaataatatgaaagatggtgcagatgaactgaatttcttctctaatggtcaagggagatggctacgcacatggctatatttgattcttggtgatagaattttccgcagttcctggctagatttgggcctcaaataagctggcaccaagctgaacttctgcacattcatgcatccacgtcagattgggtcaacttttgttcaattacctctggcatcagtcacaagaattaggcagaacagtaatacagtactgttatttttaagttgttaatatataaagtcagtttcttttttttaaaaaaaatctattttcggtaacactaacaaacacttaagtcaataagtaagcaggagcaaagaaaaattcagtttgccaactgaccaaacatgtgtagggggtactaatgacagccatgcaaaatctgtctgaagttcaaatttctgtagcaaatatcatcaagaaacaattcgagtgatagtgacgtgcaagtggaagatctcctaacatagtaaatcacaaggcgactaatctgcagagatgtaaaagccggtttctgtatcaccctctaattctcctcgctgcgttgtgtaacttgttactgctttcttctgattgattgacgtgtaattcttttacatgttcgtgaaaaaaataatctgcagggatgtatcaagtttcaacccttgggttgatagtcaagatttatttacaaatcgatgggttccatcgatcaagttgaatttagtactgaacttcagtagtatgtacaatataaaattattattgctgctctgtcatatgctatcttttaactgtcaaaggtagtcaatgtagggttagtgaccaatgtaagcactcaaaaagttcctaattaagttgctgcaaatcaatgccccactgacttttagttgaaaagcaaagcaaagatgcctcctatcatcacagctggcctgattatatttgccaattgtccgtttgcaactgtttcaaaaaaagaaattgtctgtttgcaatggcaagcagttcaaaatagccaatccgttcaacgaaaacgtctgtttcgcaccaaacatgcaacctgtcattctcaatcgccttcagaaacgccacgacgttcattcggttctgaaaatttcatacgagcagacaaaagccggacaaaaggccgaattacgatgacgcaaaaggtcaaaaactgtcaaagaagaatcgtacatggattgatcctctcggccgagtagctactccgacagtgacattgctgcatgcagcaacaaagagctcaatcacatactccagaatagaatggattttcttgggcaacttgccagattaactagcatacatgtaactatctcttatctctaggctggtaaggataaccctaactccagggaatcgataccagtcggcaatctttgcactctttaagcgccaatccacgaactcctcggttctttaatagctcggattaaacaactgaaacactccaaaatgcaagctctgtgcactgcattcttccccaactcttcagtctccaagcttaaagtctttcaggtcactctctgaagccccagtcgattgtctgtataccaccacaaatacgtacttcatctttctacgattccatctgtagtaggatctcgatgcacagatctcttgaatgcaactgatctcgcagcttgctaatgctatttgctagctactgaattggtggcccgtggtttcaacaaggactgctaattgctcgatcgccgtcttgccttgcctgcagatcacggcatcggttgggggcacgtcggtttcaagggagcatgccgccatgtcgttcaactagtgatgccaagggagctctttggatccacctgctagctagttcgagcgaggcatcttgtcctcgcgcttgttttatcaaatcaatcgattgggtcgttgagctcggtctctggcctgatgctaggcgcgcttgcctacctttcttgggagtttctgtgaggaagcttcggctgctctgtgcctctgttcatggcgggccggcggcggcatagtgaaattggaattgaatgatagatcggatgatttacaatggcaatcagtacttcaaatatttggactgaattgataagcaaggaatgaatgatacctcaaagttggtttatatcgaggcctggaagaacgttgctcacgacggcgaggttccgggcttctccggcggcggccatggcggcgaggaagctaggaggcgtgcagtgtgagggagtaaaagaagagtagagcccagaaggaagtacggcccagtctatcttggcccaactaaagcccatccttacttctcttgcagatctacggcccatacagtacggcgcagttttgacttttgaaaaagcccataatcctgaggagcaaatagatgggcctcctaataaaaagtcagcccagatatagcatgctcaacttgatggaagccctagccctagtccagtaccaagcccaagaacacgttttggtttttccatcgtctgattctcctggctcgccggcggcggcgtgccgctctgcagctcgcggggagtctgcgtgcgggacgtcagtcgtccactgatgttttttttttaaagagtaaattacatccacggtacatcaacttggtaggtgggtataatttggtgcaataacttaagaaatgagcgttctagtgcaacaacttgagaggtaggtgcaatttagtataagaactttataagtgatcgtataaatacgacaacttacaaggtaggtacgattttgatacaataaattaaaaatttatgcgacaacttaattatttggagcatatttttatataaatttaatttttaagtacttattttgacaatatactagtgcagatttgtataagtatatttatatttttatcctaataaataataactataagtcaattaaactggatgtagaaattattatatttcagttgatattttagaaagtgaagaaaacaaaaaaattcaatatatgttgtggtaattggatgtaaattgtactagaacgcacccatttgttaagttattgcactcggttgatcaattctcaagttcttgcactatattgcacccacatgtcaagttgttgtactgtgggtgtaatttactcttttttaaacaactcgcacgagacgatgcgaaattctattgatagagcaggacaaaaattacaagattataacctggagggtcgtaaccaggaaaaaggaaaaaaaaaacaccacccacacaccgacatcgccaacacacaaacccaggagaagtctagcaccggatcgaccgccgctaagcgtgaccgaccgccactagaccaacaaagggacacagacgagatcgccccctaggggatgccagaacgacgtcttcaagaagagaagcgacggaaaaaccgccgccgccgtccgtcgggactcaaaggagccaagactaggctttcacccggcaaacacccttgaggggtgagacagcacgacccgccgctcaccacaagcgaatccacgactaacgcactgatactccaccaccacacaagctctgccgacatgttagacccctgaaccggcgtctcccgtcagccagccttcgtgtgcagaagacgcgccacatccaccgacagctcctcctcacgccggcttccatctccgccgctcgcgcctctcgcgccgagccggcctccgctcccatcgggtgcgcctctctgcgtcaagccagtctccgaccccttcaccaaacgatgccacgccggtcagatgtcgccatctcccacgccctcggctagccgtccgagaccgtcacgcctctgatgaccgcagacacggtcaccaccaccacagccgctgttgccgaacacccagccacctcactgtcgccatcctcacctcataaccaactccatccccgccgccgacatcaccaccgcctccacaatcacggccgccgtcgtcgctgccaccgacaccgccgtcgcagaccgccgttgcgccgtcaccctccgccaccacgcagccagcacccgccccgacgccgccgacatgtcctcctccgccaacggcagccgacgatgccactgcccaccaactgccattgccggtcgatgccaacgccgcaatcactgccgcatgcgccagtcaccgctagagccgtgtctgccacagccgccgcgccgtccacgggcgtcgcgtcgctgacagccgccatcagcgttgtcgccatagccgccgtcggtgtcgctagccgccgtctgccaccgcaatcaccgccgccgctgttgccagccgccgtcgccgctgccaccagccgcatcgcaaccgccagcacccccagatctggaggacctcgctgccgacaccgacaggacgagcgccgacgcgcccgaaccgccatagccgttgccgctgcgccagctgccgcccgccaccgcagtccccgccgacgctgtcgccagctgccgtcggcatccaccgccgccgctgccaccggacgcgctgcaaccaccggcacccgcagatctggaggacctcgccgtcgacaccgtcagcacgagcgtcgacgcgtccaacaccagaggccgccgccgtcaccttcagcccccgccgccagctgcccctcccgtagatccggccgggcccggcgcggatctaggcaccacagccgccactcaaggcatccccccacccgccgagcgcgtggaggcgagatgaggccccaccgccgccgtcctagcttgtgggagcaaggctttgccggtgcccgctcaggcggcggtgaggcggggggaggagacgtgaggaggaggaggacggcggcggcgtcgcctcccgagtcgcccgggggagggcgacgcgagagcgtttaatcgatgggagcaagttttcagtgcaatgctggatccactgatctttttttgagaactcgtccactgatctgagattttgtgactgatctttcggtgttctgaattctgaattctaccaacccctatttgctgcagtttctgaattctgactggaagatttgacactagcagggaggttgctccaaggtaattccctaagaacatctgctttatgatactgtagtaaccgaaaatttatcttgatttaattctgattcaattccttgaaagtgaatttactgtctgggcattcgcgaaaaaaaaaattactgtctgtactagaaaaaaaatcaactattaacagtgacgaagacaagcctaacataattatggcttgagcgctaggctcgtccctttaatcccttgtaaatccttttaaaaattaatgaaaagtttgaagatttaacaaattgcattggttgtactttgtaatacctgattcccccactgatatgtatctcgaagctggcatagatacatagttagaagttatctttctaggacggaggtatacatagttaaaacagtgagtgtaagtgctgtttttttttctttcggcatcatggaacccgtcaagatcatgataattttaatagtatctagataacacaagtgtgatactatttgttgtcagcacaacttcactgcacgccattgctagatttagccaccgttgatgttctgtccattactaatcgaatgcgtgagtcactcactctacgtgtgattctctccgttcttgcattgcattggatgggacaatagcaatctaatcctgcagttgatatgtagcggcatatatagccagaaatccgtggattagtaccatgctggtcgcctcacgggcaacacctcacgccggagcactgccatgcatattctgccacaacttaacccggctgagctcgaaaagacgctgatctgagcccctggactcaagcggattctctctctgatcaatccagcggcgaaggcgctgtatgcagccttgagctttcagacatcagcagctagcagattgcagatcccggccctctcgtgatgcatataggcaaggtgcctactgcttcgaggaggtgatcgaattttggatgtgacaagcctgatccagagcaatgctgtaatcaagatggtataatccagactaagctcgtttcagaattcataagaaattaatctgcatgcagcatggaggaagaaacggctgtagctaccgctcccttagtttcaagttataagatattttaactttaattaaagttaaaccactttaagtttgaccaagtttgtagaaaaaaatagtaacatttttaacctaacacaaatttatttgaaaatatattcaattattgatttgatgaaactaatttagtattataaatattactatatttgtctaaaaacttaattaaatttgaaacagtttaattttgaccaaaatcaaaacgtcttataacctgaaacggagggattagatagctacctgccaggttcatcgaccactcgtgacatgcatggatgtgtccatggcgcatatatacagtatgtagcagcaagggcaggcatgagcacaagagcatgcatgcgttgagaggataagcagatggagccggcagtacgtatagccgtctcgccacatggatggacgtgatattctctgcttggcgagctcgccattcgagacattctcggcgctgtttgatcacttcatacgcgctccgggcctaaagagctccaagagatgctgcatgctgtcttgttcacaagagtttgtatcacgagagcatagtagagccctccagctcgtgctccctaaagaaatggcacgcatggcttgttcgcttcttcctggtttgcaattggtgttcttgttgcatatgctaactgctacccctcttgatttgtcccaaaagataagccagaataacgtgaatggccaattgtcctccagtccagttccttgtcctcgcctctcattggctcatttccatggttattggagccatgcatgcaagaattctttggttttgtttcttggtacacctgccagctcattggattcctgactatcctttacaccaccaattggtatatgtgggaataacatttgctaattaaggcatgctaaggttgtgttaactctttcattataataatatatactagt

SEQ ID NO: 9858 - DNA, 6411 bp, Oryza sativa
taaatttgcatcttgtgaatatatgtgcccccttaatttggtaatggcgaagacattaggaaaattataatgtggactaagggcgatacaactatatcggccattgtacatcagcaaaccacaaccgattacaacatggaaaaacaactaagggcgatataaccatatcggccatctcaaggcgatgtaaacacatcggctgtcatgcatcggcaacactagacgatcatgcattaacccaaacacttgggtaatatttcttcaagtacttgccattgagtgctcgtccataaacttctccatcaagcccttgcaacatatatgcccctttagacacaaccttatagatttggaacggtccctcccaattcggtgaccacttgccgaatttgttatcccgagttccaatcggcaaaatcaacttccatacaagttcaccttccgaaaaagtcttgggtaccactttcttattatagtaccgagcaacttgttctttatctttagttaccttagcaagagctcgcaaacgtgattgaaccaagtcctccctttcatcggccataaggttataatactcatcggctgtcaaaccatcttgcaactctactcgtcgtgagccaactctaacttcccatggcaaaatagcttcacgcccataaacaagcttataaggaggaacttggattgatccatgacaagccatccgataagaccacaagcttcggctaaacgagtatgccattgccgaggataatcagaaattttccttttaatcaacttgatcaagcttttgttagatgcctcggcctgcacgttagcttgtgcataatatggtgaagaattcaacaatttgatacccatactatcggcaaactaaacaaattcatcggacacgaagattgaaccttgatcggttgtaatagtttgaggaataccaaatctatagataatatgttcttgaacaaattgaatagcatccccagaatcaaccttcttcaaagggatcgcttctacccacttggtaaaataatcggttgccaccaatataaacttatgtcctttgctggacagtggattaatcatgccgatcatatcaattccccaacctctaaacggccatggtttaataataggattcatagccgatgtcggcgctctctggatcgctccaaatttctgacagtcttgacaacctttataatatctaaagcaatcctccaacatcgtcggccaaaaatatccagcatgtcgaagtaaccacttcattttatgcgccgattgatgagtgccacataccccttcatgaacctcaccgattgcaacttttgcctgatcggcactcaaacatttaagcaacactccatcgatcgtccgataataaagctcattgtccaacaatgtatacttcaacgctttatatcttaacttccgagaaggcgattgagatggatcctgtaaataccaatagacatcatatctccaatcatcagctgttacggtagcaacctcaatctgaacatctttgatcatcggcttatatcccgatgccccttaggctaaatcattagcttcaatattctgctctcgagatacatgcttcaaagttactagccgaaattccttcatcagttcttgtcacttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttagtggaattttcagagcacaaataataattattaagaaataaacaaagttaaaatggttttataaaaagaaaaaccctaaaaagtcttcttttcccccccttccccctcttgggccggctcggcccaactccctccctctctctcctctcccccgcggcccatcggccttcccccgcgcgcgcgccgctgacgggtgggcccgcccgccaccctcgctgacgggtggggcccacctgtcatcccctacctcgcgctgcgcccgccgcccgcccgtgccctagcgccgccgccgccgccgaatccgccgcatcccgccgttcccgcgcgccataaagagggggaaatcactccccgtgattccctccctctttcccccctcttttccctctctctctccctcggattcgttcggaaagtctcccgcaatcctcgccggcgccattgatggagtccgagatttccgcggccgattccttcctccccggccgccctctctccctcccaaccctatttaatcgctccccgtgcctctctcctccgtttccgccgctcgccgctctctctccccgtcggaatcaagcccgcgccgtcgtcctctctctccgccgtcgccgccgagctccggttcgccgccgtcgtcgccccggacctcctcccgcttcggcaccgcctccttcggcttcgccgcgtccttgccgacctcgtccgctcctccgtttcgcccgccgaccgtcggagcgccgccgtcctcgtcgctccgaaccgcgccgccgcctctcgccgcttcggtcgccgtttccgtcgccgccatcgacccggggtgagctgtggaccgctcctttcgcttcccccttccctcctctctctcgggcgccgctccgccgcgtcggtggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggccggcgtcagccgcgtgcacccggtccaccgtggaccgagaggctgtcgcgtgggccccactcccgtggacccggtccgcgcgccctctctctcggctgacgcaataaatccaattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattattaccttgttcaccctaggttaaacaaaaccccaactagtgagtactctattcatggttccactagtatgaatttaggtagatgcttcgctgattaaataggacaacattaggtggtttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatgtgtgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgctttctgcaaaacttaacccctatattattatcccctttacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggaaattttcccggtcgcgacatcacttctcattatagacccttaacgtgtcattcttgcactcatattctcctgccaattgactgatcaccaacaaataatcccccatgatttcgatagcatcggcctcaacttccttgagtaactgcaaccctttgagaactgcctcatacccagcttgattattagtcgcataaggtttaatagtataagcaaactcaaatcatgccccccgaggggaaattattactaagccgataccacaaccatgagtacaaactgactgtaacatcccggcctagggcttaataggattaatagaatactcatattaacaagttacaacttcttttccggaagccaatcatcaaagaactccgaggttaagcgtgattggtctggagcaatttcgggatgggtgactgaccggaaaattcttcccgggtgcacacgagtgaggacaaagtgtgcagaaaagacttgtgtaggtttgtgagggcagtctatgacctatgaaagctgccaggcgggcccggcctgggaaaggcgggacgttacaaaatggtatcagagccgactctcgcggtttcacgggcggtgtgtcgcagttgcgcaggcatggtgcgcatggctggtgtgggcccggagtggtcacatagcatggcacattgtgagggcagtctatgacctatgaaagctgccagatataagcgggcccggcctaggagaggcgggacgttacaaaatggtatcagagccgactcgcggtttcacgggcgcgtgtgtcgcagttgcgcaggcatggtgcgcatggctggtgtgggcccggagtggtcacacagcatggcacatgcgctggcactggacacacggacgtggctaagaggggacgttcctggcctagggttgattgacgggggcgtcgatctctcttaagggggtgagggtgtaacatcccggcctagggcttaataggattaatagaatactcatatgaataagttacaacttcttttccagaagccaatcttcaaagaactctaaggttaagcgtgcttggtctggagcaatttcgggatgggtgaccgaccgggaaattcttcctgggtgcacacgagtgaggacaaagtgtgcagaaaagacttgtgttggtttatgagggcagtctatgacctatgaaagttgccagatgtaagcgggcccggccgttacactgacccatcaaagaataaagtccatggcacaatctcaaccgagcctattgaatcatcacggtgatcaacaataaaatcagctatagcttgccctttaatcgccttcggtgaatcatcacggtgatcaacaataaaatcggctatagcttgccctttaatcgccttcagtgactcataccgaagatcaaactcagttaaggaaaatatccactttccaaccctttctttcaaaattggatcctatgaaagctgccaaatgtaagcgggcccggcctgggagaggcgagacgttacactaacccatcaaaaaataaagtccatggcacaatctcaaccgagccgattgaatcatcacgatgatcaacaataaaatcggctatagcttgcccttaatcgccttcggtgac

SEQ ID NO: 9859 - DNA, 2406 bp, Oryza sativa
aagcgcctttgtaataatgtaaatattatcgatataataaagatgtgtcttttatatcatgtttgtgtggtgtaccccggcttttcctgggacggggattaatacactagcgttcgggaaaaggaaattttcccggtcgcgacaagctggtatcagagccatctcgactgtaggataagccaagtggataaaacctaaggacatattttataaataaaactatttgcgaaagttcctctttttcttcttcccctaatgctatttgcaaaagggttactcttttcttccttcttcaaatttcaactagtaccagatggtcaggtcagtgaagaagaagacatcgtcagttgtctgccgaagctccggaaggctggaggatccgctagcgaagtggaggaagcagtgaagccagctgtgaaggagtgaagatcttggagaacccgtcgcagaacctaagccaccctctagggcagagtcgttagtcgtgtgtttccttgcttgtgtgtgtagcgcatggtttgcatcagtgggttgtgatgtaaccatgctaggttgtttgcttaatcaacttgcagaataagcccaacatacatcataacagcaaaaggcatagatctgttaaggtcctatccttagtttctaatctgtctctccccttttgttttccctctctccctctccaaacctttgcaacagatggctgacaatgagaaaggcaataaggtcagaagacaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcaccgaatggcctccaccaggaatgacaaaacgtcagagaagaaataccttccgaggggcaccacagttgacagagcatcttttagctaatggaggtagagtgtctgatagtgaagattcagatcaagtctcctcagatgatgaagaggagaagtctccccaaggtttcaaccagaataaaatggaacataaggcatgttcccgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctaacgaagaacatggccaaccaacccgccagttccaacggagagaagcatcaaggcaacacaaatcctcgccaagattacagtttcagcctaactccagtgccaggacagaggaatcaaaatgagaaaagaaaatgccgagtccgggaagatatctgttgcttcaattgtcaaggaatgggtcatttcgtcgacaagtgcccaaaaccgagaaacatagctgccagcacgtcagtccacgcaaccccctgcaatcagaagcttgttcctcagcgaattgtcatccatgcatcccgaagcagtcctatagcccgcgttgcaacagctccaactccagcgagtgcattaccacaaggtgtcaatgctcaatttcagccccagccatcaattgacaagacagaggccagtatcggcattgtacctttggatgttccagcacagcagccaagaaatcaagtaccagatgaagaacccgagcataagaaagttattgtctgttacaactgtggtacctgttaaggaagcggacatgcccatcgccaagtggtcactggagcaaatgcagtacctgttaagcctagcgctaatcagaagcaaccataatactcttatatcagtgttcaaatacttttgttttatagttgttccccgtcaatcatgtaataacagagaaacatgagataatgaatgagtttgataagtttattgagggatccatgttaagattgcaagtgctgtgagttgtgtacattttgttgctgattagggagacctagggtctcatttccgtaagctcataatctattatgaatcaaataacctagcgattgatggcgaagaaaatcaagtgatcaaccaaagagacatttgtttggactgagagtttcagatgtgtcttcttcggatcaaaggcatgcacccgttgtggagaaactggac

SEQ ID NO: 9860 - DNA, 1209 bp, Oryza sativa
agaatatactgtagtgaattagtgatggcaaaaggacagaatatactgaagaccaatcgaatcgacctacatgcgaatatagtattgctactgcaatactgcaaattgagtggtggtagactggtagtagaatggatgcagaggcatatatatggagcaaaagaagcataggaagcaagcatgcataagcagcaggtaactaatgaaattaaggcgaattgaagaaggatcactgatcagttaccgcgtgggagtgagtgatggagcgcaggatctgcagcttctcgtgtagagcagctgccttcttgcgttctctcgacatcatctctaaaattctactcaagtgtgtctgtgtctttctactttatttctcgcttcaatggagacgagcgagcgcgggtgtctagctagctacgacctgctgcttcaaaggaaggtgatgagtactgatgatgagaggctttctctacgtctttatagtggtatcctgcgcggtcgcgtacccacgtgatgttatggtgtctttagctagctaggaaatgaaatgaatgaattgaaagggaaaccaagaggacgaagaaaagattctgcacatgcgaactgttcatatatatagtagcaagtcaattatgctagctagcaacgtgagagacgttttagtttcaggaggccaggattgttggaggagcaagaactagctagttaaattggagtttgccccgtttactaacgtactgcagagagagtctttcagagtttttccctgcatatgcactcagttttcatctgctgcttgcccatgcatgttggcgaccgatcgatgctctaaattgtttaatggtatctgcatggttgacaaacgtgcggttctgaactgaaatatttgggttgcgtatacaatgaacctataagatcgatgagagaaacatgcattagtcaacaaattaaacacgtacaaagcaatgtggacagacctaataaacacgaaagtaaacaaaacgatagaactagatgtgtctatctatccttactactccagtatgtaacagaaacaattaatgaaaccgatgaataaaagcagatggagcctgagaattgaagtggacaggtcagaaaatgcgcgcggttgctagctaggagtactctaaagcttagctagctgtgcgtgcgttggagggttgcatgccacgggttgcgtggctcggtctt

SEQ ID NO: 9861 - DNA, 7979 bp, Oryza sativa
atcacgcgctaatgctcgtattaattagttcgaccgagagggacgtgctcattttattctttttaggacgacagggacacgcacgtcgtgtctcgatcgatcggtttaattagcatcatggaccacacaacaacattgctaggctaggctgttgttcgaggaggccaataagttatactccagttcgatcgatcgatcgatcgatccgtttatagttttagtagaaaatttccggatttgcggagggggtatgaaaactgcggtggtccacggtccatcgtgaccacgacacacaatctagctggactgggaacaaactgcgctacgttagtctgctaattcatcagaaagtccaggttgatgtgtgctggcaggcagggctcgctcgctcgtcgcgtacgtacgatttgatggacagatacatctcttgtgtgtcgtccgtcacggggtgtgtggctgcacgcgcatatacagacgcatagctagcgatgtacgtacacctggcaataagtcgtgtagacatgtcgtgtcttgtgtaaacaagcagacacggcttgcgtacgtcctggccaatggcaagtgtgaagtgcatgtgttggcctgaacggtcacgctctcgatcgctgcaggctaacgttcggatgaaccacaactaccggccggctgcaaattgtcgagacctcgaccgatcgatcgatcgatcgcattaactcgcatatatgcatgcggcgcgtgaccgccgtacgtacgtccgacgccgcgcgtcttgtcactgcacaagcgcagagcgcgtatgcctcgcggccgtgatcgatgctgcaggcctgaggccgcccacatgcatgtggatgcatgcatatgcagtacgggacgcagctggcgaccatccaagtatccaaccagagacttcagtttgcaatatttgcacgcagcggtaccaatttacatggagctagtacgtactctcgtgatctatgtctctcgcagaggacaccgtacactagctagctgccggcctctcatcatgtacgtactactttctccgtttcataatataaattattatagcattttcttcatttatattgatgttaatatatatatatatatatatatatatatatatatatatatatatatatatatatatatatatatattcgttaatatcaatatgaatgtgagaaatgttataatgacttacattgtgaacggagggagtaattcaaaactactttccggtgttcactacacgtacaacatgcatgcagtggtgtatagaggcgtataggcgagccgatcaaagaggaggtcaaatcgtggtccttggcaggggcgagaaatattggtagttggctttatttttaattgcttagaatgaaggttctgagccttagtttttttttcacacttataagtacaaattcaacttctacatcttacatatcgtagtcctgagcctgtattaatatgtgatatatcacttcataaatatgtaagttcaaattcaacttctacatcttacataaatcgtggtcctgtacctatattaatatgtagtatatcactccataaatatgtaatcgtggtcctgagcctgtattaatatgtgatatatcattccataaatatgtaagttcaaattcaatttctacatcttacatcagaaaaaacaaattaaactacaactagttaatgtatgttcatagttattttttttttgctttttttcgcgaacgcgcaaaatgattgcacatcaatttattaagttttttttttgcgatatgtagaaattgaattttaacttacatatttatgtagtgatatatcacatgttaatatatcttctcaaaattcttaataactatttgaatgacatacaatgacatacaagtaacgagtatacgtctccgtgagagtttaaaatccactctagatgagtatgtaggagtaggaggaggaggaggagcaatgttggtgaacagatcagactgatgagtatgcagggcccgggggcgtattcgacatgagcacacatgtttgttgcattcgatctgtctcgaaatattcgccgtgcacccacattcccctgttttattggggaggggagcgtacgtagacaggataggagtcgtagtagctctcgatcatgtgatctgaacacatcagtagagagagagactgacgctgagatggcaccaacatacatatacatgcgaaatacgcagcagcattcgttggccagctggtggggtgacatagtgctgtggatgcatttggctgcatggaattttgacaaacatctcgtgaacgcgaactgttctaaccttgtttctatatgcccgagactagcagaagtactcgcattaggccccgtatcgacgtaagatctgacattttgtctcgtgtgcatgagatttgcacttgtcactatcctcccctgtttttttaaatgattccctgaagaaagttttctcctgagaaaacgatgtccttgtctgattctatataacttgcatctttggactgaattagttactgttacaattagttagtttggtggggacttgtcttctcggatgcttggactagaaaagtaaaaaagaagaaacaaagactgccgtcttatatctgttgaccatggataaatctcaattggcaagtagtagttatactcatttatcgcaaaagctgaaaaagaaacaattgcagatttagacaagtctgctgaagtgattcagttggcagtagcttgtggctcatcgctcacgcatgctgggtttcagaatttagaagagaaggggcaacggatccatgcttatcatcattgagatcgatgctaaattgtcatgattaaggagtttaactatagcatttttgtggattgtggttgcgccaagtctgttccaaagtaccatttttgggaatacgtaaggagcgtatctttatattaagaggagtaaaagtctgtacaggtgaaagagaaaacacagcaggagacgggattacaggaagtcacccaagagcattaaaccctattctcgcgatacaatgttgcgacctgagcgctctaagagcaagtttaatagtatagcccactactagctccaatttatttatagccaatctaatagctaattcatacaataattgcttactatactattagtatatggtcccacctatcatacacacattacgtcttggagttcgtgctgcagctggctacagatctgtagcccgctgctcttctctctcatcttttatcttattaaaatatggttgtagctgactaatagtctgctattgtacctgctctaaaggcatggccggtatggcagtattggtgagccgccacagcgctgcctcttccaccattgcccttgcacttctgtctagcttctgtgcttctggttgaacaccctgttattccattccttccagattgttcatgctgcgagagtagcaatggtatcgaaacctcgccgttgagagctcggtaaggtttccctcttgtcacacaactaggagtggaatgaggtttcattgacgggcaagcactccgagcgaccgattgccaagagcagtagccaccagagctatcttgattctggacatgcgaccaaaatatggttgatgctttcctcatgctcatcgcataggacacacatgctggggtggggcaagcccctgatgcttaacctgtccgccgtccagcagcggttgagtgcgtccagccaactgaagtaacggcaatgcggcggcgccagcgatttccagatctgcgtgaattaaaacgggattagaccgaggaacaatgcttggtaggcggagcgggagaagtacaggcctgaactctcccatttccaaataaattggtcaattggtcctgccgatccgagagctctatctcccgcaacaacgaccggagatgttccaaagtaccatcatcgatcatggtatgtatacagacgagaggtagcgacgagacgagtcaagttgtaggattcagacaagatacgtacgtactcgtaattgttcgtgccatcccgctgtgccggcccgaaattctgttcggcgacaaaaacccaacctgaccaataatgttgtcgatcatacacggtacaacgtacaatacaaagccatgcatgcttaattcacaagcctgtccttgaacatgaaagatcatcgaccatttctgttctccttcacgtgcatcaatcgatcgcgatgaacacacaagaattcagctagctagctagcgaaataacaactccatcgatcgatcgatcgatcgcgatgaacagggaaagaaaactgcatttgcgatgaacagatagaactgctcatactgcctaggattctcggcctgtactctgtaggatgcaacagaggcgccgaggcggcgtgccgcgtgccactgcaacaacaaccagtagctccaaaggtcacgtgagcgacggccgtgatcgagcgatcgagctgaggcctgagcggctcagctacagctagctctctgaaactctctgctcgagtaggtacattcacatgcgatttggcgcaatacgaagctctctctgtcgcgtcgagtatacgtctaccctacatgcttcgctcactcacgttgtactacagtctacagctgcaagggtacaaagtacaaactggactagtacgacatgctccagccgtccagcgagcaagcgcactagtagtaccagaggcggagtaaaaaggaaaaagaaaaaaagaaaaacgagaaggccgactgaaacttcggtttgtagtgcagaagcccaatttagaaatttttcggcctatgggcctcatcaatgcgacagcccagcccaagttttgaacgggaaacttattattgagtgtattgtggcccaaagaccaattcagtccttaacgtctcgacccagtgacacttttccgtcacatttgcagtaggcggtgtccaactccaatgtggatgactgatgatcgcgtcaatagtcaataacgatggtcaatctagccgaatggcatattctctcaaaaaagaaaagaacatatcaggcacgggcaaagaaccacctcaaatcatttttttttcatacaaaggaaaaagaagggaaagaaccacaaaattccccttttgcgatgacacggtgcctccctccatccaaaattagagccatccaggcatccagcacaaaggcctggccggcgaaagggccaccaagcggcagatggcggcttcccgaatgttcgcggcttcgcacgcacaggaattatgcactcatcgattatctgaatcacattattaaaatatttttgctaagcagagggataaacgaaaagcaacacatcaagccagtggcggagccacgaaaactccattaaattttaataatgatgagtaaattgatgatgaaatttctataacaaagactagttatattgaaatttatccgggctccaaaatttatctgactccgccactacatcaagtggaagcatagcatggtagttcacatagggctataaactgctgtaacaaaaactaaacagcgataatattgtttttaagacgataacatctcaatagtcaactcccaaaacttgagacgctctcatcaatattgtcattctttctcatctgtactacctttcttccgtttacatcatttgctccatttgtacacatttgactaggtaacacatcaactaagcatcagctgcaaaaataaatcaatgatatgataacacaacaaaagtaaactgagccaagtatcatgagaatatagaagttagtgctttgagttttgactatatatacataccagtatatcgcgacatgctggacgcagtcttggtgaaatctgtagcatccggattagtactggcacctttccaccccatcctttagaaatattgcagtttagccatgtttgaagtggattagtcttccatttgctgctattcaaaatgctttcaagtttttccagtcttttgtatcttccattgctgctcgtgggacctccaaagagctcgaagtacaggattccgagactaaacacatcagtctatgaatgaaaatgaagaaaattcttttagcaaatttgccgtagcaagctagaaattctatgaatttaaaggagagttcatcatactagtaatctctaatttgtcaaggttttatatactacttaaatattagtaatggtggtattcattctcacactaccccctaccactaatatctgagcccaccaatctattatactattatatcacctttcaacaagttctcccccatttggccatttcactattagtttcctccaaatttcaaaatcacctatttgtttaataaaacaaatgatagtattacttaaattaaatagtgcttattaattgatttaataagctagaatctcaatttgtatttcattgcaatgcacgggctctaagctagtcaggtaaaaaatacacagaaaatggtgaatgttaccttctcgttgtgagtatgcatgttccacagctcaggagacgcatggaactgagtaccccagaacctattgccccttcccaaacaagaagcagatcccatgaaagcacctaccagaaagataaacatgccgtattaagatggcaggccaaatttaaattatgtcatagggatgttagagtacgaataaatatgatatcagtacttaccacttccgaaatctccaatcttaacattgttcaaattatcaagaaatatattactgggcttgatgtctctgtgaatgaatcctttttggtggagatagtttatgccaagaactgcctccttgaaaaactcaagcttcatcaatgtctccatttttttttcggtccaaataatcatcaaaagtactgaaaaaaaatcaatttcaacaagtgatcagattgtgacttcaataaagaaacaagtgaacaaacaagaagtgtattaccatttgcacaactcctgtgccaggtatacagatgaataatgagttccagccttttcttctttccaagcaatatatagtttctttatatttgggtgacgaagcatcttcataactctggcttctctggttttataaaaatgacagcgaaattattagggtctaggaaataaataaatcttccatcattgttttagttacagaaactaagacaatttatattacctgagctcttcatcagcatgctttcttggaacatcacatctcttaacagcagatctatgggcacctttctgagtactgcatcggagcacttgaccttccgctccccttcctggtacagatgctatatttaggtctacacaatatactatattttctgaagacaaagtattaatagtgctcacttacctagggtctggtggattgagaagtgatttttcaaagaaacctcaaattcattcgcaatttcattgcaaatgaatcctttatattgcaggtcctgtgttttgtcagatagattgctctgttttcaaataagaatgattgtcataatgtgttgcacaatagtataacattgacaaatgaaaagaaataaatactaactgttaaaagacttttcccacgtggtgaatttgttgattccatatcaaagctccaagtagaatgccaagccaatctagatttatctgcacattacaagcatcactgtatcacataaaattatttaaagctgaaaagtgatgcagctcttccttatagctatggtgcaactatgaacgaaacttggatgttgagaaaaaaatacatttagcgaacatactcgatacaatttaggagtgaatttcaactgtttattttaattgctcacaatcatggtcagtatatttcgtgtcatggaaccaatttttcctaatgccaaatggtgcaccaaaatgagaacattgagacatgtatcaattaaattggcaggttaaatagtgttgcaaataacatgtgaaaacaaagaaatta

SEQ ID NO: 9862 - DNA, 4110 bp, Oryza sativa
tggttgatcactagcataattaaggcataaacatcatgatagattttagcaatcatttttacttttctagcagttaccttaattattcatgatggaggttgctatactaaaccaacattacaacatgaacaataactgaagaaaaaaccggcacaattttgcatctcaaacaattaatgggtcgacatgatataaatgtaaatattatagtaccatttttccgcatcaatgttgcagccgcccgggactcctgaggccagatgtgaatgtccaccaagttcatctgccttcctcttcctcgacgggacctggccttgctggcgtcgaagttggtggcggtcatgagcaccgatgaagcgatgactcctcctttccccatggagttcatagtcaagcgagatgtgtctactttgcagccttcagaagatacagccctctcgatcgcatcgccggagggagacgccgatgtgcttccccacggtacggagagcttgaactctgcgcgctcatgcttcccatcctcgagatcgaatgagacagtgaggaagccacgccaccgagaggaagcggcgcgaccggcggcggcgggtaagcctattgcacggcggagcatcgccgcatctggtggggaatggaggggagggaggcggtgaggtttccgaggagacgacgaagtgcggggtgggagggaggggtttgtttccctgaagaagaaagaaggtagcagcagcacgcgcacacgcggcggggtgggtgcttggacgttcgggcgtcgggaggggtgggcccgggtggcagtgagagaagggacgagccgggcgagagagatggtgtgttgcgtgctaggagcaagtgggcacaggggttgttttggtggggcccggttgtccagaggggttacagatacaggtgcgaggtgtgtgtgtgtcctgtccaatccaaatcggaagtaacccgtcgtcgtcgtcgtcgtcgtcaatttggagaacccgcggacgcggcatgggtgtgcagcaactgggaggcgccggcggcgggcgcgggggcggccggcggagccgccgaggtcgccgtgaggcaccaccgcgccttgcccaccggtgcgccgacgaaggactccgggctcctctccgcgtggtaagtaacgtgcctacctgatctccgctatggataatggattccgcgtggtgaagtttcttgatctcctttcgtgccatgagcattgttttgggggactgcctctagggtttggtaactgaataccgttcgaagggcattttgcaattgaactgtgtggaactttgatttcaaggagtacatcgatagttaggtaattatttttgaactgtacacgtatagtcattgaggaactgcagtgatgatttctcatttatagattcttttgactgacaaatctggcacttgaaaagtatttttctagtagctgaagttgacaaaaattccatggaagaggctagtagagtttctgatgcttacctcaatatgccggatgccgcccatatcaccgagcatttcctgtcttcaatgccaatacttactgtgttcatgttgatcataacatatctgttcgcgaaaacatgtcttgttgccacccacttcaattgtttagtttgggacttcttaatgctgccatacttcacatccaatgactccttgatccttttctggcccactatcatcgcttggcacgtgaagtttagaaagtaaatagttagagcttctgcacttcatgagctcctttttcggtcgctcgcccttgacacaatctggctggtatggtctagatcctgaagtgtggcgcatttgtagaagtgtgttggatgtgtttggagaggttttctttaatccctccttgtacttttcttatctcttcttaatgaaatgacatacagctttcctgcatgttcgataaagagaaagtaaatagtatttgtttgtatcaacaattataagttataacctgtaacaagtctagtttcagcttcttctgtgctaagattttcgtagcttcaaaggaacatttctcgtataaaactcataatgacatctgctgcacaagtgaaaatgggcatggtggttaggttctagttcctgttttctcttaaaaatcacattgttatgcttgttaggcagcagttaccatattggcttctaaccattatcgtgcatgatctgaaagtggcaccatgtcgccttttcagatgttaccaaggtattcacagacaatggccttgaggttcttggctggcctgttctttttaatgtatcagtggtaggtcgctatgcaaaaagaaccatgcatgatatacaacagatttgtgaaactcgcaaaataaaaggataatgcggataacagatagggagggatggactttatttgtgttctttgtcaagcagaagtgcagaattgtattagggaaattatatttggacctttggaatggactctacaaatctctttttgccatataacaaagaaaatgcagtaccaatacaaatcgtagatggcctcttgcacaatcagtgaggttactagggcacaatggagagagaaatgcaatataggtttacatttacatttacatcctaaatctttacttcttttatttgttcgctgcctctgctgttatggaaagttcgttattgaagaataaacatacctggagctactcatagtgttcctttccttgtaagggaacttgagcaggatgcaatcaagggaagccacagtacagtctcctgtatggcgcaggtgcgagcatggaatacacccatttggtgaccctaaagcatctgagcatgaaacactacagcaaaccttgacagcactgctgaagtaagaggctgcacatggagcatctattactagtgcttcttgtccataccattgacatagcttgcttcttgtttgtaataatggcatgtacgattttttttgggttcttcttgatgcaaaatacagaaatctgatgaaaaagacttgcgtttaattctaaagttctaaaacaattgaaagatgcacggtatgcatgcaaacatcctgtgttagtttgaatttaatgcttttgagatgtggggaatgaggttgtacttccatatgttataaagttgcaagttactgctagttgctaagcaacatgattttaacttgatctatttcagtgtgcattaccatttctatgtatcaatctgaatgtgcatcatgcaccctgttctcttcttcaataaactttttacattaaaaggtgctgcaaaactgctgtattattaaatcatgaaattctttcttgcaccagttgctgctaagaagtggtaaagtcttgctgaagctcttatgattcttttcctgaggcatacatcccacattgtgatgaaatatcctgagatatggagtgcattagtagatatagaagccatgggtatacatcaaatttgtcatatactaactggtgcaatttctatcgaagtgaaggttctcttgatttgtgcattaagcgatccacttttatgactactataaaggtcacatggaggcttgagatggacctgctttgctcttatttaggtaagatcatttgtgtgtgaatctgttaggttttttttttcttttgctatatcagttcatgatgtatatcacagttttcttgcgcagtttggtccatctcacagagtatttaattgccttgtcacattgtatgtttagaagtgaccatctcctatttgtgtaatgtttatctctttttctattgttacctgctgacacttctctgacactactaccttatctttttcttgtaaagctgggcagagaaatattatcattctgggtgaagacgttctctgcgaagagtctagcaaactttgtgttcatccaataggaccaatacagacctggaggtagcatctaagtaatcaattgttgtcaaaacatattttattcgttgtttgcctctgttctgccatttcctcaatcaaaatgacatcaatttgatggtatgatatgagatctcattttctacagaatgtgtgtttttccttttccttttatatgtgatacttcttccgtttcataatgtaagactttctagc

SEQ ID NO: 9863 - DNA, 4900 bp, Oryza sativa
  unsure (1)..(4900): unsure at all n locations
attatggttcaagttaagttctctctctcacacactcatggcagtcctaccaatggcgataccgatgtagggcacgcctctcggctctacctcaacggttgccccaccgtagcgcacctgcctcactcaggggtaaaccatctatgcagggatactgcctccgctcggctatctaatccgctaggtctatacccattcgagaagtatggttgtacggaggtcgtttcatgcttaacttcatggctcggtccttaattgactggggacggtactagccttttctagataccacccaaatcttccgtccgccccagtcgaaaacagttgtttagttttatttctcctttcacaaatcatgtcatcaatatcatggcaatgtggcgctcatgtctccacatgccgcatctcaattaccttcccaaaggtaattgcccaagcatatagcatttgataaatatgaatatgcatgaatctagagtagcattttctaagcatttgtcatagttgactagggactcatacgtaatcatggttacaaggatttaagggcaaacaataatcaaggcatggcataatcacaagtaggatgtttatcattgcatgcaattttatttgtaaacaaaataatttcgcaattgggatcaatatgttcaaggaatagtgatgacttgcctgctcaggatagtccttattcttgatacaatcgtgatcaaccttcacctcctggaagctgcatacgttgcctcacgactaatcgatatacaaattctataatacgcgagaaaaaaccaatatttaaacaacaatcaaatatgtacaaacaaaatatagttgttggggtcgaacctagggttgctcatactactcgtgtttgctaatggattctaatcaagctaagaactaaggtttcttaatctttatgttgtcatcatggtcttttcaggagttaaccaacatagcatttatgggatacatatttggctaatatgtggtttagtctagcaaatggctatatatgcatctatctaaatagaacggttatacactagaggttctattgccggatggattttggatcggtcaaataattactgtgaatcatttctattattatgaacatattttatttgtcacaataaattatgaaaggttaataattatccatgctctatatgttacacttgtgaggctaataatattatagttacagattatcccatcacataattttacaatgaataatcttaatttacaattgaacttaggttatattaggtcaaggtctataattaggatttatccaccatacatgttcatcatatattctctttaattttaatacgtgcaatcaagcaatttaatactacaccgtatagctataatgggttgtgcagtatatgtgtgtgcacaatatcttaatatttaatcatttactgaatagttgctatttactataggctatatagtacatgtgattttaagtggatttatgagtgagttaccgtctatactacttaagggttgatttccaatctaaacatatactattgtataggaaatgccgtttaattaatttcgtgtgggtgattttagtcacactagctctgttattatctctcataaacaagttaaagactcttctatgtgtgtttatattttagtcacgaaatatgaggctaaacattatttatatactttggacgcatgtgtataattatatagggacatatattaataaatggcactagcatttcctatgcttaaattaatttgaaacaatgcttctaattagtttacatgggttntatagtgagaaagcatgttaaagacaattattngacatctactntatagtatattttcaattttatttattagcacatttttaagttaactattatgcatcatcttgatatgtaatgaacttttaattataaacatattttattaaatcgtgaactatataccattggaaagcttatgaatttagatgaatttaggttcaagtttcactcaaatccgagttaaaacgaataagttacgctagtttaaagattcaaatttgaattaattcaaataattgcgaaatgctactgttcctaattcatttatttttagtacaaccttatccacaagctatagtgactgacaggtggggtcttcctattttcttttcttttattttatttttctttctaaaggaatccatatgggcaaatgacgggtgggcccgactcctttgactagggtcaaaccggccattaaacccggtagggcccgcatgtcatagactcgagaccataaaacttctataattagatttttaatcacccggacccacatgtaatagacccaactaataaagattaagaaggggattactattcaccaattacgtggggcccactctaatctctcctctccttctctttttctctctctcctcgctacctctctgcttcctctctctttctcgcggctcggctggaatcagcgggagacgtggcgatgacaagcggtgggggagggggaggttcaccggaccggcggcggggtcgacggagacgcggcggcggggtcgatggcggagcacggcgcggcgacaaggcgctgcgctgtggcggggcgaggcgcgtctgctcagcggcggcggcggcttccgaagaggtggcaacgccggggacaggaaaaacaggggaaagggaggggaggtggtgagggtggtgtgggaagcaatggacgggccggggggggggggtttatataggcgtggggagaggtggtcggcctgatggcgatgggacggcgcggcgcgcggagagtgaggcgacggtgcggggctcggagcggcgacgcgacgggcgggcggcgcggcgcggggctcggcgtggctcggcatggggctcggcgcgacgggacgggcgggacggcgacaggcgagtggtgcgcggcggcagcaacgggcgcgcggcggggcaggggcgcggggccgatgagacaggtgcgcagcgacgggacatcggcggcgaggacggctaggcgcggtgtggcagaggagggggaagggctaggggaccacatcgaacacctaggggctaatgaacagtgactttttcctatttatccaattttagggcatatttcctattaaaacttgtcccataaattctatatttcacacaattgatgtttacccaatagatgtgttaatttagatgaaagtttactcaatttttaatattacccatattttatttttatatatatttttctattgcattatttaaatgaggtctaattataaaattaacctagataattttggaggctttgagggttctaaaattaattaaaatatcctaatgtggcaattattattgcaatagcacattgaatgaacttatttgtataacaatgcattttatgtgggtctattcattctataaatataaattgagactcagtacaacattaacctaattgtttaaattaaacactcacatattcttatttatatataaagcttaatttatttatatgaccattattttatatgagtgattttcatgtcatgagggactcggtgaaatgttctaagtatcaatctatatattccggtgaatttcttatttttaaacacgatcattatagtggtgatcatcatttcatgtgttcttatatttcatgtgagattggattcaaatgaattaggtttgattttactgtttcttttagctaatcatggcatcaagctatcagcatggttcgaatatttaatatttgatctataaattaaattagtaattaaccttccctttgtttggatttgctttctttgtgattatttacatttcggcaagcaatatcaaccataacaaccagcatgatgcaaaagttttaaaaagttcaaaatttaagtgatttttattgtcgggaattttcaggatgttacaatatgatgctagttttattcgtccttgtcgatatgctgagtgggtttctagcatagttcctgttatcaagaagaatgccaaggtgagagtgtgcattgattttagagatttgaataaagctaccccaaaggacgaatatccaatgccagtagccgatcaactggttgatgctgcttcagggcacaaaattttgagttttatggatagaaacgcgggatacaatcaaatttttatggccgaagaagacattcataagacggcttttaggtgtcctggtgcaatcggcttgtttgagtgggttgtgatgactttcggcttaaaaagtgctggagcaacatatcaaagagctatgaattatatataccatgatttaatcggctggttggttgaggtctatattgatgatgtggttgtcaagtctaaagagatagaggaccacataaccgatttgaggaaagtttttgagagaaccaggaaatatggcttgaagatgaatccgacaaagtgtgcttttggtgtgtcggctgccagttcttaggatttcttgttcatgagagggggattgaaattactcaaagaagtatcaatgcgatcaagaagattaagcctacggagaacaaaacagaattgcaggagatgatcggcaagattaattctattagaagatttatttctaatttgtctggaaggttagagccttttacgccattattgagattgaaggccgatcagcagtttacttggggcagcgcaacagaaagctttggataatatcaagggatacttgagttctccttcagttttgattcctccacagaaagggataccttttcggttatatttgtcggccggagagaagtcaatcggctcggttttgattcaggagctcgaaggaaaggaaagggttgtgttttatttaagccgtcggctcttggatgcagagacta

SEQ ID NO: 9864 - DNA, 2602 bp, Oryza sativa
ctgcaacatcaccgcacccaggacaatcttcaatagatggcagcctcataccctcattccaacaaaatctaaagaactcgcaaccccaatgaggatcaaagccatcaccatcttcttcatgatacctctcctgctgtttactatacctcttcttatatttgttaataatcttagccgaattcacttgaaaacctcttgcacgaccaccatcgactgttcggccaactgtatgcaccatattgacaggaaaaggattgccatcaactttcatcggccttttagaatcatcaaacttgattttacctccctcaatagctgcttggatttgctgcctgaagaccttgcaatcattagtcgtatgagacccagaattatgccacttgcaataccttttcttgcccaactcttcaaccgatggaattgtgtgtccggcaggaagttgaatctgtttttctcgaagaagcaagtcaaatattttatcagccttggttatgtcaaagccatacctttcctctttccctgagttctttgcccattgtcatggtataacctttttgctcctaacccactcggctgtagctatttcagaatcatcatcctcatcatccgatccatacatgtaagggcagacatgattcacctttctagaattctttctagcctccgcaaacctttgttcatgcaaagctaccttctgtgtaagatgcgacaagctttcaaagtcttcagatgagaacttctccctgatcggagcaatcatcccttgaaaagccaaatcggctaactgggcattagtcaaactcaagctgtaacacttattcctcatctcctgaatctctgaatatattcatgtaccggctcatcatgcttttgcttgatcgacgtgagatcggacaatttcatctcataaatcccactatagaaataactatgaaactacttttctaaatcggcccaactgttaattgacccatgtggcaaagaagaaaaccaagtaaaagccgatccagccaacgacaaccggaataacctaacccttaaggcatccacagccgatgcctcaccacactgaactaaaaatcggctaatgtgctcataagtcgatgtagtatcttgccctgaaaactttgaaaaatctggtaccttaaaccgattaggtagaggaactctttcaaaccattcaggataaggttgtcggtacaaatttccagcctcctttggcctaagcccaaaatgctccttcatgacatccgcaattaaatcggcccatggtcgctgctgaggtgttccctgaggttgttgtggtatgggctcaaactgattgtattgaggaacaaactggggctgagccgatcctgcctgttggtattgaacatgcggtgattgcggctgatactgataattcaaattgcccccttggtaattctgaagatctggctgaatattgagcaccaaatgctcgggaataacttgaggtatcaccgtgccatctggttgtacatgatgaaccaagtgctctgggacaacctgatttgtagcatgctgcacaggctgaccaccaggtgttgcaaacccagccgatgcattcattgagccttgctgctgaatcgactgaacgacctgctgctttaacggtgtctgctgaatcggctgtaaagtcggccgtcttggtggtgtctgttgaactggttgtatgacctgctggattgggggtgtttgttgaataagttgcacaacttattgcctgggtggtgtttgctgaattggctgctgctgggttggatcaacagcattctgaggaggtagaaacatggatgcaacctagtcttgcgttagccgagtcacattttgtccagcatgttgtggttgctctcttaccaacaattggggattgactaattggcctggagccaaaggcggcgcagcaggtacgggagccaatgctggtgccgtcggctgagccggtgacgcactaagaagggctgactggatgactggctgtttatcggtgattaatgtccgataattcgggaatactcctcctggtaggtaaaccggtcccgtagctttatactcggccattgaaccatcaaccattgacttcatcatgtttgacaaggtattaattaataccccagattggttgatcaaagcattatacacggcatagtcaacccgatcttggaagttattgaaaaactcatgtgctgcattaccatcctgattaagatttccaccttgtaatccttgggaattatcatcaagaccttgaacttcttgagaaccatcaccttgatctccttgagaaccatctgcaacaccttgatcacttggctaagccgcaccatccggagctgatttgacctctccatccttaaaagaacctgtcccaggaacatcagcaaccaccttaactttatacttctgaactagcgttcctttacgggtttctgtgaatgagctcaaaaattggttcctcgcttgctgcatcattgcctcaagatctttttgctgttcaagtgtcaatttgtccaaagtgacgggcataattgtcacgcccagaaatttagcctaaatttccagactattttgtgtattaaat

SEQ ID NO: 9865 - DNA, 10127 bp, Oryza sativa
gcgatcctagagtggcttcagctccactccacaggcaaaactcaactggggtctgagccttggtcctctaacttcgtcttcagctcagaagcactacgcttctgaaaagggggaataatagcaaggctgagtacaaccacgtactcagcaagccacaccaatgatgcagacgtgcaaagggatacaaggacggtttgtggctatttgcataaaggcagttgtaaaacattttatttagcaaacagtaaaactgttgagtaattaaagtaacattaaatctccactgatcaacgctacaccacgttgaacaggcccaaccaacccacctggactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccactggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagtatgtctaatactgcaattatcccatcgactgagctagtggtaattcagcatggctaagcatatagttctagctaggtcacataagtaacatgagctagtcaatttatcacccaaggttgacaaaggatagatatcaagtaaacatggcacaagcgagcagataggtaaaccctgaccccgtgtaattagcaaaacatgcatatttatttgcaaacagtaaaacatttgtaaattaggatcaacatgctcaaggggaatgtgtgacttgccttgcttcttcactttgatcttccgaactcttttccttgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaataaatttctacaattaaactcgatttattgcgcaattattatttatttttacaaaggaaatggtcctcgctgacgtcagcaaaggggcggccggcgccgacacgcggggcccaccggtcagcggcacaagagcgccggtccaccgtggaccgggaccaccgaggcggtcaccgccggtccacgggaaccaacggtccggatcggcccaagccgatcggacggccacgagacggcgcggctggggcacgggcacggcatgaaaccggctcggccgagccaaggcgcggcggcggcatgcggccaccggcggcagcagccggcgacgcggaacagcggcgggcggtcggcgaagaggaaaaggaggagggaggcggctcaccgagaggcgcggcgacggagagacgaccatggggaggcgaccggcggcggaaaggatggcggcggccggcacgggaggcgacgggaacggcgttccgacgacgcccgaccatggcggagccgcggccgagggccggcaagacctggggaaattattggagcggttagggagggaaataggcgaccggagcggcgagaataccacgccggagaggaatggtggggctcaccggcgaccgagagataccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggtggtggctcgggatgcacggtggaagggtggttgcggtggtggaatggggaaacggagcggaggccggggtagagcttggcacggcgttgccggcggcgcaagcggcgaggtgcggcgacgactagcgcggcggcagcggccggctgaaggcggtgtgtggcggtagtggctcggcctcgcgatgggaaggtggttccggcggtggaggagggagatggagtggatgccggggtgcggtggggtggtgtgatgctataggtggtggcggcgcagcgcggcagcgacgggagcggcggtggcgggcggctggagatcgccggcgagcggcggcgatgcggatcggcgtggagagctcggtagagggcgtgggagacacgggaaaacggggaaagaggaagaggaggccacggggattgattttatagctcaagggggcgaggagagggccggggagcggcggatttcgaggggaagtagggcagcgtcgtgggggagagagaaacgcgggaggcggcgacgtggccggattttgcggggagagtggggggggaaacggcgcggacgtgggcggcgaggtcccacggacaagcgcgcgcgcgcggggtggaggaggtgggcggaaacggcggcgacgttggacggctcgggcggccatggcggttgctggcccgggctggaggttgggggtgaccccgacaggtggggcccacctgtcggcggctcggggagaggagggaggatgagggaggcgaagcggacttgcgcgaaggagggggcaagccgggccgacggcccaaagagaagggaggaggggaaaaggagggcggccgggcccgagaggatggagagggagaagatcttgggccgaaagcggcccaaagacaaagaggggaaattttatttgttttctttttattttaattgatgcaatgatctttgtgctattaaaactatttctcgagctccgaaaattcacggaaaattccggagagtacattagggcacaaagaatattacaaaatattcccggccaatgatttttaaagggaaaattttaattctcccaataattcacttgattaagttgatttaacttttatttaatttctagaaaatacattatttaatgatttttaatcccgaacgaaaatcggggcgttacaataatgttgctttcatcaacctcaggcagacccaacttaagcatcttagctttaactgatccaggttctccagccgaggacggcgatgctggcggcttctcggctatgaggaaaactgctgctgtgattctgacttctaatgtgtcccaccgggcgtgccaaaagcgtgttgacaaaaaacacgaggcctgggagatctgcttaactccagtgcaggtccaaagatcgccttcggatgtatgagcgtgccagttgatttgattctgcaatcaacaagaaacaaagacaaagaaaccgtggttaaatctataaatgatagccgatcggctgattgccgataacatatcatttatctctgagccgatgtcatatgtgaatcgatcggcgatcacaaataggtaacaaggaactaaatttactcgatcggctgtagatatcaataatatgtaatccttatatcgatatatattcaaatcaagtgactgggatagatcggacgccatgccgagacagtataaatcacttagatcaaaatacatattaacaacaagattatatatgttcatagcgtagccgatcatgtagatctagcatgtatcggctaatactccgataccactctatattaagatattaaagcaagtaagatataccaaatagaagcctaacatactttaaatgcaacaagatcttaatataaaggacagatttaacatgtcaatcaagcgtataaggtaaaagtagttaaatcaggtaagatcggctgaaactccgatgctaccctaatcggcaaccaaaaggcaggctagagattatagttctaagcacgacttaatagatcaaactcaactaatgcagcattaagtatgaaaagaagaacaatatctagacaatcaagccgctggatgtttcatagagtggtagatatcttatataatctaagccaacatcgttatttaacctaatcagccgccttttactaacagatgttagccgattatagattagataatgatattgtcaaagattatataagatatatgataactcgacgaattacataaacaagattagagtatcatagagatgggagcactaatcccggaaacacaagccatcataacaagttttacctcatgtcgaagatcgaaactgatgcagctcaacccgaaagtaagaactcgtcgaaataaaactaaagcaaaaagggtggtgatgcgccgacattgtattgaacgtgtgtgttaataattacatagggctcggggtctatttatacccaagaattacaagatatgtccatattggacacgactcttatctctaacaaactctaagataccataagtctttgcggcagacttttgcccaagtttatctctaaggaaattacataaaatatcctaattaatagatacaattgccttcccaggactctatccatgcacggcaatcatcttgaagcacaccaactcgaacccgatgtcgtacacaagtcatattgtcggaatcggctgtatcacttaacccagtctgactcagacttagccgatcccagttgtagccgatccggacttcagccgattttactctatttccgcaacaatccttatcttcgattctgcttcgactccatcttcatctccgatgctgatatcaccaaatttggtcgttaacaatcatgcgttaatatatcattctattttgcatgtagagagtgttccaacccagaatacacccgtcccacatggattctaccccttattcctaggagaaaattgggaatatgccatgtctcaatgtaagaagtgggttttcccaaatacgattttcatcaatatcaccccgaccgaaagctataggcttccacttaggccgagtttagttccaaactttttcttcaaactttcaacttttccatcacatcaaaactttcctacacatataaacttccaattttttttcacatcattccaattttaatcaaactttcaattttaacgtgaactaaacacacctttactacgccatggatggagtgtacgagctgttcttgttggcttccttcattttaatggcttggagggtgatgacgacgagcttatggatccggcatcgttgtcgatgagcgcgcgggttagttgagtgcacaggtccagcaaacgatgacgacgagtgcgtggatctggcgccacccctgatgagcgcacgggtccaaatgatgacgatgatgagtgcactggtttcgccggccgccgtcgtcacttttcttcatctttgcatttcttaatttgagaaatgctagaaaaaatttattttatgttatcataacttaccgtaccctacgtaaccggcttaaagatgaaactaacaaaatggttcaaacttagaggtccaaactcatttagtcctattcacgtcaatcgtcttatcgtctgaatatatgacctcatcaactatattatcatgtactccctccgtcccaaaaaaaggcaaaccctaagtttccgtgtccaattttaactgtccgtcttatatgaaaattttttataattcgtatttttattgttattagatgataaaatatgattaatattttatgcgtgacttgtctttttaatttttttcataattttttcaaataagacggacggtcaaacgttgagcacggaaaccagggtttgtctttttttgggacggaaggagtagataatcagatttagcctcttttaagattttggcttttttggtttgactttcttaaactgaacctgtttttaattataggtgtgcaatgaagattttattttataacttcgataacctcattgttatggcttttaggttttgaacgtgtactagtcataggattactacaaacatccaatgtaggagccaattccgaaagagtcgtcggttgcggtttagccggtggtgccccctcaatcgcacgtcgggtttgagcggtgatgttgtagcggtctgacttaccactactaccgatcagaccagcatattgtgctaaatttaggatctaccatattgagagaattattggtacttttcataatctaatatcgttgtatctgaagatattatgaagatgtatgctattataggaagtagttgcaccgccaccaagcaatcggctatttagccgattctctgcttattcatgagagcatgtagcgttttctcaaagatagaattaaaacagataaaccagttatttaaactagcaacacagtgcagtaatagtgtagtactgccgccgttgacagcagctgacgacactctattttcgttgatgccggtggcgaagtccaacgccgacattgtctcgccatcgcctccactgcagccacatcccacatagtctcgcttccacagcttgtgcctatatacctcaccaagaaccaagtgcgatccgtcatggtctgcataacagcagcgccccgcgggtcagaggaaagctcccgaacagctccatggcgagcggtacaggatctcgtggcaaggcagcacaggagcacgggagccacggcgtggcgccggcgcatggtcgcgtataacaaccacgatggagattatttgtagctgcccagagatgaatgtctcggaagatggtgtaggcgtgtagcgagtacggaccgacatttacacattctgatcatactacccttcatcatgaatggactgacgtatagacatgattggtactcctaccttggtacctattactaatacccattagtaccggtaaaacagctcaaaacttaaattgcccagaaccaaaatatgattacaaatggcacgaatcctgtagaggattcgagaagtttagaagtgttttcagctttcgctgcctttatgaggttccacaaaattcgcagtattcggggcacttcgttgcgtcacaagtatcctgggttatttctttttccatgatgctgtcccaggaaagtgtcaaagaacgaacaccttcctgtcacctaatctgatgatcacttgctgattgcagttgaacataggcaaggccacccgtcattccagctgcaacgttcctccttactctaccaattgaggaatatgcatatgtcaggaccagcgtcggagccaaggcccggcgaccctgagcagctgcccgggctctgccggctacatgcaaccatgtcccattagattaaatctaattacctagctaatcatatttaatcaccgtatgaattgaaacaacaatagtatatagtgtacatacttataacgatttagtgtaaaatagcaaagcaaatgctcactctaaaatgatctacaaatttgtatagatttgtgtatactatatttgttgttaaacttgcctaggctcacgatccgccactagtcaggacaaaacactgtgatcctcatttagcagcatgtcctacttacttcccccgtttcacaacgtaagtcattctaacatttcccacaatatatctagattcattaacatcaatataaatatgggaaatactaaaatgacttacattgtgaaacagggaggatttgccaactacacagccaccgatcatgtactcgcagcaatgatctccagtgccctgacctcaaccactgattgaccaagagagtttcacctgttttgcctgtcacaaatacctgctcactagtagccaacacagacaagcgtttccagctatagtagcttcgtcaggaagtcaggaacgaatcctgtgctatctagtacactctacaggagctacaaccatctctccaccacccatgccctgcaaattcttttttaaaaaaagagagggtattttaaatctggtcaggatcaattttcaaatgtgctgtatacatttggtacctttccaacataatcattggcctctctcaacttgcagagtattccaggagttagaaaacatccaaaagactggccctgcacttccagtaaacctaaaaggcaaaaaacaattatgctcctaacttttcataagagaaactaaagaaaactaaaaatagaaaatggttaacatcgtaatgttgagctggcctgcaaagcctgtgtcagcgtacttcttcgcaatgacacctgctacttgaccacagacagccctctcaacattataatatcttggaacctcctcattctcaattacatcagatatctgcaaaatagaatatataaataatgctgcatcattaagcaagatacaagtatacaactgcacacttcgctttaaactacaattaagggcatcgatcgtcaaaattaatttctggtttcaagctgaccaaatagcagaatgaaggattactttgattgactattcacaaatcagtcactagggaggttaatgtaactgagaaaggaatggaaaacattacatcaggatttgcaaggattgtctcatcaagaacagggccattagtgtggacatcttgaacacatccagtagctattcatagccacagaaccaaaaccatattcatccacgcccatgacactagccataaggacatattggcaacttctgaatccaccatccaccctaccatcctctctcacaatcaattttgcataagtgtcaggagaaaagttaactagcattagaacaaacaagatatttcaatagggtaataacaaacaaatagatgaggctaacctggtgtgcttctgaaagaccaagttcccaaggaccggcagaatgcttaatcaaactaattggcctagctccagtgccaccatcataatctgatgtgtgacagaaatacaaatatttcaaatataagttttcataaataatctaagttaaatgctgcaataatctaacttcattcgaagaagactataatgtttagtacatccattcagtttgtaaattagttcagtatcttcattagtatgagattttttggaagagaccatcatgcgctacactgctaaaattttggggccattctactccctccattccaaaatacaagtatttccagcattcaaaatttgttccacaatgtaagcatttccagggcactgatttcaatgcacggaaatccataaattttcagccaattaggtgcttgggaagagaatctaagcaattcaaaattcaaattttgaccattgtggtgactgaaagggaatcttatgacttaatgttagtactccctctatcccaaaatataagggattttggattttgactggttaggacacatcctaatactacgaatcacgaatttggacagggagcctgtccgtactaggatatgccccatcctatcaaaataccttatattttgggacggcgggagtatatgctaaacaacctagaaatgcttatattttggaacgagggaagtagtaaatttctcaaaaaaaatcctccaaaatctctaacagcttctaggacactttttttcactaaatagtggcattcgttagcaagtactcagcgtcagtgcatatcccattcagtaaaatatagctaaccaatatctcaaggaaggaaatatttctcaatctggagaaagacaaactacaaaagggagttatatcattgtgaataccatataaattggcaaattatgtagcataatattgcaaacaaaaccctatgcaacttgatgaggtatgcattgcatccgtagcaagagttaatccgcgttaatatgtagaatgaaattagttaacatgctctgcttctttatttctgtgagatacagtacacattataaagtaaatttggcaaat

SEQ ID NO: 9866 - DNA, 3048 bp, Oryza sativa
  unsure (1)..(3048): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatactgcgaatcaacttgattcactgattattgacagctacctgggagaacctatccttttccagattatgtgtcaagatgtatcctccactgctcaaacatgctttttctgtcaaccagcttaggttcaagctagttgttatcaccgaaaagtatttttagcattttcttttaccctaaaattgctcttgactcagtgctaatcagttgtgaggcaacacgttatccagaaaaagaggatccctgagttcctccacctcccaaccaaccccattcaacacagacaaggacagaggagtacaaaacctagttatcgagaaaagacattttgaaaataggggtgctttgaaaaactccgatgagctctctgttactatgcattttctttctcctttctatggacaaacttttggtagcatgtccgtccgaatttaaactagtgtcatttgaagtcacagtaaaattgtttatcttacgcctctgtggaatggaacacctcactctatgagaagcatgattctagcatttctagtttatcactagtttgtcaattggaacatgtaacatttacagaatcttccatgtgggatgatccattaatatcaaaatagtattcattataagcggatgtagagaagggaaatggcagaacttatccagcaagagatggatgactggaaatcagaacacatatgtacagacaaaagcattacctgcaatatctcgttcaatgacttttcaagggccagcttcacatcagcaggatgcagagcgccactttcataatcagctgtaagttcctccatgctcagaaaagtcctaaacaagatagaagtaatcacaaaccatagaataaaagcatacaaatataatgcatgattacgttatatgatttagttgtgaattgttaggtattgatgacaccgacaggacaaaacaattgtactaatactgttgaattgtaaaattaagatttgtccagaaatctgcggaagtgactctgcaacttcttactttttgccaccattccctttcttctggaccacctcaaacattccaaaccaaggcaagatgatatattttatgtactccaaacatggattgccttctgctagttttggagggcagaaagctttttccattttaaaacatatatcctcctgaaatatacaacaggtaaatattgaacaatctccattgtcaaccttcaaacaataactaatgatttcgccaaaacatcgatcagacgatgagctgcataaggtagcatatttcaacaactctatggtcacactgattgacaaaaccaaaccccataccagaactgttcaaaatgtcaaataacataataattatcacatatagggttcaagtaacaaaaaagctaaaacaaactggttaataatcatctgttgcagtgcataagaacaaagttagcctcttttcaaacaaagaatggggagtcttcccttgttactcatctccctggatcaagatgagtttattgcctaagcatataatagcaggttcgagttaaacttatgttgcagtaaaaaaaaaaggatggaacgaagagaatatataaacaggattggcatcatataggatgagtataacggtagtaaaaccttatcatcttccatgaagatagcccaagctggatgcctcctgttctccatttgagggtattgtaataaattaggaagcatatctgtagtttgagttaaggatgtgcacccgagtatgtttcggtgcatgtaccttgtgcaagtgtcttggcatgtaagtaccaccatccaagaaccaaataccaaaagcacaagcacatgtaacaacttggaacaatacatataaaagtgaaaagatactgtccaaaacagcaattgccttattcttctttttgaaatgcttataatattgtctagctaataagttggcatcatgctgttccattcccaacagccatatgtctgcctgcagttgataatgtatgcattgcaagaagctttaaagaagtccattacaaaatcccatgtaaaataaaatacagaagcatatttgaacactattactttagttgatatggcaatcacagaattggttgcacaaaagtttcacaacaatcagtctagtgaaagtgaacagatacataatctacacttgaaaccaaaaaaaaaagaggagtatgttatatcaataggccttgtgtacaagaattggtgaggtgcaagatcaaagggaagcaaacagggttggactgcatagtcaaataactatattaatagaactacactaattgcttccttcatttgtccctactaagtttaaagcaccaccactacttttgctcatttaacaaattagcccctgatatttccagaagttattaatatatcagcggttactgttagataaattgactgaaacataccaatggcaacacatttgcaaacagaggtagtaggtacattaaacataccttctgaaataatatgctagcacactgcaagcaaatgtaaaaaatctcatcaacatttaattttccaatcgcataagaatttctactcccacaaaatctgctaggtaaacagtaataagaggacctgcatgtactgatccaacatccgatgctcaatcagtaggctctccagtgaaataacccttgaaaactcaaatgattcaaacaagaatatacctttttattctacgcacactgtttgtccttgcaatatccatgacaattggccagtactcatcaccatgttgacgtatttcatctgacaaccagactagatctactttatcaagagccatgccagttgctttccacatctcaatattgtacctgccaacagtccgcatcttatttagattgccactaatctcactgttcatctgggaaaaccagtctgccattaagattttaactttgaaaccagattcaaccattttatt

SEQ ID NO: 9867 - DNA, 3550 bp, Oryza sativa
tgagacaaaacgttcatgcaacattattttctcacaaagaagcttggtggcattgttgtaactaactaaaagagacagaacaaaagttaattgtaaatagcaagctgatggtactatcagaatcaactcttgactacaatttggtggaaccatggaaaggatgttctcaataagttgcaattttgaagcgcacaaaaataataggcagttattattattgtctggtctatggatttcgtttgtgccaaagcataaacatcgacaactgattagtgagcacataaagaacaaaagatgtttttttcctgaaaatttcagtaacgcggaagacttataaatgttttagaatccaaatgataattataagacaccgcatgttttcttatgaaacacactagttcaactttacacactgaatccaaaggatgtacacaagtaaaatcgtggtattcttttggatttgttgtgcaacccaaatggttgtacatttaggcactgctttttttttaaacttcaagttattcctgatgaggttgcagtgcatttaaacaaaaattgcttttaacgacactacagactaaagagtgcatctgcataaagctatccctgttttttcttagcagtgctacagtatggtatatatgaaccatataatcaaagataattatcagtttcaataagtagcatctatgagagctaccaaaaaatgtgctcctatacctgagaaatgtgcatccaggggcatggatcacaccaaacataacaaatgggggcatgtttcttctttagcagtaacttaagctcacgatcgttgacccgatcctccccaatgctcttcagtgctgcaaacctcaggtcaaaactcccctcaacagtatccctgaatgtaaacaactaatttagcatgccaaccttacaaagcttagttcaatattgaagttcagaagcgagcaaggttatccattagagtcgacagcagcaacagctgaattctccatgttgccattactacggtgcttaagttctgttcggagatatagtccagcattggcggagctcctctgtagcaaaataatcaggttgcggttggaaagatgttgcctgctatttcccattttcttttatcatgaataacctaacccatgaaatttaacaagaatcccgaagaacatgagtcggaaattcgaccctacctactggggcatctgttccaacttccaaccaatcaaataggcatagagagagataaatcttaccccgggagctgttcttcggggaacttttgccgttgtgacggcgtgctgccgtggagatgacaaagctgctgctgtggcatctgggagcggcggcgcggcgaggcggaagcctcgacggacatagtcggcgttcgcttccatgttttgcccacgaggccaaacgcccgcgctagcattgcccccacacggacacgggagctccaaatccaggggcgaccggctaatccggtcgcagcctccgcgcctgacttcgtcgacgacgatcggccgccgtcgccaggggttagggttagcggcggcccaagtcttcccccttatattctttttctgtttttctagatataataaaataaaatgataccgtactgttttgtactcctgtatgttgatatggggcatttttagaaaattagcccagggctaattttgggggctaattttgggagctaacgtttagttatgaatttataggctaaacattagcctagagtagtatgtttggatccattggctaattcaaggctaaagggtagagagagtagaaagagagcggagaaagggaaagagagagaactgctttttatggtccccacacaaaattagccccatttagcaccccttggaggggctaatgttttgagggggctaattcactttaaccccaaattagtccacctgtttggatgcttgagggttaattcagggctaaaaggtgagtgctaataattagcccatggaaccaaacatggccatgatgtgttttttcttcaaactcggtactcccgccgtcttaaaataacctatgaccccttacaatgaatctaaacgctcacatctcctactagtttagtttatcctgggacagaaggaatacgtgttttgcaaaaagtttataatatgaaagttgcttttaaaaatcatattaatctattttttaaggttttttcatagctaatacttaattaatcattgttgacaaaaaacacgaggcctgggagatctgcttaactccagtgcaggtccaaagctcgccttcggatgtatgagcgtgccagttgatttgatcctgcaatcaacaagaaacaaagacaaagaaaccgtggttaaatctataaatgatagccgatcggctgattgccgatgacatatcatttatctctgagccgatgtcatatgtgaatcgatcggcgatcacaaataagtaacaaggaactaaatttactcgatcggctgtagatatcaacaatatttaatccttatatcgatatatattcaaatcaagtgactgggatagatcggacgccatgccgagacagtataaatcacttagatcaaaatacatattaacaacaagattatatatgttcatagcgtagccgatcatgtagatctagcatgtatcggctaatactccgataccactctatattaagatattaaagcaagtaagatataccaaacagaagcctaatatactttaaatgcaacaagatcttaatataaaggcagatttaacatgtcaatcaagcgtataaggtaaaagtagttaaatcaggtaagatcggctgaaactccgatactaccctaatcggcaaccagaaggcaggctagagattatggttctaagcacgacttaatagatcaaactcaactgatgcagcattaagtatgaaaagaagaacaatatctagacaatcaagccgctggatgtttcatagagtggtagatatcttatataatctaagccaacgttgctatttaacctaatcagccgccttctactaacagatgttagcgattatagattagataatgatattgtcaaagattatataagatatatgataactcgacgaattacataaacaagattagagtatcatagagatggaagcactaatcccggaaacacaagccgtcataacaagttttacctcttgttgaagattgaaaccgatgcagctcaacccgaaagcaagaactcgtcgaaataaaactaaagcaaaaagggtggtgatgcaccgaaattgtattgaacgtgtgtgttaataattacatagggctcggggtctatttatacccgagaattacaagatatgtccatattggacactactcttatctctaacaaactctaagataccataagtctttgcggcagacttttgcccaagtttatctctaaggaaattacataaaatatcctaattaatagatacaattgccttcccatgactctatccatgcacggcaatcatcttgaagcacaccaactcgaacccgatgtcgtacac

SEQ ID NO: 9868 - DNA, 1191 bp, Oryza sativa
tccaattttttttcacatcattccaattttaatcaaacttccaattttaacaatccttatctttgattctgcttcgactccatcttcatctccgatgctgatattaccaaatttggtcattaacacatgcctcccaagtccgggatatttggtaatgttccggatttgccgtataccgactccgagcaagtttcgcactctgccgttttccaactgctattccagcgctttaaatactaaccgttgtccccaagaaatctcacaccgtgacttccattttcaccgcttaagcaaaactctgccttctctctctccggcgactcctccgacgcacaaggcgatccccaggtgacttcatctacggccagatctccacctgcggcgatgtcgtcctctgccagcccatctgccgcaccatcagccgagtacgctgaggtaagttcctatcggctagatcccctttcttatcatcagatcggttttcccttgccatatattgctctcttcttctcggttactttgaatttgtagcatctttccaatctagttgcaattcccagcctgtcacatgaaaattactactttctcggcccagtcggcaaccctgatcccaccgagttcatcattggtgaaaccaataggattcctttcagattaaccaacccagacctaggtcactggaagaataccttcaaatcctggccgtctctagagaaaacttcacccgagaaaagttggacagcatggttcaagcgcatgtcggctggtaaaagagttcactgggacgaaatcggaatcggccaagcactcgaccttaccatagccaactcagctaaggacgaacccctaatagcagctgcctcttatttctggtccaacaccatcaacgccttcttgttcaaccaagagccgatgaccccaactctcatagatatcatcatgatcacaggcctggatgtcacctcatcggctaaccctatgagcctgaacacgaaaaaccaatacgacttcaagaccaagagcataggcggctggtcaggctatgtagcagcatatatgggccaaggtccggtcacccctcgagaacatgtggcctttttgctaatgtgactagaaaaattcctcttctgtggatcaagctgtggccctacaactaattggcaatttgtagctgaggccttagaaacaaag

SEQ ID NO: 9869 - DNA, 1278 bp, Oryza sativa
atctcatcaaccttaatgatggatcggctgctcaatctccaaggacctcctctaggcagcattgacaacataaagctggcgaaccttcaggagcaaagcatttgacagatggtggggcgaatggaagctgcacttattccatcaatcggcttttatgtatatgacagacctctttccaaatgttgtccctcaagtaagtcttaactcacttgattttcatttgaataactgcctagctgattaatccttggctaactttccttttgacttgcagacaacagaatcctctccccctcgccaaagcaacagtggcaaggatattgagtatgccctaggattgatccctaacggaggtgggccatctccccccgtcatcggctataatgcccccaagacttcagctcttcttcaagagctcatcagagatccagccgatgccggcaagaagaggaaaaccagatcatcggccgtaaatatttcagccccagctccaaataagaaaactaagacaaagaaaaccacaccagctgatgatctgcctgctctagatccatccattgaacaaactctagatgaagaagtaattgaagacgacgttgatgaggccgcagccgaagtaagtgatatagaaagaacaccattggcttcacccaaacagacccctccaactccttctgctccagtacacttttcaagagtaagcagctctctttgatcccttttgtaatcattttaccttatagccgattactcacaaatttagtaattgcagaaaaagaagactgctgtgaagaagaaattgactgcaacaacatccaaaccagctccactagtaagatagtctcaattctttttacaaaatccttaactctgataatagccgatatcaactgacacttgtccttttcagccttctcctcctccttcaccacctgtctagccagaaacaagcaatcgtactccatcggctgcagacagtcataatgttgaagaagaaatacaaccaactgctcctgctatcccggtaagtctctttttattcacgaacttagatcggctacatctatttagctctaactctctttaaaccattattgcaggtcttagccgatcttttctctttcgacattagagactatcttgatgagacagaagaagataccacaagcaaagccttagctcccttatccgatgatatgaagaaaatttttgaagacatctctcatcggctagaggcataattggatagcttggtggccgactgtggttctatccgag

SEQ ID NO: 9870 - DNA, 13399 bp, Oryza sativa
  unsure (1)..(13399): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtctcctcgtgctaattaatcaaacccacacaacactaatcaacgcgatcccccacatccgctaatcacaacagaacacctgtaacatattaattaactaactaatctccccgcaaaaaaaaaaactaactaatctacatccatctcgttgctcgtgcctaatccacatgactaattattggctaccatcacggccggtcgatgtcagagcagcgagatgaattgtttgtactcgtacttgaccagattaataacaaagataatttagctacaatcatggatagagaatcttgtttaacaaaatatgataggcgaccagtagatgtacactgcagcccatagcaattcaaaaatctccgtttaattgacgagcgtgcgagcgtgggaggggaccggtggtctccaggccgttggttggttggttggttatggttgatgagcgatcgggccaaccccaacatggagacgctggactgcacgagcgtcgcagtggacggtgtggtgccgcaacgaggggatcgaacgaatcaacgaatgatcgaaatcctctcggaatcggtagcatctctttaaaagcgacgctctatcggttagtaattaaacatatttatcatttaaactactaggtattgatattaatatgatgcagaaagaattaaaaaaacagattttaaaaatagtctaaaacggtacaccttatacgaaaacgacgctcggtcaatcaggaatttcatcttaaacgaaccatatgtaagccaactcactgggcaccggtagtaaccaacgggaggggagagcaccctgagtttactaggatttttcactggtattggactataaagtgacgcatttgcacgactataacaattttgttatgtgtcattaaacaattatatcatttgacgtaaaatttgagaacaaagtaaggttattttgagaaatatctttactgtatggtggagcataaatctacacatgtattagaaaataagcaaggaatttgaattagtttctcggaccatcatcgtcgatgggtctggattgggtcttaggagattttatggtggaatgatctacctctctcattggtggagcccgccgtttcagcagtgaactcgacctgtggctgcttcaggacacagtagtgtagggattgaattcggttcgctgcagtctgtagcgtgaacactatatccgtttgatcttatttcaaagggcagagtcatccaaaaagcttcatgcagaaaatagatgtaggagtacttatgccgtgtttagttccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcaacgagaggaggaaaaagaaatccggcaatcacctggcgggaaaaaagaatgaaaaaaaaaatgaatattgagagagagaaatttgatggacacagaggaagtgcaagatcggaagcttcaatggattaataattcactaatcacccagaataacaataataatgtacacgtacaacaagtacagctacaatcacctgcactgctgctgatcgctcgctcgctcgtgcatcgggatgcacgctaattacaaaacttcccgatgattagcggcggcgattagcgatcagcaagggagcaaacagaagcaacaagttccggattaagggactaatggcagattaattagctggagctagtaggagcaggcgaccctgagcatggagcggccgcggagcatgccgcggtacagcgcctcccggttcgccggcatcgccgtcgccgccgtcgccgccgcgttcctgcacgacggctcggccgccgccgggcgggacgacgcattgctgtcgttgtcgacgacgtcggcggcgaacctcacccgcttcttgctcccgcgccgcgccttctccctcttccgcttctctgcaagaaacacacgtcaggtgagaggagagtcctaaagaggagccaagaagaacagcacgcacgacggcgcgctatggccatccatggcggcgcttttgctccgctcgctcaccggaggaggagaggcaggggcggaggcgagcaggggcgtcgtcgtggtgaggcggcttgttggcgcggcagagggagaagaggacgagggtgccggagagcgccatggcggtggcggcgagggcgaggccggcgtgggagccgccggccgacgaggacgaggacgacatgggagcagctcaggtagctcgagctcggcgcgcggcggcggcgactgtttggggaggtagttggttgggtggttaaggcgagagggacccctgcactgcactgcaatggcagagaagcccgtaggcacgctgctactataatatactacccgctactgctggttgctttgctggagctggactgaggttggtcaagctagtttattagggtagttcagtacacttatccaactggtaaattattactactactgtaatttttaatttttttctatttttattttgggagaggtttgttttgggttggaatcattggtgcagggtacaatggtcattttgtagttgatgtttcaatttgtattcagttttccatggaagagtgggggctatatatgcatcttcggcagtggctgtatgcacgttgttggtgtagaggctgagtttaatccattattaaaaatatatttgtcatttggtaattccgtcgataaaaaaatgcataggactagtttcttatcggtggatctacatcgagacttataataaagtgcgcgagcggccctaaacttgtgcgggtatgtcatttaggtctctaaactttcaaaatgcattttcggttctttgaacttgttttgggtgtcatataggtccaaacaagctccaacctcttccatgcgctgatgtggtatgccacggtagcgcctacgtgttagtcggatccacatgccagttacatagaaaaaatataattagaaaaaaaacatattttctcgtctctaccttcgaatttttatctttttttctgtctacctaagaggagaaaatatggtttttaattttatttttttatatatgcttgacatgtgaatttcactaacacgtaggcgttaccgtggcattgccacatcagcgctatggagcgggttagaacccgtttggacctacatgacacaaacaagtttagagacctaaaaaatatattttagtagtttggagatctagatgacacactggcacaagtttcgggatcgcccatgtgcttcactctattctatatggataacaaatgtcttgattgattgtgcgtttgtgcgtcaagtgttatagcggctgcgataaccagcccagccgagcaggtccaaattggatgctattagaaaaaaaaagtgtaaaacgcttttgggtaaatcctacaatgaaatttatattcatgaaattcatatttgtttgaaaattcggtcggtctcaaattattgatacttttatgtgcatatatgaattcatcaccaagccagtccatctgaaatacataaattgcagcatagaagatacaaagggtcatacaagaaaccactctcactagaaaagaatagaaacatgggaggtagtagtagtaaataaaaccaaataaaactagaatttcgtatttaatttaaatctgtgttcccagcattcagaacctgatgagacagagtggaattctgtggaaagctggaaataatacccctgtggaccaggtcatcagtcatcaccaggacagtttttgttttccttctttcattccccttgttttcacttgcaacacctgtaaatcctactgctggtgttatccggcacggcacgatgaattattggggggatgtctccctcttcttgctacctttgacatgaggtcagataagacggtcacccaatgttatgtctgcaaaagatttatgcttttcccccctcttttacaagtgaatggaggccaaggttatgatgaaaatactttttttaaaaaaaaatcttggatcaaattccaaattaattgaggccaagaagtaagattcagtgactgcttggcagcagggcaggtaggacaacatatgcaggctctcctgatgcttttactttgctaccagttgctttaaatgatctagtttgcctctcatttctgcagccagtatggtttttgctccaactagtaaataaaagaaaaaaaaaggcaaggtcctcgaatttgtttatgattttattacaacctctatactttcagaaaaaaaaaacaggttagagctcttactcttgctaggtgtatcatataaagcagttcaaaaaagggaggaaaaaacaataaaaaccgtttaaaaaaactaagagaaaaaaccattccaaaaaacacagaaaaatacgggggagaaaagattgaactatgtccatcagatctggttctgttgaaatgtacagtcctgtgactagtgtactggtctaaactattaactattgtaagtattattgagcggatcagcaccttacaaggtactccctccgtttcacaatgtaaatcattctcgcatttcccatattcatattgttgttaatgtatggaaaatgctaaaatgacttacattatgaaacgcaggaagtattagactttcacaagcttctcccatcaatcagaccaaatctccctagaaaaacctaaattatgtcacgttttggatcccattaattccatcgtcgtcatcacgtcggatccaatgatcgttaattgcatcagctagcttaaccaaatgaatattatttgtccagccaaatggcccttgtacctgccggaaactgctgtcctatgtagcggtttcgcgtgcaatttgcaacgaaaaaggacgcccatttggcgatgtaagctgacatcgatgcccccaaaagagcccaataggaagctaatggaggattaattaatgaaaaaaaatccttgaattcatgtttgcctctctttttttaattcaaattatacatgtatgacgtatagagcagcatgcatgatgtaggtgtactgttagctgcaactggaattatccaattccagttaaagtggaaccctaacccaattatttgagatctaggacaagcaaaccgcacttttgccactctttttctttttttcatgccgctgctagctaatggagaacacatccataatcagtatctaaaatgggtgaggtacatctatatatcctttaggataataagattttttttctaattatttctataaaactttaaaagcaaagtcgatctccttccatcccctcctcacaccacgtgtgtataaccactggattaaatgatttgtcctcaatcaccattctaactcatctctatttatatgggcatgttataacgtacgagcgtgttattagaattatccaattccattttcttggtttccttctcgcataggtatatcatcatgacttcaagaatatacaaagtacatatgacaacttaattaaaccgttaatatgccaccttcctatctcctgaagttgaactatatatgctgtgaagaaatatatggatggttgaagtagaatctaattcaatattgtcacatcgtatccaatgatcactgcaaccaatcaggatgaatattcacctatagttcccgataaaaaccgatgttttatgccgtgttctcttgtgatagcttagttagaccgcaacttacaaaagggacactatcgaccaaacgctgacgtctcttgaaagagatgttgaaagagctcaacaattgaagctaatggaagatttgttatgaataaactctagcaaatgggaatatcctagattccatggatgacgtacatacagagttctttttcccttttggaagttatgggatataggtagctatagtactagtattgcatcggaaatgcttgcttgcaacgacctagagtatccaattagagtggaactataacccaactatttgcgctcttgtacaaacaattgctcttttgaagctcttttcttttccttttatgtgtaatggaaggaacaaccttttgcactacttttgttgtctagcattgtgctgaattcactagttaaaatggttagggtactcaatgtaccaagaaaacaaggtcgacacaaattgaagacaatttattgtcttatacttttgagtttacatagatttatccccaattgggaaattttggacacctagtagccaacaatgccatttataaatccttggtaggaaagatcgtccatttctcatgtgacaataatttcatttaaaccatgaaaagataatcaccttcagttgtattcgaattagtggcgaagctttttttttttttttttgaggatcttgtcctccacatacttattatatagtactccctccgtacttataaagtaagtaatttaggacaatgtttaagtcaaaccttaggaatataaatcatgaataactctcaagttgttgagtttgaaaatgtaaaaattatatgaatagatttgtcttgaaaaatactttcataaaagtacacatatatcacttttcaataaatatttatagaaacaagaagtcaaagttgtgttttggagaccgtgtcgctgtccaaacgacttactttacgagtacggagggagtacctttgtttcattttgaccttttttagtcaaaacaaataaactatcaaaatacattcaatattagatgtaatgaaattaaattaatgctacaaatgttattatatttttctataaacttgattaaagtttagagaagtttgatgagaaaataaaaatgacttataatatgaaacgaattataaacggagggagtaatttttaaagtaatataataattaatatgatctaaaatagctaaaaatacacaagctatccgtgcccggtgacacatcaatgattggaattgggttaactaatgatctaaaaccttagaaagaaaatttagagaaaaaataccactaaaatacaagaaattggaaaatatagaattggcatgaactcatgggaaatgtttgcacgaggtatgtcgattcagctgctgtcctggtgttcttgtgttagataatcctacaacctgcttttttttttccctggccctctctctctctctctttttttaaacacctgggccctctctctctatctctctctctctcactctgatgattacttttcccaggcgtccttgttcttatcccctatccgcccggggatttgcagtacaaaacccaacacgctgtggctccccttttgtactgcgtccctgctgcctatgatctcattggtggccgaccgcggcatcgacggcttcgtcacggaaagaggagaggagaggctctccccgtcgcctgccaagtgcgaaagcggaggagaaagcgaagcatagcaaagagagagatcgctgccgtgccgtgacgcaaatcgaagggagggtcccgcgctggctgtcacgttgggagatcctatggtaggagtacggtggtggtggtggtgacaggatccgtccttctagggcgtcccgggagacgtcgctgttgggagtttggggacacttgtcgcctctgtggtgacccggcagattgggattgggatttggatccggtgcagtacctagtgtgactgcaacataagcagtcacattaggaccttttgatgtaaatctgagggtccaaaatctatcaagtattgttcacacgaaaaaaaaactgtaaaactagcatcaacattgtagcatcagatctagaccgttcattgaaaaaatggatggctgagatgatgtgcagttcctaacttgcagtcacagttaggacttcactaaatctcaattcatcagattgagaggtcatcgctgcttggtgtggtaaaaccgtaaaattagcagtgctaggatcctaaaacctactccttctttaaaattaaccaatctaacattagattaaaagtttctttttccagatttataatagtagatttaggtaatgtctccaatcttaaattgatttattttaagatagaagtagcacgtgtgaggtttttttttttacatcagacagatataaagaaattctctatttctagaggaccattcacatggtaacaacatgacaactgacaagtagatttgtggtttcggcttaccacatctgagccatgcctccactttagtcaagcccatgccccacaacagagctacacgtgtcttgcaaaaggaatttgtgtctagttaagacgatctacttacaaaccgtattgagtgaggccgtaccctcgagttccaagcagtgaaggccaaatctggaactagggagaggcggagtatggttagatatgtcaaatatgaaagaaggcggcggtgctcactgccagggacaagtgaagagagggtgaggaagatggctgatgatgagggagggagaaaaggggcccaccaccatggatgttgcaccgatttacctctgcgccaccctaatcttattatttcgttgctccacgtcgcctcgatctgaccaaattcaacaagtttgtagctagcattggcacgctcatgaccagatttagcgaggtctttgcttgtttgatggttgacggtgaaaaatcgacctgacgataatctcctcagccctaaccagccttgatctatgctgatggctagctcgtcggccgaagaagttgaggtcatatatgaggagaaatgaagcgatgacggtgcccaagagtgcttgttggcatgtgccaaggaggagcatgtcaggagagaaaggagaatatgggaaatggtgaggagggttatgctaataccccatctttagagtgtttaatgtaaaattatggacatagtgtatataaattgagataatatcgtgaactaaaatagaaattgatatgggcaacttgtaaaattaaagccactacgtgttattggagaggagtatagtctccgtctatgtgttcttatgagtggcttccactaccgttgctaccctattaaactttagtagttttcaaaatacatccactttaaactctatcaaaatttgataagcctacaaacaaatacatccataatcactaaaatttggtaacaacataatgccaaactttactaaggttatttctggcaacaattcacgtgcctataaacactagacctcggtcagctggtcaagaaacggcgatttctaaatccaaaagggatagtggagaagcgggtggacgagagacacgagacaacgcaagaggctgtagccagcatcaccagctagcaccaggaacaggaagcttctgcccggtttctccctacgtctacatccccggttgcccagttcagctcccctccacttctcaagctcttccaaccgagtagctttcatccaactgcgagagcttctagaagaccagaacaacccagagactgtgaaacatcaacctctcgaggcactcaactcttttcatcaagaagcttccttctaatcatactgcacacatggctgctcaagagtttatctgaattgggagtatccaatctacatgccacacagcagcacaaggcctctcatgagtgaccactgatgttctgataacaacaggtaaacaacaatggcagctgacagcacaccatctccttgctctgcacaaacgttggcagctattgaaacttccacaagtttctgagaatgccagttcagaaagtatggagcaagccacagtaccactgcttatggaacaagagaagactgccatgtaagcagtccagaaagggatcaacttctaacttctaagcacatatatatacatgtacacatacaatttgaggggcattttaccgtctttacactgctcaccgggtcatttgcgtattcatttaacagggtaaccataaggaagttatattggtaaagctggcagattattacatacagtaggcattgacttttttggcatgtagccaaggggcaatacaggcatgtataaccagcaccctttctgcagggcaatttcgtcgtcagtaaaggtcaagctcctctttaatttcaggagcacaaggaatggtaaattaagttaaagagtgttttcctgtgttttacagtttgactaacaaaactcaccccaggacaggggcaaaataagccttcaggaattcacgaggaccagctaactcggagcaaacgatgccttactgaaatgtcaaaagtaaaggaaatgagtcataaagaagagaatttgtccagatctgtgagaacatgagttacaagtttaaataactgaacaaattatcatgttcataaactaactcttgaattagaacagtatcataattcaccaaggatcaggccctccgtccacatataaggtattttgactatatacatggacaagtgctcccaggtgcatagctaaaatccccttatatttgtggacagagagagtaggtaacatagttcatttggagtggaattgaaactattggcaaacaatattgcagtaatgctatgaagttggctccaataatacaattagaacctgacacatgaaaagagccagctgtatattcgacagatttcaacaagcatatttgttatcagttgcatgaattgtatgggacaatgagtacaaactaagattcgttaaactctgggcatacttagtactagtttgccacggcaatgctcccaagtcctgaaatctggaatcaaggctcataacaaagaaaagataattaaattgttgtttttattcctattattttaagtaccagggcatctagaacagaagtaccacttatacatacggttttcaaggagacaaaatagaccacaaatctcataacgtttcaagctaactattctatacaagttaataatgtttcttcattcaaagcaaacaacatttcatttcatcaccttataaagtcatatagagatcatgcttccaaacagaactgatcccattgatattccaggacatacaaatattattaacaggaaaaaaaaatatttagtcacttccacggcaggtgattccgtgattggcacatataatgaaattgaaatgtcctaatgtttagacgctctcttgtgtgcattaatgtaatagacaagatcggaggaggaggacgagcaagcagatttagctgcaaaaacagtatggaatggatttccgtctgtacctttcaggttctttggccattaacatatttgattccagatctagtatcagtcaaattcgatcttactttggccattaatatgcacacacatttaacttatactgggtccatactcatacctctgaatatcctgcagcttaactaaataataaactaaagtattaacatagtccttttcaagtctttcactttttttgaagtctattcatgataccaaggtgtattcagctatgatacaaaaaaaaagttatgcatacgatagctgtctcttacagtatgttccacttctagaagactaaagtattatagagtattaactatccatatgagcacagttaaactgtacaccaggatcagcaaattttaggcatttagcttccagtacccactgggtttctctgtcacaggatcaagggaaaaaaaggacaaaatgctcagttttcaagcttgctgattaagcataattacataagctaactcctaagaaacatcatcagctctagtcgctgtggctgctaatataagctatgttgttcactattcacttccaagtatgtgcagcagcataaagtagttgtgtatgtacaaaaaggagttgttataaagaacagaagggcatgtcaagt

SEQ ID NO: 9871 - DNA, 13181 bp, Oryza sativa
accaacttcgctcttattttctcctttgctcttcataatatattctttcagcatttcataggcataaaatcttattgcgctttctggagcaactttcacaacattcaatccattccctctaaaaaatgctaacatgccaccctggctccatatatccttaattgaatgcatgactgtagttcgtgtagtctgtacttgcatgatcactttaaggcggtcaagaggtgcagttgcagtacgagatgcagcacctgcaatccctcctgcaatcagatatttacttgcattgaccgacttacttatgccttctggtataacagcctgttcacctatatctacaagacatactctttcccagtgatgataaatattctcaatggttacttcattaggatatagcaaaagaaagtccctccactcttcaaaagtaataattccattgttgtccttgtccacatgctcgacaaaccgtgcaagctcctcatcatcaatctctatacctgcaaacaacaagctgacattgcttgtaagatatattatggatgtgcaaacaataaaatctctaaataacccaactatgaatatatttaagacttcaggcaaagcagaaccaaggaagcaaacaatgtgtatgcttttttaaatttgacagaaggtatatttttggtagaagataccataaattaataaggtatagctaaataatgcaaagtcagattgtgctctcctgcaagctcaacatccataggaaagaaaattatttttggtcatacttgagacaaaaatatgatcacatgaagttaagaacttaagatgatagtgttttcaactctgaatgaagaattgtaatctaatatgaattgctccgtgatatggttgaaattaaaaccatcttaactaaatgttcaatgcaaaaaaaacttcctgaacaaagaccgccctaccacatttaatctttcttctcagccttttgagaaatattctattacaaaaatcatccacgtcaagctttggcatgagaaggtatagctgatataccagttttatcattattagttctcaagtcaagctagtatgttactccgtaccagttcaaaacaaatcataaatataccgcctacctaaattcaccttaaggaattccacttagataatgcattggccagctacaattacctctaaatcgaattcatataccccgtgctaaaatttgaaaaaggaacatggtactcaccatggccatctttcactaattatgcaaggccaaaagtttgggcccaattgattggaagctgcttcagccaccttcttgaagtgattttatcatgtgagaatgcttcgacttcacctgaggcactcaaattcggttgcctatactacgaaagtcttagtatgggaacatagtcttggatctatatgctgtatcaataagggattcagtcttctgaaactaatagagttcgccttgaacagggaataaggaaaataactaaaacgtttgcactcttaaactgcctccagtttttggactctgtgacaatctaatatctaacaagaaactgataagtctttgaggctatatatttgctctcataactatatatcacaagattaacgaagcataaaatccaacattaatcagtcaaaaaatgaggaaccaattcaacttattcagtggaagcaggttattgtaatgaatctaataaaatatggaactcaatatgtggaactgcttaacaagagaggatttaggacaaatgcaacgcatcaataggattggattctatgagcttcaacacttatatatggtagatgaacacctaatatgaaaacctgtgagcggtggcaaatacaaggcttatcctgtttgatgtgatggcaaatacaatgtcttatgttgatcagccctagttccagtgaatctaactacagaataattacattcagcaggcaataatatgcaatactgataggaaaatgatttcagagatccaagttcacattgcactagtgaaacgtgatcccgtaggatcatagtcatgccactactaagtggttaggctcaatccttcctcaaatatgtgggaaaatggacaaaatctagtagcatgttaactgaaaattttcagatgctcccaaggttccactactcaatgtcagtagatgacactgttctaaaactcagccctaggctaggtaccagtgtaccacctaggtgactattgggcgctaggtgcccggtggccgcaccaattaggcattatatggtgctttagtcaaccgaactatccttgagggctcttgtgctcatattttagtgttctattgtcttaacttttatgtgatatgctcactaattgcttggtttcactagtcgcgttggacctaggtactggacatgccgaccatctagtgcctaccgccttattgaatgttccctacaagtaccattaagctccattggtatcagtacattgttcgccgcataaggacttcttcccgtcttcaaacattacaacacacatctacccatcgagtaaaccaaaaccaaaaaaaaggaacaattccaatgtatggctacaaattcaccacgagcatccagcaacaatcaagtaaagtaataatgcgtttgaaaccacatttcgccgaacacgtcagaatacggacagcggagcgacgtgtgacagcacgggaaggaggcgatcaatggctgcggaaggtgagggtgaaggtgaggcgagcgcatacataccagccttgacgagcgcgtcccagagctcctcggggaggatgcagccgttgtgctcgacgtcgatggcctggaagatgcggtagagctcgagctccttgtcgtccatgtaccgcctgaagtcgtcgtacccgacgcggccgtcgcggtcgcggtcgcaggcgcggagcagctcccgcgcgtacttgcactcggcggggatctgcagcgcggcgagcccggcctcgatctgcgcgtagtccagctgcccgcgcccgtccacgtcgaagaaggcgaacatctcccggatccgcgcctccctctccgcctccgtctcgtgcagcgccagcagcacgtgctccatggtcaccgcccccgccttccgcgccggctcgcaccctcccgccgccgccgctgcagccgtcgccgcctccgccttggcgacggggggcggggaggcgccgccccgtgggtccaccgcgtggaccgccgcgccgggcatggcgccggcggcgaggaaggaatgggggtgagggggaggcggcggcggcggcggcgccggtggtggtggtggtgggttgggttggtttggggaatggaatgggaatggaaagaggaggaaaggttggagaaggggaagggaatatacgtggatgtgagaggctgcatacggtatgtatgtatgtatgtatgtatgtatgtatgtatgtatacgtattggaataccgtattttttggggctcatggaatacgggaaaaatccgtatgtgtgggaggggcgcgcggctggatcggtatgggcagccgggtgccgtgcgatgggggacggatggttagatatccacgtggtcacgtggagatcttttctcgaataataaacaatactatttgaaatgaatgaattcttccgcagttccattccaagaagcctggaggtagttttggaaatataaagaaaaaaagacaataaaaacaataatattgcattgacactacaatatttatatcttatatgtttactattttctatataccattattaatcctaaacaacattagacggagtagaaaagattttttttaaaatataatactagcactatgacataatcacatgaaacattttcgataagactttattggcatggttctttttctgactgtgagaaaaaatgaggggttgataaaaattatgctcatgttacatctcgtgtctcgttagacctgtcatggcaccgccacctacatcacttgccattgtccataggacttagctacattggtgtcaccgacacgtcgtgtcacattgaactcgctacccttcactggattgtcttctcctcagtcgctctctaagcatgccatctcccaaacacccttcggaccttcacatcacaaaccctacacgtaaaataccaacccgatagaaccgttgaatagcatcgatagtctaaggtgaacgttttgtatccatagaaagcactcgtcgagacagttcaattgagaggtagaaaagaattagatatttgttggtatgttggtatgttggtatgattcggtagagaagaagcaacctgataaaagaaacaattttagggcccatttgaatcacaggaatgaaaaaacggagaaataggaaaaacataggattctgacaggaatgtaagtgtaaaacagaggattgcaaaacacagaaaaaacataggaatgaccgtttgattggaccacaggaaaaacgtaggaatttgaggagagataaagactcaaaggatttcttccataaggttctacctcttgttaaaattcctccaaaacttatatgggaagaggcattccataggaatttcatatgattccatagggttcattcctttgattcaaagggttttgtaggaaaaattcctataggaataaaatcctctaaaattcctataaatttcctttgaatcaaagggggccttagaaaagaaaatctcatatatttatatttttttcccttgagtgctaagaccacctcctgcatataggtcgggtggatggtccaacctcgtgcgagttgtgaatgctagtagtccccttcgtgtatcttgctggtgtctgaatacatttgatcgagccagcgaagtgcaagtgattctgatttcgagactgatggacagtgatgtatgatggtgtgatcacgagatttgtttctactccctccgtctcataataagtgacgtttttgactttttatttgtaacgtttgactattcgttttatttgaaaaattaatgcaaatataaaaaaagataagtcatatgtaaagtacttttgataataaagcaattgacaaacaaaataaataataattcaattttttttaaataagacaaatgattaaacattgacaaacaaaaactcaaaaagacaagtaatatgggacgcatgtaatagctgctgctaatactacttaaaatacctaccgtcctgtacaaccacctcgtgcttattttcagccccatcgttttgtacgcatgtgagaatgagctgtgatagataggtgcctaattcaagaatcatatctaaggtaggtccaggtactccggttctaatattaaacaaattcctagtacaagtatttcaaatagcaattacaattattttgagctagtatgattgaccaatatcatacttggctgagtctcatattgtaggaaaagttttccacgcacaagaaacgacaaactcattagcacataatttattaagtattaactatagtataaacttaaaaaatagatttatttaatttttttaaataacttatatatagaactttttttttaaaaaacatactatttaacaatttgaaaaacatgataacagaaaagagcagggcctggaaaattttcactctccctgcaaagattacaaataaaccccaaaaatgaaaattcatgatctacatgatgtaggctgagtttttgtttagataatggtgtaggcttcagtttattacaaagaaatattttcaacggggaatccatggttaatagtgacctgacgatcctattcatctcgaacgatctttgtagcgtcctgcccaatttgcaccttaaatatttcccctggaatctcaatcatgccaacgtttggcttattttgtttggaggatgtatggacactgagaaatggggaataaatatggaaagggataggcttaatacagaagaaagggaaatgaccaaagactatggcaaaagcaggaaagctgggaagcatcagctggtccaaagcagagcaggtctggctaccattttctccaaaacttccatgttacaactgaaagaccagatcagcaccaaaatttggtgcaacaagcagcatctgagagggtgacactctgacagggaggttcctctgcaacagagctataacatgagaaaagtgcttcttgatcttcagagaatcacacagcagtgagtaataagcattggcatagtcagaggcaacttcaagccttcaagccaagaatatacttgaattccgacaataggtcagggaaattacaatttacaaggataagcacactggcaaaaggtaatagaagtactaaagcttctgacccaatgtgtcacctattgatttacctaactatccaggagtcaagtcaagtctgaacagctaatgagctagtcactctccatttctccagcaaagcatacctataactttcagtgctccccggatggatcttggttcatgcaaaatgctaggaccggctgaaatcttcagactttcagataagctggctaaccaatttcagactacaagcatagcataggggtgatagggtcagagtaatgcgaggtagctttcactgctgaagctgaatgagcaagtcactcttcaacaaagcatacctacaattttcagtactaccaggatgtatcttggttcaggcaaatgctaggaccagctgaaatcttcagaattccagacaagttggccaaccaaattcagactacaagcagtgcatagaaggtgataggctaactgtaatgtgagatagctttcactgctgaaactatcaatctagaaaaagcaccgacctagtgaaagaaaattcaaggtaaacagttcacttagaaatttcaaattctggtcactggccagtgatatagaaatttcaaattctggtcactggccagtgatattaaaaaggtaaacatgcttctgaaacttactgctcctactaccttttcccagaatgtgacgttgttactgtcaagtatagaaatccttgtccatgtattaaaacttggagaaagcagcatggtttgactcaagattacaagtctgctctgtcttgtccaattcaaagattggaaaggagatatacagttcatgcagaaaaaatttctccagacaggcacattgaccatgtgtagctgacaaccaccactcaaagctgtcttgaatcccacaggtaaaacctactctactaaagtacgtaccaagcttttgacacaatgtgccacaacaccaagttgtccaagacttcagtagtatgtatattcaggtcaaatctccaacaaaacatgcctattatttcagtactcccatgaggaaaatcatgattcgtgcaaaagaatagcatcaactgatcaaccaaattttgactagaaataggcgtgacaccctattattgggctggaaattacatatctagaagcaccacccaacagtgcaaggtttccaattatgcagcacaatctgaatcttgctactctatgtggtgagaaagggaggcaggttccccttcgtgccgatcactggagcctgagtgtcagggaagaatttcgctcctgggagctctgtcaccgtgccttccttcgtaacacgtaccgggtaggtcagcaggtgcccaggaaggtcatcgttaagctcatcgctcgcgtagaggtcccagtacttgtcagccatcttgttcaccctctgaacacactccaggctctctgggttcaggaagttgtcatgcagcatgccaaggtgctcataccacaacgacatccggaaaccgtggatttgtcctcttgcaaccaggcccttggtgttcaggtggcatggctggaatgcacccatggcgatctcggagtctctgcccccatccatggacctctggttgatgttggcagatccaacaatgatgtactcgtcgtcaactgaaacaaaccaaggatattaagttccaacaaatttatctttatcaacatgaagcatgtcatcaaagcacaggtactgaaataagagccagtgacaatatattgtctatcttacaacaaggaatgaagtaattgcgtatgttgcctagtgacaaggaaattgaactgtgatgtaaaagtctttcctaacatgtgggtgtcgaaattggggcaagtagttatgagtgtataaacataaaatgggacattggagatccataagaggtgctgcgattctgatttgtgaattcttaaagatgttaaacaatgcaaaaaagatcatgtgtcagctgcaatctggagtaaatttagagaacttgtgacaataatgtttttaagcatacctatcatcatcttggagtgaacatagatcatgaaccggcgtgccttctgtgccttagcatagtctgtgccatccaaagggcgacctgcaggttcatactcaccattcaactttacttccctgttccctaagcagaagaaggtaaggtaatccctcgggtcagcattgatcctcttcgcctcaagtgcaacggcaatatcatagtacatcatctccattgtcctcctctgccaatccagtattgcctgcactgatccactagcaggaggtccttcaggccacattggcagcacaacatagactgcaaaacgctcaccagcttcaatcttgttcacaatcttcagagaaatctctctgggaatcagatgcaacgcctcaatgtcttctggtctgatgccatcggctttccatgcaaatgagctgccaaggaagtactgattctcgatgtagatgaagttcttggcgcggcgaattgcgtggatgtatgcatcttggatgctcctgtcaatggtgttgttcttgccactgacaaggcctgatcttgcagcagcctctggagtgctagggaagccaaagcaggcgccgccatcgatggaccggaacaactgaacactccaggcctcaccgtcatcggggaacatcaccggagacggcggaataatgaggtcggccatggctttgaggtctaggaggaggtccttgtcaccgccttgcttcctccaccgctgctcgaagttgtagagcacatcccaagccgcggggccttcgatcttggagtggatgtcgtgccatggctccctcggcccgcccttggtgacggccgcgccgtcgaggttgggctggtggaagtcgctgtggtgcgccgtgtcgagcgtccggaagagggagtggaactgcgtgtcgtagcggccgtcgcagaggtcgaggccgccgacgaagctgacgatgcggcggctgccaccgccacgcggcactggcatgtcgtggtcgacgatgacggtcttctggtggtgggtgatcatgtaggcgatctgcgcgcccatgatggcgctccggccggcgtcggggttccgcgggcagaggacgcagcgcacgtcggtgccgcggaagtagtccgccgtctcggcgtcgtgcgtcgacatgaacccccacttcatgccgagcgactcgacggaggtgcggtcgtcccagaccagcaacagcacgcgcacgccctcgctggccttgcgcttgaggagctcgccgagggtggcgtcgccgccggggcgctgccgggtgccgtcacggatgagcgtgatctcggtgtacacggaccagccggtgaggtatatgaggtgcttggcgttgctgatggcgtcgaacacgtcctcccagcaccgcccctgccggtagtacccgccgccggcgagcgggatcctgggcgcgaacgcgtcgggcacgtgcgcgtcctggtacagggtgaccctgcacccggggcgctgcgagaagaaggtgtacggcacgccggggtaccgcgcgccggagacgcccctgccccacccatggcggtcgccggcgacgtcgcggaactgcagccgcacgtgtatcgtcggcccgtgcgagatcctcctcctgccggcgtcgaggatgtcgaggcggcgctcgatggcctcgccggacaggagctccctgacggggaggtaggcgcggccgatgagcgtggcgccgatgggctgcgccgccttgacggagaacaccacgtcggcggcgaagtgggcgcagtagatgtggaacacctcgtaccaccgcgggttcaccggctcgtcgtcgacgacccgcgtccgccccacccgcgcccggccgaggtcgatcgtcgcgtacagccgcgtcgcccccttcccgagccccagcgagtcctcgaacccttccacgaactgcacgaacggattcaaaaatcaaaccaacaccaaaattcgcgcctcctcttggattgctccaaccaaaaatctctcaccactaaattggatcgattttgagctcgaagagagagcgggattcgactgaccttgcggaagatcccgggggcggcgccggtggcgcgggtggggttggagaggtggtcggcctcgaggatggtggcctcgagcgtgccgtgcagcagcaggtgagccatggtcgctcctcctcggctccgccgccgcccgccgccgccgccgccgctgccgctgacgtcacctgctcgcggcgcgtccaatacgagcttccctccgagacgaaggggacagtgcaccaacaaggcgaaaagcgtccaattaggagagggaaatggaaaaggagagattctagccttttattttgatttcctttgctccaaagaaaaagacgtggcgtttgggatagttattaatgtcggatcggaaaatcccgtaaaaaaagttggaacagaaaatatttgggaaattggaaagaagttaaagggagaattttgggaagaagttaagggctgcttcatacagaatattaactaatttatgtggagtttctactatgtaaataagttagtacaataacagactataagccagctataaacatatatggagtaaataaatgagaagagataagagcagcggacaatagatttgtagccacctgtagcacagactataagacgcaatgtgtgtatcataggtgggaccagatattacttgtatagtagtatatgtttataggtaactattgtatgaattaactattttatgatttagagtcagtagttggctatactattaaacttgctctaatatagaggatttggggacggatcaagacaagaaactaataaaacatgggaaggctttggtaaaagaaaaatacaatattggcagggattaaactttgttgtctttgaaccattttgaaccattttaacaaaccaattaacttaagtcctatttggcatgccttcgaatttgatattcggggtagatttaaagtttgtatgctaaattatattgtgtaaaagaaaaaaaaattctaaacttcatataaaataggaatgaaatgatttattcaaatgttatcaatgtaattgaaaatctagatccataaatttgtaaagctagtaatatccaacttaaaacaaaaatgagtccaaagccgtgctaaagatgggtgagggttgtgaacactgaacactcaccttccgacatagaaaactgagcaatgaattagtgcacgattaattaaatattagctaaaaattaaaaattgggttaatatgattttttaaaaacaactttcatataaaatttaatgtaaaaacacacagtttagcagtttggaaagcgtgcgcgtgtggaaaacgaaggagagaagtttggaacacccacagacgaactcagcttttattggggagttaagacctttgatctccttcccgtttgcatggttataatttatgggacagtagaaataccccgtagcaagtcactatagtaacatgcaacgacgatgataacttaaacacactagtcatatccatattcatatctagaagtggttttgttaacgacgagtatctactgatggacccacattccatattattccatagattcgccgctatgtctcatgacctaaagttgtattctataaatacgtcgtttcctattgttgaaattgactaatgagtactccctccgaaaaactatatcctaggtcaagattatcatatcttgatctaggttgatttttttgacggagagagtatccaaattcattgttttaagtggtatcaaatccttatcttgattgtttttttttaacggtggaagtactgagtagtgattactcggagatgagaaaaatcggtggaaatgtgcccactaaccacgcatctaatcatctaggagtatcacactatcacacacacacacaccaccgtgacaccaggtcaccaacaaagtgtcaaccacaagacagacaaagaccaccagaaggcacaattggggggtccaggactgcccaccacgagcataaacgaggcgtacgcatccgcatcgcaatcgcaatcgcaaccacatgccgttcagtcgctgtagatcgtggagctggaggtcaagctcggtgtagtacgagattcgccaccacgcacagctcccggtgcacaagaaagcagaacggagcccatgcatggaaaaacgatcagaattcacaagaacacaggtgtgtgtacctgtgacactgtgagcttttgattcgcatgttgattgatctgctgcacatgttaattaaccgtgtggcatgaacgcatgcatgatgagcaaacgcttcacaggaggaaattaacgatgcattttatagtggatgcagcgtggaggaactggccgatcggagcaatagtttcttattcccaaagacggggagacagacgtaaaggaatccaatgacttgcgctttcggtatctagcttgggtctattcttcagagttattaaaagattgtgagaatttagttgactagtgagaacttagaaaggactactttctcagtttcaagttataaaattttctattacccacatttacatatatgttaatgaatatatgtcagtatttattaacatatatatgaaatggaggtaatagtaaattgttatgcatagtacgtccaatcaataggtccagcacatacgtatatatgtatagcagtactcatttagaaaaagaatgggctacatttaaggtcccacatctttcaacgaaaaagagttaaatttttgttacactctaaattacatgtaattacactgtaagtttgaaagcttatattgtatttataacttagtactcactccgttttaaaatgtaagtcattctagcat

SEQ ID NO: 9872 - DNA, 34703 bp, Oryza sativa
atgggcactggatcctggataaaaggaaagctccaaatgaaccctgctatatgtacgacttctccatccaatcggcgtatgaccgaaacggcagagcaacacactacatgacggcgtgaagcttggtatgacgtatagcatgttgctaacactgcgtacgccgtagtcgtccaaaagtcatcacatccactaaaacatagaacacatcatcatccactaacaataattacatatcaaatctcgtgcaagcatacaacatcatcatctacaatttgttgaattctacaaatcaaaatacaagcatatttaatcatcacccccacatcatttccataatattttaacatatctatttattatttttataatatttagaatatattcatacatatattccgtagcaagacacctcagtatctcacttagtggttgaaaaaaacaaggcaaaatgaataatttaacctcatgtttcccatcatataactaaatctgaaatctcctaaccgctctatatttttttacaacccagagtaatccagcattcaccgttttaccccagaatttccaccaaatgtcatataggactagcaaatccagtaaattttaaagccatccaagccagtgtaatgtaacatatgctcgacagcaattaaaaaaaaactgatacattactcctagcctcctaggatgactaatgcttgctaaaaagactatgaccaagctaaaactttcaagagtgattttgctatgaggtataagaagctaatacatttttataatgcaagatttagtacaacccagcattggtttcttaggtaacactgtaacaggaggtatagggtgtgtttagttcctgaaaaaaattgaaagtttgggaaaagttgggagtttcgaaaaatagttggaagtttatgtgtgtaggaaagtttttgatgtgatatgatgtaatggaaagttagaaattttgggtagttgaggtgaactaaacacggccataaaacaaattgttacctcccaagaatcgtaaaattcataaactgtcaacttgaaataagccgatgaacataattcatattagaacagaacactacatagagctgtagaattcaaccggagatagattacattgcttgaaacaacaaactctgcccaaacccaaagcagagcaacactctagcagtgtgcaggaatggcaactcgatcacacactcagagcaacactctacgacgtgaggtaggggatcatgtacgccgacgacgccaatgtcccgatcaccttcgcctccgtgtccgggaagaactcggcgcccgggagcgccgtcacggcgccgccgtccttctcgacggcgaccgggtaggtgagcaggtgtccggggaggtcgccgtggagctcctcgccggcgtacagctgccagtgcctgtcggccatcgcgttcactctccggacacactccaggctccccgggtgcacgaagtcgtcgtgcagcatccccaggtgctcgtaccacagcgacatccggaagccatggatctggcctctcgcagcctgcccattgacgttcaggtggtgtggctggaacgctcccatggcgatctccgagtcccgcccgccgtccatcgaccgctggttgatgttggccgacccgacgatgatgtactcatcatcaactgataaaagaaaaacattgaattcggtgtgaaatttagagcgagtttaaccgtagtggttgaaatttgcaactagtagttgttgttacctatcatcatcttggagtggacatagatcatgaagcggcgcgcgttctgcgccttggcgtagtctgtgtcttgatccgggcgatgtgcaggcacgtactcgccatggctcttggcctccctgttccccaagcagaagaaggtgaggtaatccctcgggtcggcgtcgctgtgattggccttgagcgcgacggcgatgtcgtagtacatcatctccatcgtcctcctctgccagtcgaggatggcctgcatggcctcgttgccagggtggccctcgggccacatcggcaccacgacgtagacggcgaaccgctcgccggcggcgatcttgctcacgatcttgagggagagctccctcgggatcaggttcaccgcctcgacgtcctccggcctgacgccgccgccgggcctccacccgtaggagctcccgatgaagtactggttctcgatgtagatgaagtccctggcgcggcggatggcgtggatgtacgcgtcctggatgctccgctcgatcacgttgttcttcccgctcacgaggtcgaggcgcgccgccgcctccgggctgctcgggaagccgtcgcacgcgccgccgtcgatggagcggaagagctgcacgttccatgcgtcgtcgtggtggtcgtcgttgttggtgccggggagcttcaccggggacggcggcgtgatgaggtgctcgagggcggtgaggttgacgaggaggtcggcgtggccgctctgcttccgccaccgctgctcgaagttgtagaggacgtcccaggcgatggggccctcgagcttggagtggatgtcgtgccatggctccctcggcccgcccttggcgagctcggcgtcgtcgatgctcggctggtggaagtccttgtggtgcgcggcgtcgagcgtccggaagagggagtgggactgcgtgtcgtagcggccgtcgcagaggtcgaggccgccgacgaagctgacgatgcagcggatgtcggagccgccgccgccggtgccggccggcatgtcgtggtcgacgatgacggtcttctggtggtgggtggccaagagtgagaccttcgtgcccatgatgaagctgctgccggcggcggcgtcggcttgccgcgggcagaggacgcagtgcacgtcggagtcctcgaagtaggcgagcgtgtcctcgtcgtgcgtctgcgcgacgctgagcttgatgccgatggcgtggagcgcctggatggaggagacgtcgttccagaccagcatgagcacgcggacgccctcgctggccttgcgcttgaggagctcgccgatggtggcgtcgccgccggggcgctgccgggacgggtcgcggatgagcgtgatgtcggtgaacaccgaccagccggtgatgtatatgaggtgcttggcgttgctgatggcgtcgaacacgtcctcccagcaccgcccctgctggtagtgcgcgccgccggcgagcgggatcctcggcgcgaacgtgtccggcgcgtgcgcgtcctggtacagggtgaccctgcacccggcgtgctgcttgaagtaggtgcacggcacgccggggtacgccgcgtcgccgacgccgccgccccaccacttcccgccgccgtcggcggccacgtccttgaactgcagccggacgtggatggtcggaccgtgggggagcttcttcttgtcgtcgccgaggatgtcgagcttgcgctcgacggcctcgccggacaggaggtccctgacggggaggtaggcgcggccgatgagcttggcatcgacggacagcgcgaccttgacggagaagacgacgttctcggcgaagtgggcgcagtagaagtggaagcgctcgtcccaccgcgggctcaccggctcgtcgtcgatcacccgcgtccggccgagccgcgccctgccgaggtccaccgtcgcgtacagcctcgtcccgccggggccaagcccggtcgtcttctccaacccgttctccagcccttcccaccactgcaaacaccaacaccaaccaagcacaaagattcagaaacacagcaagaatcagggaaaaaatgtcggcgaggtggatgatcgctatggatggcatcgacgagtgaccttgcggaagccctcgggggcgttgccggtgaggcgggtggggttggtgaggttggtggcctcgaagatggtggcgtcgagcgtgccgtgcatcagcaggtgagccattgctgctgctccttcagtttcagtgtgtggctgtgtgcacttgacaaggctgggaagaagctcgcaaaacaatggtgtggcatgaggcttgacgggctgccaatttataggcaggcgctgctgcacatcgcggagctgaccgcgtacgtgctagattcagaatttcagaggatcaatcacaacagttactaaaacacacacacacacaaaagatcaacggcaacagcacacaagctcgtgaagcacgttcgatcgtactaggaaaatatagtaaattggtggggtcaatgcccaatgagatgttctgtagtttgttcactacagacttgcaggcttcgaagttcaaagtgtatatgtctctgacatctcagttttctcggtgtatagttttcttctgcctcttgacccgtcttccccctccgatttcggtggttcgccaccggcgagggtcggaggacgggtccaaccgtcatcgtcgggtcccttaatagtatagtgtagttaggttggttctttctcgtcgggtcttttatgtaagttgggttcttctcgagttgggaatctgctggtgagattccatggttgttagagtggatggcagcggcggttggtggcggtggagatgtgggaatatactatctgtggaggaatcaggcggtagaggcatcacctctaggcggcggtggcttctcatggcgccggcttgatgtcttctcggctagtagttcaggcctctgtcctagaagttctggtggtggcggtcaaaggcacctactatgcggccccttagcctgatcgtagtccaggatctcctgacccgtggggttggcaattggggcgtcttcggttacatcgcccgaaggttttggcggtggcggttggcggcgcctgctgtggctaccgttctacttggttagaggttgggatctcctgaccggtgaggttggtggcttagaatgacctcgactgttgcagctacttatggtggccagcgacttactaatggagagtacaatggtgacggtggatgggaacttccactggctaggttctagccgtcgggatatgcaggtttcctcatttccaacctcatgtgtcggcctaagtagacaacagttcattcgccatcattcgagttcttcggtgtttatgggtggctggatttggattcttcctctttgtttcctagcagtagtatccatgtagggtttgttgttcaggttgagctcaagctcctcaaatttaatggcgaactccatggagaattcctgctaagctcggcgaagcccataccaaaatctatggctcagcaacaagcctccaattttatgttgtttctgtggaggcaaccaaacggaatcactggttcgtcaagcggtgtgcacgtcaaaggagacccaagatgcaatcatcgcagcaatgtcgcatctcactgtcaatttgcacctctgctactgcttagattcaataggaagtttgttacattaggctgtgttcttttctcctctttcccaactcacttccctcgtttttcatgcgcacgctttttaaactgttcaacggtgtattttttttgcaaaatttatatatataaaagttactttaaacaatcatataaatccattttcaagttttttaggctaatatttaattaatctcactataatcacgtgttttgttttccgtgctgggaggcaagcttgagaacctaccctcccgaacacagccttagtgcagtttcttgtcatttggaaatagatggttcgatgctttttagctaatcggtttggtgatgtgctagagcttgttcccctgaactttatcgttattaatgaatgtttatgttttaaaaaggaaactgaggaattttagagaatttaatgataataaactaatttctatgaaaatcctgtaaaatttatacgttctaaataagcatagattgcacatagtcgagaccaaaggtgaggtaatgcataccacaaaccaaaactagtttgcttgaaccttgtatctcaatgggaatgggcgagataggtgtgctttgtgctatgactagaggcattatctaccgaaattgacacacgctagactgatttgccggtggaatcagccgaactaaaagaaaacaaacattacaaagcacatatgaccacgatttgttgatagggaattcgacgataggaatactttcatgggagtcaaatcagacaactccatcctctaagaattcatttctattctcaatcattcaaaaatgcataaggattagcaacatattctatgctgagtggtttatagatctcgactcgacctcaagtccttatcgactcaaacatgagccactaccgcaatgacttacatcatccacaagaccacaaagtgtaacctataaatattccatatctcttcattcatcatccatagggaatcatgcgtgctaatatctactatctccgtcttaaaatatactcgctctatttcatattgcaataagttgctttgattttttaaaactatttaaatttgatcaagttcataaacaaatttaataacatctaaaacactaaattagtttcgttaaatctaatattgaataaattttaataatatatttgttttgtgctgaaaatactactatgttttttataaacctatagttaaacttaaaagagtttgacttaatataaaacgaaaaaaataataacctgatactgaaccaactttataacttttttagtcatattgccataagatttctccggatatacttttatatactcttgcataaattgttatggaactttggatgcgcccctaaaacaactgaaagttgcattgcacgggaatgatcacatcacatggacgcggaaactgccgggcagcatagaaatattataacacgttgatctagaattctagatccaagcttgccgctcgtgtaaagcgtggggggtggcctggatcgagtaacagcaacgacctgcatgcagattggaatattggatttggatatgataaaaatgcagatagcagcatttgacgaggtgcccacttggacactcgcaacgctttctctattggcggagaggaatattgtaataagcgctgcattggcattttgtttgtttattggattgatgatgcattggcatttggcagttttggtatggttctctgcagctgcgcttcgcctattggtgccaatcctatgcaagttggcacttggcacagtggaagtccagtgccttttttttttttttggagaactcagtccaatgcaagtagactgcaagatccccccctatcctcgcccaattgggcccatgaaaacaaacactatgttggaaatggagaaaggtgatgcatggttgaacgtgattatattattgattggatgaagagaggtttagtactagtatataataacagatacaatagcagactataagctagctctaaacacatattgagaagatgaaagaatatagagatgagcgacgggctacacatttgtagccatctgcagcatgaactctaagatgtaatgtctgtatgataggtatgaccagataatatataatagtatatatatttataggtaactattgtatgaattggctattaaattgactatatatgacttagagttagtagttggctacttggctatactattaaacatgctttaaatacctaacggtgactattaaaactttcacatgctaactactgaatttggagtatatattactagatgtcagtcttatttttttccccctttccttttcctagcaataagtcaaatttcatttcctgttatttcaaatagtgcacagctcaaatagacacatcaaacatgtgtagtataggaatggcactttgtacaatgtaatcatggaaaatgatcacgcaacaccacacatatacgcacacccgggattgtatttcgtgttttcttaacacaagctcaaactgacggagacagagagcagagataaaatccattaatttcgcttagaaaatccctaataaaaatatacatacatatatataatctaaacataattaatggtcattcctaatgtaataaaacatatatagctgaccagtaaaataacatatccatatgtctcaaaagataataaaatagacactgatagttgttttgtttcccgtatggcagaatggcacacgttttatgattttaagttaaaaaatggttatgaactacaattatttgtacatgttaattgaccttttatttcaaagtagacgccatgcacctacccacccacgagcaccaccacctctgcctcagcaggaccgtggcgggtagggttgtaagcgggccaacccacaaatttatttataggtcaaatagatgataacgaatggatttttgtgtcgtgattcgatttgcgtatttagagagatgcaagtggatcaatctataaactcatttatatgtcaaattaataggtaacccgcgagtcaaatccgtggattacctactaattttatctataagcgggttcgcagccaagcccgcttactcgctagcggcaggcaaacggcagcaccgttttgatatcgcttgccgccatggagccgcggcaagcagaacactcttgttttggctgcaaattaaacactgcatttaaactgacgttctttgctaacaacatatacttctcaattcttttttgattgctcctctggtctgatctgactatatatgtatttcactttagtgaaaattatctttgaagagtttgtaattgagcaacatgcatgcccaagaacccaagtgctccactgctcatactaccacaacgacatctgaaagcagttggcatgccctcttgcaactgtattcaggtggtacggctgttgttcatccactgtttgttgatgctggcagatggccagatccaacgatgatgtgctcgtcgtcggctgaaataagccgagcagtgaattcgatgaaaattcagagggaatttgatagattgaagcattgaaatttgttgtgctggaatattgagcaaacctacgtctgggtcctctgggagtgaacaacatacaccatgagctggcacatcttttgttttttgtttttttgtctgacgaggagttagcaatttcttaccaaagttttgcatgtttaaatttccggttaccttattcagaaatccataaccaccgtttaattagctttgaaagggagtgtcctatgggaaacaaaaatatggctaccaccttaagggtgtgttcggatgcctcttttcccaaccatttctctcgttttacgcgcgcacgctttttaaacggctaaacggtgcgttttttataaaaagtttctatatgaaaattgcttaaaaaatcaaactaatccattttttttaaaaaaaattagctaatacttaattaatcacgtgttaatcgatcgttccattttccgtgctcagtatgctggaggggaatgagaaccagctaacacaccctaacggtggtcaaatacgaaaccctcattttttaataaatggttacagttgactttttaacaaatatttaaccattcgccttattcaatttattttgcaaataaaaaaaatttaaatcatacttagagaacatttgatgatgaatcaagtcacaataaaataaataacatttgatgatgaatcattatatttaccaattgcaaattatctgccaagtttctttttttttttgattgggggggggggggcacaagctcaagttgtgtcacacgaggctctgtccttgacttaattctaatgtataggatctttaatatttttaggttcgtcattgtgtgatagtgtagtgtgtgatacacacacgatagatgtgtctatttgagctgtactatttcaaagacgaggaaatcaaatttgacttgaagctatatcaaaaacaaaaacctaaaaaggaaaagacggacagctcatagtttagtcgcatgtgacagtatttttacccctagtcaccgttagattagaaacctaactctctcaagtcttatccattattaaattagttcaaccacagttggacctcatcttttcgcttatacttatacttattagctaaaatttaaattttcaatcttaaatttaaagttgattttgggtttttcatcgaagtttattttccagtctttacttctagatcgctaagagcaagtttaatagtatagccaactactagctccaaatcatctagggtgtagctatatttatggcgccatatttttcatcaaaaaatagtcggcatgtatttacattggaagttcctaaattacatatgtaattttagtgtatttacaatgtaaatctcaagagtacatatgtaagtcttaaaattacatatgtaaattcaaaaattacatactaattacatatgtaagtggggtataaatgagttgtaactactctctaagtggcttaaaaaaatgactgtagcatatgtcgccacaattatagccaatccgatcatctatagccagtttatatagtatttttctctgtactattaatacatgatcccacatgtcatacacacattacgtcttggagtccgtgctgcagctagctatagatttgtagcctgctactcttctctcttatcttttatctctttaaaatatatttatagctggctaatagtgtgctattgtacctgctaacacgtatataaaagttttattcaaaaattacttttcgtttgcaaatatatcgtttgacttattacacgaataaatgaaacgatgggctaagttcaaaagtgtcgcaattaacaagcatatactccctgtgtactactccctccgtttaaaaaagggcaacctaggaggggttacatgctcctagtatctgtccagattcgttgttactaggaggggatagttgtctttttatgggatggtcacatcgttattttttttatggggagtacgttccaacttccaacttccaaggttagtgtactgtgttttgttttttttttcacgtgccaattggcaattttcctttcgtacgtgtgggctctcgtctccgccaataagaaagcgttgcaaatgtcccaagttggcaattttccttgcgtacgtgtgggctctcgtcttcgtcaatgctgctcaagtgctcatcatttgttggattaggcggtgcttggatctagggacttaactttagtctctatgtttagacactaatttagagtattaaatatagactacttacaaaactaattacatcaatgaaaactaattcgcgagacaaattttttaagcctaattcatcttgcgaattagtccaagattatagatgggttttattaataatctacgtttaatatttataattaatgtcaaacatcagatgtgatagggataaaattgtagtcgtatctaaacagcgtcgtactctactccactctaccccaaggtcccccacgctttacacgggcgccaggctttggatctcgatccacgggctgctgatcaaaagcacgtggtgccggtttctgcgtccgtgtggtcaccgatcagctccatgctggttcctgtataattttggcccctggctaacaagccaatttggagatggtgagagtgatactccctccgtttctgattgatcacctaactaaaaataaaatcagaatttatagattgattgttactccgtacataaccttgtcttcttcgtgtgccgtgcaaaattgtgtatataacctctccggcaaaaagaaaaagaattgtgttggcttattagcgcatgattaattaagtacccgtccgttccaaaatataaatatttttggacttcgacacattcttcgagatactactttgaccaacaatatctataagataaatatgttttaaataaaaaattgcatattatgatagtttgtttaatgataaaaaattgcaggaattcaaccatgcggatacagtcactactacttacgcgccttcgacatgtacttaagaaataaaaacactgaaattaaagtcatccggccccaccctcaccctctctagctgatgattagtcgattactgttttcctatagccatcgttatacacgagtttctgtggtgttagcgttgatcttttgctaatctctgaatctagcacgcggtcggctgcctataaatttggttgctcgtcaagcctctcatgccaccattaattgcgagctgcttcttcttcccgttcttgtcaagactgaaactcactggatcatcgaggagtggcaatggcggagcagcagctgatgcatggcaccctcgacgccaccatcttcgaggccaccaacctcaccaaccccacccgcctcaccggcagcgcccccgagggcatccgcaaggtcagcgaccgattccatggagctagatcgatcgaacctcgccaatgtttttctacttcttggttgccttctcatggtgtttgtgtttatgcgtgcagtggtgggaaggggtggagaagacgaccggggttgggcagggcgggacgcggctgtacgcgacggtggatctcggcaaggcgcggctcggccggacgcgggtcatcgacgacgagccggtgaacccgcggtgggacgagcgcttccacctctactgcgcccacttcgccgacaacgtcgtcttctccgtcaaggtctcgctgcccatcgacgccgcgctcatcggccgcgcctacctccccgtcggggacctcctgtccggcgaggtcgtcgagcgcaagctcgacatcctcgacgagcacaagaataagctcccccacgggccgaccatccacgtccgtctgcagttcaaggacgtcgccgtcgacggcgacgggaagtggtggggcgccggcgtcggcaacgccgggtacgccggcgtgccgtgcacctacttcaagcagcacaccgggtgcggggtcaccctgtaccaggacgcgcacgtgccggacacgttcgcgccgacgatcccgctcgccggcggcgcgcactaccagcaggggcggtgctgggaggacgtgttcgacgccatcagcaacgccaagcacctcatatacatcaccggctggtcggtgttcaccgacatcacgctcatccgcgacccgtcccggcagcgccccggcggcgacgccaccatcggcgagctcctcaagcgcaaggccagcgagggcgtccgcgtgctcatgctggtctggaacgacgtcacgtcgctgcagatcctccagtcgctcggcatcaagtggggcttcagccagacgcacgacgccgagacgttccagtacttcgaggacaccgacgtccactgcgtcgtctgcgcgcgccaccccgacgccggcggcagcatcgtcatgggcgtcaaggtgcccttcgcttccacccaccaccagaagaccgtcatcgtcgaccacgacatgccggccggcgccggctccggcctccgcagcatcgtcagcttcgtcggcggcctcgacctctgcgacggccgctacgacacgcagtcccactccctcttccggacgctcgacgccgcgcaccacaaggacttccaccagccgagcatcgacgacgccgagctcgccaagggcgggccgagggagccatggcacacatccactccaggctcgagggccccgtcgcctgggacgtcctctacaacttcgagcagcggtggcggaagcagagcggccacggcgacctcctcgtcaacctcaccgccctcgagcacctcattgcgccgcagtccgcgatgaagctccccgtcatcggcaacgacgaccacgaggcgtggaacgtgcaggtcttccgctccatcgacggcggcgcgtgcgacggcttcccgagcagcccggatgcggcggcgcggctcgacctcgtgagcgggaagaacaacgtgatcgagcggagcatccaggacgcgtacatccacgccatccgccgcgccagggacttcatctacatcgagaaccagtacttcatcgggagctcctacgggtggaggcccgacgacggcgtcaggccggaggacgtcgaggcggtgaacctgatcccgagggagctctccctcaagatcatgagcaagatcgccgccggcgagcggttcaccgtctacgtcgtggtgccgatgtggccggagggccaccctgacagccaggccatgcaggccatcctcgattggcagaggaggacgatggagatgatgtacgccgacatcgccggcgcgctcaaggcgaagaggatggacgccgacccgagggattacctcaccttcttctgcttgggaaacagagaggtgaagaggagtggtgagtatgtgcccggacatcacccaagagatggcacgccatatgccaaggcacaaaagacgcgccggttcatgatctatgtccactccaagatgatgataggtatgctcaaatctagccccgcaaatttcaacccttcaatctagtagtaaatcctttccaaattcacatcaaattctagctgatataggataaactaactgggtggtccacgcaattgcgcggctagcacccatataaaattatatatttttaatatgattttacttaaaatttattaaataattatctcattgtcttaaaattttgaaaaagaccaaacattatcatcccttgctacccttacttctgtcatatcattttttttattaccttgctcgatctaccactgtttctattcattcttcttggaacctttaaaaattagatataaaaacttatagttttagagtttattgttctgttggccttcttttttataatttctaaaagtcacatatactcctctacaaccatccactgcatcttctctttattgtcattgctattttaaaattcgaacataattattgtttaggttcgtttttttactttctaaaagttccactaaaagtcagggactttgtcactatactcctctacgactcgcccgctgccgtccttcttttttgtcattgagattttaaaatcaagcatgattaccattgggatttatttttttactttttaaaagcccgaaccttttaaaaattgaatcttataggttttagagttttattgtctcgttgggtttcatgttttttataatttttagaaatcccgtcaaacactgccactatactcctctacaacccgtccgctgcataatctttattgtcattgggattgtaaaaatcgaacataactaccgttggaattcattttttactttctagaagacccaccaaccatcgtcagctctaccattgtactcctatacgacccgctgcctctcatttttattgtaattgagattttaaaaatcaaatatgattattattggggtttattattttactttctagaagtccctcgccaaccgctttgactgattgcttcacaacctgcccgtcgtccttctttttaatcgtcattaggattctatttggtgttttattaatattttttagatgtctcatcaaccgccaccactctacttctctgtaggcttgttacttaattaatcttgtcatggtcttttctttcaatagtctaatttttattaccaattttagctatttataaattgtattcctaattaaattctttttttctttttctaatttcagaatttattttatttattattatgttcttttgatatttttattttttattttcaattttagttgtttcaaatttgtattcatactttaactctctctttaatttgcctaatttcggattttattttattctttattccgaattttaattaatctaccatttagttcttatatgtactcttatttcaatattgcttatatttaattccgaatttaagttaattttaaattgtattcctacttgaacttttattttcttttcttttttctaattttatttttttattctgaattgtaattaatctcgtattggattcttgtatggactcttctttcaatattccttatttttaattcggaattttagttatttataaattgtattcctagtcgaactcttcttttttctttttctaattttgaaatttatttttttattattccgaattttaattaatcacgtattgggttactatatggactcctctttccatattgcatatttttaattccgaattttagctatttttaaattgtatttctaattggactcttcttttctttttcttttgattaatgtgagaatttctaacctccacagcgaacgtggtgtcttctttcaaggctgttttaataatataatagatagatagatagatagatgttctaatgtgcttatcatgtcatttggtacctgtacttttcaaaaagtttttaaaaattgttcgtttgtttcagtcgatgacgagtacatcatcgtgggatcggccaacatcaaccagaggtcgatggacggcggccgagactcggagatcgccatgggagcattccagccacaccacctgaacatcggtggccagcttgcaagaggtcaaatccatggcttccggatgtcactatggtatgagcacctaggaggcgaaccgcacgacgacttcctgcacccggggagcctggagtgtgtccggagagtgaacgagatggctaacaagcactgggagctctacgccagcgaggagctccatgaagacctcccggggcatctgctaacctacccgatcgccgtggctaaggacggcacggtggcggcgctcccgggggcgaagttcttcccggacaccgaggcgccggtgctggggaagaaggcgatcaatccgttgatgacccccgatatcacctcgtagatcaggtgaaagtttgtgctggtggtgcatgcggagcaaaagtttgctagtcctacactggagtgatgctgcttccatcagaatgtgtttgtttttcaacggtgtaagttgtcctagaatgtcaccctctatgtaatgttgaatcttaattccattgtctaaaataaccaaatttgtaatgttactggaacaaattttgtaatgatgagtatgcacctgcaaatcgatcacccagaggaggccaaccaaataaaacatgccctggagactattggagctgaagttgcaaggctggccataaaaatgtttagggattaggactcatttggataatgggtaggaatgggattgggatagggaaatgagtgaagggctaggatgagataggaagaatggagggctaggattaaaagtaacctttgaaaggtacgaacaaaattcccaatccttctgaaacgggccctcataagtacattcttctgctagctttggtggaaaggaacaagtccattttgactccctcaaatattgcttcaatctaatttatatcactgaaccgcaataccggatatcttcacccaaaaaaaactattaaaaccggtgtagtttgactccctcagcggttttagaaggcggtttcgctaacgtggtgctttgacttggtccaacctattgagtcatcgtgtggggcccacctgtcaatgacccttatatctcttatcttcctttcctttcccctccatcggatctacgccacgccgccgcccctcttcccccttccactccactccgccccttagggagtcactgacatgtggttctcacatactgacgcatctggttggaccaagtcaacgtgccacgttagcgaaaaccactctcaaaaccgctaagagagtcaaattgcaccggttttaatagttgataggtcaagatatccggtattgcggttgagggatacaaatcaattgaacctatattgagggagtcaaagtgatcttattccttgttggaaatgcaaggaaaaagaagatagcaacccaggtcaattttagcccaacaggtgcggggtaatttgggccaacaaatgggttattttgatagaacaggcctccagctatacgcaacgaggaacatatcagtttcttttctgaaggaagggggaaaatagctctagctgaagtatatcctcgaataaaatttagaaatatacattatatacatgttttgaaagattcatgaaaatatacgcgtaccgcagttcagaaatacgcgaccggttgttttcctcggcatggagccgcgagaccgacggctgaaacatgcggcatactggccggtgccgcacagccgatctgcgtgaccgtgcggtgccgcgttgctggcgggatcgacgcagtaccgcgcgctcgtgtgtcgcgggattgttccggccatcggtctctataccgcgaaaaaaaatcggtcacgcattttcaaaccgcggtacaagtatagtttcacaaatctttcaaaatcttgtatataatcataaaaacgtaaaaaaataatgtacattttcaaattttattcgtgtatcctccagtaaaaaaaataccaatcgtttcggaaatattttattgggtgtagataaagatagtgtgtgtcgaattagcataataatttttttgtgtttaacacaaaaaatagcgatcaagtcaatagattagggtattcatatgtgaactactacatcatacagttaaccgtaacatgaatgtctacagggcccagctgttcttatctttgatagttcaacagctagcgttactaggcaggcagcccatgcgaagtattgaatcagggcaggacgttgctgttccatctcttcccatcattgaggtcgtatgtgatttcctttttattttaatgtttcataacgcattcatttgcttgcactataaaagcaagaggccatcaaacaagaaactgttcatcgcagcctttgccattgcctaaagcaaacgtgctgtagaataaatgagaactgttcactcgagcagtcgagcttaacttgtggcagaagcccagaaagataccagagacaattgctacaccagtttgcatttagtggtcactgtttcctggctgaagacagaatttttggaacgcatgaattttaatttgatttcgactcataaactacttcaagaaagaaattgtatttcagacgagcctactattggcgtgagcaataaaatgcatatatttttccagcttttttttaagaacatatttttccagctttaaattcgagatgacagacacaggatttcaagggtaagtagtcacgcaacaattgcagataaaattcaccggaagaatacgagataatatcaggagtggatttgttgagggaaaaaatgggttgagaatgaagtattaggccaagtttagaatatgctaggtataatatagctacgtatactattttttttttaagaaattgttgcgtattcacgtgaacaccaagaactccctaggtccatccctgagaaacttgtatagattaaggtcccgttcgaataaactaaaaaaagtggacaaacttttgataaaagtggcacgtttttcaaactgctaaacggtgtgttttgtgcaaaaactttctatatgaaagttgttcaaaaatatcaaattaatccatttttcaagtttgtaataattaaaacacaattaatcacacgctattaacacctcgtcttgcgtaaaacacttaatcttttatcttcatctccaggagattcaaacaccacttaatttgattcatagatatattttttttgccatagttgagtaaacatgagcttttacgcacaagaggtactcgacagtcagcggaacaacagtagatactagtactagattagataaaaaaagagtaaagtgcacacgcggtccctagacttgtgtggtgtgtcaactagctaggtctctgaactctcaaaatgaattttttggatctctcaacttgtctcaagtgtcatataggtctaaatgggttccaacccgctccatgtgctgatgtggcaggccatggtggcgcctacgtgttagtaaaaccgatatgtctgccacatatagaaaaaaaataacatatttttttctcctctcttttttcatttattttttcaaaattaaaaacatcattttctcctctctttttaaattttattttttctacatgattgacatgtggatcccactaacacataagcatcaccgtggcatgccatgtcatctcacggagcgggttgaaacccgtttggatttctatatgacacacatgacaagtttggggacccaaaatgtattttaaaagtttagggacctagataatacatatatatacaagtttaaggactgcccgtgcacttcactctgaaaaaaaaactaagaatctagctccagcttctagcacctatcatccaggaaagaactcgacttgcctgttcaaacagcctactccagctcaaaagtatcagcttaagccaaataaacgacaccaatcaagggttagccaaacatcaaccacatcaggttgaatatttaggttgattttctaaccagaaaagctggagctggagccatgtgaaacactccataacaatagcaggaccagggcgtgcaccgttcatcatgcaaggaatatacaatttttcttaaggagggcttagaggacccagcacagcaatggaggagagaagtccacattgtctccatcttaaatcttggcatgtttctgggggaggaggagatggaacttgacaaaattatcaccactcattcactcacaaaaagtcactataaggatctcaggctgtgtttagatccaaagtttggatccaaacttcagtccttttccatcacatcagcctgtcatacacacacaacttttcagtcacatcatctccaatttcaaccaaaatccaaactttggatccaactaaacacagcctcaagctttcaacacggtagctctatgtaatagtgtgcacgcatgcctgccgtttgtagccgcacatgggcgctatctatgtgcagacgtgcagttaacctgggaccaaaaggaccggacggaacaactcagccggagtagcccggcagcgagagtggacgttgccacacggcagaaaggctttacacggtaccaagattccaagacccctcaatgcatcaaatcatttctatcgatccacacgtctacatagatcaaaacaatgaaaaatacaaagtacatcgagtagtaagaatgagagaagatatatctgattgcggggtgtgcatgttgaggctggtttgttcagagagaacctcagatcctgggagaaagtcaggtcaggatgcagctaaagctaacactaaacaaggcaacaactactggtctactgctgctacaacagtggtgctaccacctggatgcactataatatatgcatcgtcatctgcatgtaatgtaactacccgtcgacagcctcataattatgcccggccaactctcctggcccttctcccctaacgttttcccaagtttccatgccaacgcttccggtgtccccccaagcaatattggtgatcatggccaggcacgtactgacgtacgtattcacacatatagattgttaattaccacgacttgacaaagcaaattaaggctagctacagcacagcacagaactatgacccattcttaaatggatcaaactatggacaacagtggctagctacgctaaagcacaagcaagcaaaacgtgtgcgcctgattggccaatcgatcctcacaatttacccattgaaaggaacgacgttattagaaattacagaaaaatgaagatccagccgtgttcatcgattgtccacgaaacctcgaacatttgcagcccaaaaatatcctgtacaatgcagcgagagagcaattaatcaaggggtcattttcgatgaggcataaggcgcgtatactgatgctgacctgccgctcgctcgcgcactcgataatcgtcaagaaattggccacgtcaatcacggccacgctatcacacgccagcgaccgacgcagtcgggcactatgtgtgtacacagggttggtggatccgtgtgcatatatgcgaggatcatatcaatgcccggtccagtgatcagctcactcactcactcactccaggccagctgatttgctgattaattcccatcggttgatgcagcatggctagtgagtaacgagccatcaccttccttagacgtttgtacgtacgttgctaccttcaactgctacatctgcatgcatatatcgatactacctctgttttagattataagactttctagcattgcccatattaatataaatgttaataaatatatatatgtatctagattcattaacatatatatgaatgtgggcaatgctagaaagtcttataacttaaaatggaggaaatacatatacagcgacagctctagtaaggccggtgcaagaacagaaactacatattttctacaactaggtattcatgcacgtatatttatgtagtcatataaagttctgtgaagatttccaacaagacaaagtacagagccaactcaagatcaaatgatcaatcgatcgagccctagctagcttagttttcgtgtgaccaaggtggcatgctggcattgtaccagcagtacagcgtacgttctggtagaagcgagtggcgtttggtgctgacccaacccaaagcacgagaaagccccccatcgtagttaattcgcactgcttaaaaagttcagtaaatttaaccaccactaccaggactaactttattgcgctgctgtcctagctaaacctgcccctcatccctgggatacttcaggtttcagtgaaataacccaagttagagctacccatgcattcataggatttgagtacttagtagttagtagctagtgtggcagtggagatccaattaatctaccacaattcgagcacatgtaatgtactacccgcaaggcagagctagctagctactcttctcctctcaccgaaccggatgcatttgccccgttgagtgcttggcaagggagtgatcactaaccactggccagacagtgccttctagttgcacgggaacaggattagcaaggggattaactcctagatgcaggttttgggcaagtccccaacaactcaaagcagtatgtgtaattgtgtatgcatgatataatgcagcttgttgaagcaaaggatgcggtgtagaacactgtacctcttgtggactttgtttctgacagaggtgtggcaggtctgatcatcgtcatccgtttcctgtaaccaaagccgcccaactcggacttgcccccaccgtttacctgcaaaaatgtgaaacctgcagaaaatgagatttaatcatcatcatcatcaataactgtagtgtcagtataaatgctgagagtatacagatcagaaatttatatataggggattatctgcaggtgtatatgttgtgtatgttgtgtacgggcgtgctaccttgcagtctgccaggctgacaaagagcaagcagccctgaaagaataaatgacaaagaattcataagaagatggggtgcctcttcctttgaaacattaatcaatacatttaaacctaagtcatcaacaaataataataactagcatgatggcccgcgcagattgcgcggctagcatcattatattttctctcatataatagcatatatgttttctcattatattattcaaatatattaaaatgacaacataattttaaattttgcaataactttacaaaactactaatgtgtaatattcatattgcattttatatacgtgttagttattaattatttttaagataaaattttagttatttgtaaattatatatattcatatatggactctagactcgtcttttaatatttcttttttctgtaaattgtatttctatatagactatatgttcttcttctaatattatttatttttatttctgaaattttattatttctaattgtatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatggactctatactctacttctaatattccttatttttaattccgaatttcagttatttcctaattgtatttctacatggactccggtctcctcttctaatattccttattttttaattccgaatttcagctatttcctaattgtatttctatatggactccggtctcctcttctaatattccttattttttaattccgaatttaagctatttctaaattgtatttctatatggactctgctttttctttttctccgattaatgtgagaatttctaggccatgagagcgaacgtggaggctcctttttctattcctttaattatataatagataataataatttagatctccatcctattcttgaagtgtggcagtagatgatgaggttgttgattataactagtaattatcatacctgtcacataattgtgaaggtttgagctagagggacccttaagattttcttccttgaatcgctagtcctagcatttgtactgacaatgtatatatgatcagtgtggtgtactagcgtttatagtgctcacctgtcaacggtttttactggacgacaggtcctgacagtccttggcaaccaccacaaacctgcctgcacttttccatgtaaaaaaaggagtgcgtgcatgtgtacgacgagcagcagcagaagaagcttccatccctgcaggaactcactgacacacgtatctgtgtggagccgatggaactgtaaaagcacccggacggaagccccattcaattcgatcggccggacaaacaatggcaacgaactcactccgccattaactccgtttcacctttttacggagagaagagcaagttcttctgctgctgcaatgctgtgtgcgccttccttgccgatgcgccatggatggatggatgattggctgcttgattggggcagttattgcaggccaactgctctgtcgaaagagtgtccctcggaaagtggctttagaagttggagtaaaccttgcagtgcatggcatacatacagcatggagtggtattaccttggttacgaacgcccatcaagtccatttctggagtagtacacactgtccaagcttcagtgtttgtacctggaaagaaatgcacattagccatatgcgcaaggcaaggcaaggcattgagcaaagttagattcatcagttactagtttagctagttagcacatacacactactggacaatgactagcgagtgagcttagctagctgatcggcgacaagtgacaaccagctagttagcaataagagctggtgatggttagctcatctcagttcatccttaggttttcctccagtgaaggccataaatgaggtcgccaagggcgtaggtgggggagtttattaccggcgtactggcagagaaggtggttatgccgctcgccacagttcaccgacagcccaccccagcagcccatgagggccccccatcctctttccatctatctctctcttccactaatctcaccaaagagtcttcttcacttccttctctaggcttattaacagcttatttctgatctctcacatgttcagttttatctcatccctcctgctagatattactgttgctggccccaaccaccctgcatggattacaacacaagtttatcagtaccactgtggttcaaagtagtgtatgtactggactcgtggagttatgaccacaaggaaattgaccagaaagttaattacaatgactgaaggtgtgtactcacttggtcctggcagagtagaaggagagtacaccaactagatctgaaccctggtgtgctactgtaccaaaaggctaaggccactgacagaggagatacgtgacagacaagtcccagttgagttactgtccaacccccaaatctaaccctcttctaccaccacccccactcgtgcgccacagcgctctcacacgcgcgccacactcatgccatgtatgtctatatatatgtgcatctatatatcttagccacattgaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctcctgtaagtctctatctcactagtgatgatcactagctagctatgttgctctgatgtgttatgccactgtcgtgatagatacattttgatggatagctagtggttctggtttgttgttgctttctttctttttttctttctctttcatggtatgttagtagctaactcaaggtgcttgggtgcgtgcatgcatgaatgatggatgatgttttttttgctacgtgcgttgtggcagtaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgtacttttgtggctttgctttttctttcagactacttgctggattttcatcaaaagaagatgaggaatatgatgaaggtgatatttgtgaataagacatgtttcctaaatggttttaaaagaaaaaaagacatgctttataggataatactcctacaatcatatctatgaactgttcatcttatccaaagatagtagtactccaagattggaaaattatggatgattgtcatattaaagacaaacaagcaggagaaatatttttcttcctgcatcactccaattctccaaccacatgagtccactcaaagggttaattgatcaaatgattaatgcaatggaaagaatttggtaagatagacatggtgcaaaacatagtttactggaaaaaagccgtaatttccgttactacaattcagtaaaataaatccatactccaatgttctggttctgttctgtcttctcactttcatcaagggaaccacctagtttattaataggaaatacaccaattcctgcaggaaaaaggtgttccaaaggaggccttagcatagtaaaaactataatgttttagagcagtcgttgccaccagaaaaagattcacttgtgtccacttaggggggatttgctgatagttaaaagcaataattatgcaataaacagatggccataactcacaaggcatcaactaaattgcgacagtgcaccagactacatgcattatgtcagtgtgtttattcacaccaaatatatagcagcacaccacacagtacaagcagtggtgtttctaactgtgatgccaaccctccgaaagtaaaaatggtgacaccaatccagcacaaacaacttaaagaacttcaagataacatcatacgtggcatatcaaatgaaaaagaatgaaagcactgaaatggatggcaaagatcatggtccccatattatttccccttcctaatttcacaacatacaaataggagcaatgaagcgcgaatcagctccacagttggttctataggttggtaatgcatgaagtcaatgcgaaagggcccagtcagttagttggtcagtcataaagtacgatcatgtcaaaaaaagaagaaaagaaaattaacaatatgagaggatacactattctaaggtcttggatgttgatgaaaacaacaaaggcactacatttagtagtacacgaaatgacaaaatggcatatgattaagaccttagtgaaattcaacgatggccagaaccaaaagctatgcttacatagtgagccaacatttaagttttgatgcttaaaataaacaaattggttttcctttatcatcatgtcctttcagcagaaaagtgctcaccaatttgtgtctcaatccatcaaaacctaataaatgggtttcttgcataaaaaccatcaaactcaaatatgacaaataattctcctaatatgtgctgcagaacaaattgttaggtgtatgatgttcgcctcataatttagagatttgatactcatgctactgctcctaaattttggaaaagtaacagctcacaactagtttcgccttgataccttgtggtgccacagtagctggttaaggacctcccatgttgcaaaagcatgcattgaatatgtccagtaggatagctgtatcggtccccacaacattaactctgccctttgcttcaatctcattcgaatcaatctggtgatgtcatcttaattaagattgtaaagcatatagcaccaagttacgctgcgctcttgacactgtcatccgccagatctacctaaaatagatcaacacatggtccatgtacatgccaattaatccattaatgtcattgtcaagtggctgtggacgacagaagtgtagcaaattagcaatgagccaaaaagaaaaggaaaactggcttgtttcaacttctgactaatgagaaagacactcaagtacacaaacatgcgctgaaaacaacatatcataacttgtatcagtaataaataagcatttcaaatgagcaacattccaattccagggggctttccgttctttaaaatctagtaaagaagttaccatctggtgagcttttgtaattattcttcaaagcatgggtagattagttggttaagatatctatttagtgaagaaactacaattctactaaaaaatatgtaaaagagatacagcatgaaagaattacccactagtctatcaaaatctgggaagatgtcaatgaaatatggattcacaatgtacagaacaggtggcctgcttggcttccatgtgtaaatatactctctagactctagactttatccagtcaatcttgtagcaaaagatttaggaatcaagtctgacacaacaatttctgtaaacaactaccccttttttggcctctgtaaacaactagcagtagaccagccagtgaccctaaatgcaaagcgttggcaagtataactgctactgcatgacaaacccttgcccctctgagggcatagtaccatggcctggtggtcctagttagttgttacattttgatgtacttacgtccattcaaaatgattacatgcttggcatgtcattatcttggttcatttagcaaccaaatctgtaaaaagtctaatttttaacaatcagttacataaaagtcaaagatatgcatagtcgtcttttacaatttacactaccttattaatccccacttttatattgtggggtatatgtgcagacaaactttagtaactttgactgatatactggattgaacacatggaagtgataccggtgggtaaattgccaatgataacattatacttttgccagattttgatcgtaaagtatataatatattaatgactaagtttaaaactcaagggctgaacatcaaacagaaaaaattgtaaaaataataaaatgtataaaactatacaagtctagtttgctttcactttttcaagtcaagcattacaaaccagcaacagcaacaaaaaaaaaaaaaaagaaaggccaagtcagcttgtttccaaaaattgtttacttggatagctgcagttttgagtttcatcacttcaactcctcaaaactatgaagaccaaccatttggagacatatttagtatattgctacccaagtcattgcagagaagcgagtttctcaatataaatgaccctgtggccaagaagtagtctaaatcatttcatttgcatgttgttaaccccaatgtagttgtcagtcacccgatgcatgtgtttcagaagcatggtaattgagtaaagcgatacaatgaccagctggtcaatttaactaacagatttaactgtgtaaactcatatgaacaatcagtgactgcaaggttcaactattgacagacaagaacacaggtgtgcagcaggcactatgatgtatcacatagaccagaggcaatgctgatatgcatttcctttcagatttttattgttgaagtaatgaacaaatggcaaagtaatagaagtgcatattgtctgtcaaccacagtttaaatgtagcccaattagttctcaagtaaattcaatttatccaaataaacaattcctataaaaaaaatttaaccacccaatgatcaaatttaaccaagctacaccacatctttcgttgttttgttctgtacatatccaagaacatccaaacaacaagtttgaatgtttaacccatataattaaatttgcaaaagtgaaaataaaactatattattgcaattcagtgaagggaagtaaaggagaaatctagccagactggtggaaacaagataattattgctgttcccggcaaagactcaaatagtaatagcttagaacaggttggcaagtggcaatataattaatttcctatattctggaaaaaaacaaaaagtagcacaaagtattgtaaaatgcaaatagagataataaagtaaggaagataagctattccatgccacacaggaaaagagcaatttccagggcaaaagagttgatttatgcgcaactattatataagcgagataggagggcgtatagtcttttaaggaggaaataaacacccaaatttcgagctaaagaggtcccaaacctgggttggggggggggggggggggtaggccgttgcctccacacctcataggctcccaccgagtgagctagtcccggttccatttgcaacagaacattggcaaccaatatccatgtcattttgtttaaaaagagtgtagagccacttcgaaatatggtaacatatcattcaaaattatttgcatgaagcaagcacagaaccaacagagctaaagctatatggcacaactctaatagatttcatataaattgaacaatggagtgaaggaaaatgaaaatcataccgtttttatttgactcatgtagacacaagaaatatgcgccagatagtttatacttttcatataaaaatatgctataaaagttgcatgtggaattgtggatcctgcaggctttcaaaacctgaacaagctctctctgaaaaagcttccagtcttcatttcatcataaagaaaattggcatatcctaatcacctattcaaggtactcttgcaatttgctgaagatattcactggtagaattcaaccagttaaaaaaagacccaccatacttttaagattcatgatctggtagaaacagttgaaagtatctcctctattggcactttcaaactgtcctcttgccatggacggaagcaacttttcaacatagtagcacggatttgcttcaagtttatctgctttagaaacactaattaaatatgaggaagaagttcttattctagaatccacaaacatgactgctaggagtgctattataacatatgtttcttcgagaactccagagtggtgaccagcttactgcatatataacttgtttgttcggtctagggattcccacaggtatatattgtagtactactgaaaatttgtcaacaggctaagaaagataaatgagctgaatgctgaatatcaaaaaactaggacagagaaatggcttgaatgtgttgtgttgcatggcctggcactcaactaaatccccttggccatcagcaatctacaatcagcaccatcaaaaactgatgcagaatgtcgttaggtttcacattgtaagatcagtcagtttactgtgactctgtgtgtgagagaacacatgtttctaatcctgtagttctcctgactcctgagaagaccaagaaaaactgatatagaatgtcgcaaggattcacattggcaagatcagtcagctgacttgtaaatctgtgtcaaagaacacttgtttctaatcctgaagttctcttgactcctgagataaggaactccactgcagttttaaaatgatgaatccttaccaagctgtcaatcactattgaaatatctgtttcgtaagctgatatctagcatcagaagaaacattatcttccattgtatactgccaaatggcttccatgcatactcatgggggaaggcataagatcattgcagaatctcccctgcaagtcatatgtgattgcacttcttgatcttgccagtacatgatatagataataagataaagtgggaaacagctgcctctagaacataagctctcatcaacaattacaatttcagcaacggtttgctcttctactgctagcttccgcttagaagcaatggacgtgagacggatgctcttgaaatcatcatcaatctggccacactttctactgccatcacccaatggaacaccttaggaagggtttctcccagctcaaaatatattggcaggaaagtctttcaggctgcagagtaatagccagattccttaaccagaggcataaaggaggataaggaccctgcatcatgcacattgctttgcaaagttacataaaatcaacagttacagtgccaaaacacaagtaatagatgaaatcatgaaagctgggatagtagcatatagccaactgtactagttcagcattggactgagaaaagttctatataacagattctactcacagcctttagcacaaaagctagccgattctactcacgtggaataaactgtagcaaggatcactgcactgcaattccacacataactctcttcaaacaccatgcaaataattagttgcttgctcaacgcaactctacaattttttggcagaaaagttaacccaacaaatccagcagaaccgactaaaatttgccgttaacaatcacaaaaaacaataacaatcacatttgcacattcgatgcagaaacctcgaaccagtcaactcctgcactccagcccattccgatttccgaaccgcacctccctccattgacgcgatcccgagttcccaccctaccacggttcagagagcagctagctttgcctaaccctgcatcaagctaaatctgcattccgtctcgaagcccgcccccatgcgaatcgatgcgggtcgcggcgttgctagcacaaccagcgcgggcgcccggcgatctaccaggaaaaaacccgagagctcagttgtgcgcgcgcggcggaaacccctctcgtggcgcaagcgtaacccccgacaccgccggcgcagagcaaggccgtgtctagtttcagggttgacgagagaggcgtacctcgcggcgcagcggaggccgccacgcgcgaggcggcgaagctcgttgccggcggcgaggggcggctcgcctgagaggccggccgggccgggagcaccacggggagagaatagaggagaaaattgagatttagccgttgtcaaaacgggtttcactagaatgccgcttccaaaaagtttcattaagatgccacttctaaagtagtttcgttaaaatgccaccatcaaatacgggcaacatgttacaatgccattttatccatttattctcagtttaatgttttttttaatatttttttctcgctgagatgaccaaaatacccttgatcttatctcatctctcatctctgtcttcctcctctccgtttggctcggcggcgcagttggggatagggatgacggcggcgcggctggggacggggacagcggctgcgcacccagggacagggaaggcggcgg

SEQ ID NO: 9873 - DNA, 6228 bp, Oryza sativa
aatgacggattaattaggctcaaaagttccatctcgcggtttactggcgagttataaaattagtttttttttattcgtgttcaaaaaccccttccgacatctgatcaaacgataaaacaggcccctagttctatggtggaaagggattagaacaagtgctacaatatgtatagagtcaatcctacctccttttctctcctatagaacccttttaagtctaacattgcagatgctatatgaggggtataaatcgaatttcaagtgcaaattgagaataattgcatatcaccatgagtaagtggaagcaagaactttttcgaattttgtttgagaaaaggagcttgtatttaacttatcatttggtaaaaggtaaaatctctacatgtcaatcatttacccagggaagaagagaagaggtacacggaagactgaaatttcaatcagcggttaagattaaacattactacaattttccgtacatttcacaatgcagttcttagttacttatggggttttccttcccaccaaaataaaattatagatttcccctaaaaataataaaactatagatatatatttaagacaaaatagatttgttgctagctcttactattactagttggtaccccgcgctttcttacaagatatgtgaataaatgcatattatatattatataaattgtagatgtatatatttaaataatgtgaaaatgatatgaaaataatgatttgacattgcttgcatcttgagttctaaaaataatgatttggttcatttaaataacaaaattataaatgatatatcatatttgtatgatatttaaaatactctagataataattgctagtgggtgatgatgtggtacacctgcatgttatttaaaattctctagataaatttaaaatactatagataataattgctagtgaatgataatgtgacacacttgcatgttgagttttagaagttagtgaaattaactttataataataagataggatgttgtgtaatgtttcgaaaacgctctgcaccagtagggccagccagagaaaagtacgtatatttagctagtcatatacttagatggttccaaattgattcagttcattcatagcccattataaagaagcttccatgtttataagagacggtcgttgcagtcctcaattctaaaagaaccggttagttgaaccatggtttagaattcatattaaaaaaaactatttactccatcaaaaaatatatgaacctaagagtggtattcatagaattagaacgtatcctatccagcaccatattattgtattatgagtcaatacagttctgcactacattcatcacagatataatatttactatagcttaaatatagtgggcaggtgataaattaaaatagtatttcacacatataggaacagcatgatgctctcctggtccaaaacaatcgagaagatgattaggatatgccattttgatgccatctgcagatcaatgttccatgctgcagttacattgaaaaccatatcctccggttatcttccagccccatcattttcttttaattctaaaccatccaccaggcaagttgctgctcctcatcacagtggcaataatgtacttaatttttttctattcttcgcgaaaaatacgtgcctgcaggctacagtgcaaaaagatattactgcatctagaaatttatcactagatattatccatctttaaatttgaactctataaacttgtcttttttttgaaaaaatatatgtaaaatacctaaaagtatgtcgtattaacatagtgtgctcatcctaaatactccaataatcacaaaacttctgtataccgtgatctaattatccaaaacttattgatcttcaaagtgaaaaacagtactcctagtactagccaacgttgatgggtatttagaaggcaaaattggttatatagcattaaaagttcacgtttttagttttatagcaccgaaagttaccggttcactttaatagcacccaaaattcaccatgttctcatttttagcacttccgtcaatttttccgtccgtcttgatcgatattgatctagccacacacacgatatgacatttcttgatctagccacacacacgatatgacatttctacctctcatttacatgcattatacttgtacttgtgaggggtagaaacgtcatatcgtgtgtggctggatcaataacgatcaagacggacggaaaacgatcaagaattgatggaagtgttaaaaatagaaacatggtgaactttaggtgctattaaagagaaccggtaactttcggtgctataaaaccaaaaacgtgaactttcgatgctatataaccaattttacctttttaaaacctggagtattattttccatcagaaatgctcctgctcgaagtattgctacaactgtacaggtgagcacggccactcccatctccgtgattgcgtcaggcgatgagaagaatatgcgaggagaggtgctcgcgtggattcgggtcattttcgtatttttcaggcggagtccgcaccggccagtaggctgaggcagctgttgcttcttggacagttcagagtttcagagtttcagaaattcagatgatgggggaggacggcctcctgtttcttcacgtcgcgtcgaattgtactaaaaagggtcgtcctttttcgagagtgatcctttgtggagcggatctcgactgatggttttggtttgccggggggtttatcgctctccaacgggatgcgattgggatgggcggcaaacgggccggctggatatttttgcaacaacggcaggttttctctctggctaaaatcgttcgtatacagactctgtaatactccctccgcccataaaaaacataaaaaacaaatttagaatccgatgtgatatattttagtactacgaatttagacatatgtatacctagatttataatactaggatttatcacatccagtatatgttatttttttttatgtaatggagagaatatgacccaacgaagacatgatcatgtagtgaaatacttctaattaagttaacacatttctcgtatcctatctatgtatgctggtgtttttttaattagaagtgttctctttcaataaaagatatagattaaaagaaagtgatattgaagttttacaattgtttacatgttcgtttttgggagacaaaatcaaaagtccaaatatcaccataaactttagatagaagtccgtatagtaccttgaattttaaaaccagacatccaaccccctagatttagcaaaatcgttcatattatctcctaaggtggctttgtatagttgtttatatctaatttgtatataacttggatgagtttgatcatatgacatacacattagacatatgtattaaaattttcacttcaatctttctttttaatcgcttgttagctctcacttacaaacaagtaccaacgtaataatagtatggtatcattgtataagtataaattgatgacttacaattgatgatatgcaaatatgttacattagttatccaaagttgtttatttaagcttccaaaatatgaaaaaccaccatccaaaatcaccttaggggatgattataaagtttagaggttagatgtatggttttaaagttcaggttgatgtactttcatccaaagtttagggggatatttggacttttaccaattataaatatatgtatattaagaaaaaaaaatttgtaaataaatgttagctctagctacaattttatcttgaccaccaattaatcttaaatggttcacatgaaagattttcccgtacactagaccctttttgttttcaggtggatcataagtgcaaccgcacaggaaaatggggacaggtgctgggccgttgcccacatagaaaaatcaattttcgtgtgcggatcacttaacaggcccacacacgaaaataagcctattttcacgtgcgggcctgttaagtgacccgtacacgaaaatagcctaccccacgcgctgcccatcctcccatctccctcttatcctcctccccatcctcccatcatgcgagcgctgccatttatcctcctccccatcctgcccatcctcccatctccctcctccccttcctcccatctccctctccctgtccctctcctcctcggcgatggcggcgctctcggttagggcggcggaggcggcggcattggcgggcgcggcgggacatctgcgagtacggcggcagcggcattggctacggtggtggcggtggagcggatccgtctccggccgccgcgtggaggccggatccgtcgctggccgccgcggagaggccggatccgtggcttgccaccgctgggaggccggatctgtcgccggccgccgcggggaggccggatccatggtctgccaccgcggggaggccggatccatcgccggcgaccacagggacgacatcggcgggcctcggcaaggcggcgatgatgacggtggtggcggcgacaacgacgacgacaggcctcgggcaaggcagcgacgacggcggtggtggcggcgacaatggcggcggcgatggtgttgacggcggctagattagggtttgcgggtggattttgattttttttcggtttcagttttttattttctcgtgcgggtggcttaagcgtccgcacgtgcgggtgcatcacccgcacgaaaaaatcgggattttcacagactccacgttccagacgggtggaagctacgcacgcgaaaattgattccacccgcacggaaaaatctttcatgtagtagtggttagaatacatagttttatgtttacgacacaatgcactttgattatagagcatcggtctcttttaagtatttgtagatctgttttggaagaaagaaaatatgagaggtcaagtttaataaatgattagttccacctatctttaaacatgaacggagtgctatattgtatgataaaactcatgcgatgtatgacgttttgcatagagaacgatcaaatccttcataatactacaatgcaatgcaataagttatcatctacaatactgacataagtgaaagggtggtaatttgtgctaccaaaaaaggattggtctatgccataatactagtaaatagtatgtgtccatatcaattaaatattttactcccgacataaccatataattatgcaaatatactttaaaatgagtgtgccgtaataaaagcacaaataacatatcatacaaccacttgtcaaataacaattcaaaagcaataaaactatgaccgtatgtggttgtctttccacatggaccaaaagtttgaccaatggtcatgtgtacttttccctataccaggagataaaaaataatatctcatgatcatgtcggatggaccgcacctccgaccaatgactaacatgcacttttttggccgaccactaacacttcactgtcttcaactaatccaatatttattggtcgcttcagatcttttctaactttaatctcttccttaaatattcggacagccacccaacctttctttaaataataagacagtcacttggtgccacgtgggccactacacacaagaactcatgagaaacactcaacttttcctccaacgaatccaaaagtatacttcttggacacatcactgttccagcatgcaagagtggctcatactgtagagcgcacagactcagagagaactcagcttagcttaggattagttactttaaaatggaatcattacactaaaaagacatcgaataatcacttgctcgagtgcaaagttcgtgtacacgaccacgataatctctctctctatccagaagataatttcaagtctcataggcttttttttttcatttccaggtggcagtgagagagagagagagagagagaggacatgggcttttaagggcgacagtgacgtgcagaggatctgtgacatatccggatggatattcccctcgcgagcaaaggattatgccccgaatcttccatggctgcaggtcattttggctcatggcgtgtacggagtacattgtacttggctgagggatttcttgcggatcttctgcgccgttcaggttgtgtttcccatgttggttgttttttttttaaaataagttcttgatatatgcggtgggttgggttagttgtctactcccagatagctacgagtatttactcatggccagtagtatactcatgtagcgt

SEQ ID NO: 9874 - DNA, 24980 bp, Oryza sativa
tttccatctaaaaagaatattacagattttatgtggacgttcaagtaattatgactcattgttccatacttccatacagcataaacaaaactacaaaagttctctatcctgctaagatttcaggtgcaaacaaattgcacacggtattatgtaggagtagaataaaggtactcattatttgcttctcaattatttactaatccctccatttcatattataagtcgttttgattttttcctagtcaaacttaaagaagtttgatgaagtttatagaaaaatttagcaacatctacaacatcaaattagtttcattaaaactaacatttaatatatttggataatatgtttgttttgtgtcgaatatgttgctatattttttctacaaatttggtcaaattttaaaaagttcgactacaacaaaatcaaaacgactataatatgaaacggagaagtacttaagtggaactggtcaactagccaaacacgaagctacgtgttgttctaaaactcaaatgtaaaacaaatagaaaaatctagagtttcaccaatacagataaatgcagacaatccagataccataaaacttcagcaagcaagctagaagatataaagggtatcattgttaacattatatattatttaattttctttgctagtgaaatgttttccttgcaaaatgcaaagtaatcatcaataagaaagaggcttctcacatccaaccatccaatacacagagagctagtggaggcaaattgacggacaacgtaggtccatgaaagggtgtaacaaagactcaagggttaaggacaaggcggattccagaaagattctgttataaagactcaaggatttccttcaaaagaaatcctgttataaagaaaatgctgcccataactcaactagcagaataactgcatgatgtgcaccccccaaaattggaggcaacgtttattgtgttatttgcataccagaccatagcagaataacagaacaagagtatgtaaaattggggtaccatggtgccaacataagctgtttgcaagtacaaacctaccgaggtaattctgcacatagcatgccaagtggtaatgtaatataaggatttctaattccaagtgtcgaaacaatacaatgccaaaatacaagacttatacatgattaagggaagcaatacaggagtgtggatacagaaaataactgtgctggggatgccacctctaaacagcagagggagccacaatgaaaattttagtgatttaaggcatccatgaataggaatataggatgtctctcgagaaggtcgatacaagtttgcccatagaataggaaccaatagtaaggtactactttagatgattataccgccaagtgccaaccaactgcaaatagacatgcacatggcttcctgtacttcttacttgatacatataggcaaacattgatattttgatgatactcttaaagaaatgttgccagtaaagcgttttaacactttcgaaacacctaaacaattttatcaagaccctcccaaaaacatattctgtgcctgccaaatgttttgctagcagcatgccaggcaaggatgcctctcaatgacaaagaaatgcctttgttttattttaaaaaatgtgggctgaatgttacttaaattggatccacctgcacatggcactggtcttatggtcagtggaagagcatatcatgtaacagaaggggaaatatacattttttttatttaaatttcagatcggtagctgacttatccaaagctgatgcaatttcctcgatgacatgaaataatcataggctcaaagtcttttaataccttaacttggattacatatattttctcaagcatccaaaccaaactcaaaacagggggtttgcaagtgctcctactcccaccatatggcacatccaacttcaatttgacattttccttcacaaaaagctgtgcatccaatttttttctggctaaacaattatactatttgactattctagaacagaaggtgagaaatatttccaactttcatgggtgtcgccgtatgaaccaatcaaatatcatttcagttcaaaattttctaaaaaaaaacgtcatccacaaaaattccaagcggtccaaagtagagcacggaggaggaagagcttttccgatcactcacaccaggggacggcggcgcggtcgacgatggtctcgagcgtctcgaagacgagcttgctgtcgacgaggaagcggaggtagccgtccacggagggctcccacctggccaccggcggcgcctgcggctccttctccccttccttggcctggtccttggtgtgcagccgcatggccaccgccctcatctcctccacgaacggcttcccttcctccccgctcgccgcgggcgccatctccgccgccgtcgccgccgccaccaccatcctcctgctactgctagcgctcccccacaacctccgcgccaccaccgccaccgcccgcgaaggcgaaggcgccccggcgtgcacggacacgccgccgccgccgctcttccttccgtgcaagaagggcaacgacgtcgccgcgagtgcgttgggggccgtgagcgacgctgccgcgggcgccatgagtcccgcccacctctctccctcttatagcggcgctaggggtctccgttccgtgcgggggaggaggaagcgtgaaggtgctcgacgatggcgacgggccgcgcgcggaggcggttggcgttggagtgcggcgttggtgttgcttctgcggagtgaggagtgcggcgtcggcggcggcggtggaggaggaggaggagtggggaattttctacggattaaatcggagaaaatcgattaaaaaaataatcgagctcgcgcttggtggtgggagtggattggaatggccgggaatggcaagcaacctcggcagcaatggcgtctcgaggaggaagacgacgggtaagggactctcctttctcacctacatagtgcgtacccattacaatgacaggtgggcccggatggaagtgggcccgctatgtcagtgagttagggtagaggatggggaatggtaggtggtgggatttcccaaaggggatggagtgatagatgggacggtcgctgacgtgtaggccatggtggagatggggggcgggagggccaatgggcgtccacgtgacggggactggggatgcgagctcctccatgtccatgtcctcttttttagttctttattgggccggatgggcccatgtcgaaatgttcgcccatttctaactgtcctttttatttgttttatattatatgtggttaagggacatttggaaaaaacagttgttatctagaggcgtctataaatcggacgctgcacgaagtagttcggaattgtttaactacgtagattaaaaaaatgtttcaatcgttttaaaagttgaaacacaacaaaatcaccactcatgaaacattttgctgcaacgtatgaatcaatgttttttttttgtcttttttaagttgttttaccatatataaaaataatgtttcatcaaatagcgaaaggatgtttcaattcaccgcaacatttgatctatacataatgaaacatcacgagtataattgctgaaacattgttggtggaacaaaaaatgaaacggattttcttaatagagcgttttcgtaatatgtgggtgatttgttgcaatggcgtatgtggtggggaacgtggtggggacggcacggaggtgcgcgcggaggcgcaagaagcggcgggcgcacgatttttctggcgctgatcgagcgcccaatcgctaacattttccgttatttattgcaaaataaaaaaaattagcccatgcatgtcaattttcataatgtagaatttctgtgcacaatagtttatacgaagaaccgggcggactttaatattattctttcccttcattttttaatggttaagggacgctcaaggagttagtaaaattcaagaacagtcgtctaattgtccatgcacgtgatttataattgtcatagtctcatttacaatccatacagtaattttgtccgtagaactgtatgcgatatccacatattctcatatagaaaatccttcctctatatttaacactctttctgttctaaaatataaatatttaaataagtgaatactaggtttaaatagtagacttaacgtgctaatcactctttcaacgacttatgatacgacgtatatacttgtcaacagcgggtagggatgggcgcgcatatatgcatgtatatatgagaatctacgagactacgactatagtagtgtgctttgaaaataaaaaaaaaaaaccttttgcttatagaggcttaacaccgctagtccgctatagtttacatgctccaaacacaccaatttcgtaagaatctatttgaaattttacttacaaaggtatttgatgctttctatttacacttgaagtgagaaaacattaagatcacttgtgatattcttctgtcgttcttcactttaaaaagttgcgaaactaatatttttttcatttcacaatacaagtcattataacattttccacatttatattgatgttaatgaatctagacaaataatataaatatagaaaatgctataatgatttatattgtcaaacggagggagtaagatttttttttttcagtggatagctgaataataacatgggttgagggggatggagctttccggtgccgtcacgcagtgaatttgaaagcgtggccacatgtatctttcttcaatgttacccactagctagcttcacccacacaaaactggaaagcaacgtacattgatcgttggaaaatgctgaaactacaattaaaagcttggtttcgaagctgggaattttccgtattcgtaattagtggattaaactggatatcttgtagaagtcgctatattaattaatttttccagtgaaattctttttcttaaaaaaatgcggtctaaacttcagcgtgatggtttaatttaaagatgacgtccatatatcagtgcaagagcaacgaaatatatgtgtacaagcttatgaatgcaaaggttagtgcagtggcaggcgtgcacgtttgacgttacagctcccgggtttaactcaagaggaagaaatctctctctaaccgcttgcattatttgaaatggagtagtaggtaggacctactcccttcatcccaaaatataagctattgtcaaacttagtacaatcttcaaaactaatttttaacttaaaatttctcatatataaggttgttgcaacaaaattataatcatcttaaagtaaatttaaatgttaatccaataatttaattttaacaaataaaatttaatttatattataataattattggtcaaatgtttttaaagttgaatattgaaatgtgtgcacgtcttatattataagatagagagaataaaagttaattaagcctaatttgatttatacttattagctgtgcatgagtgtaccatcttacagtttagctcctctctagacaaaataagatctgcagtttttttttttgttggcacaagatatgcaactgtatttatttcaatacaagcctagagctcgtgcgttacaacggaaaataaattaagtttctagcttattaaattagttaataagtacttatttagtctaagtagtattaggatttatttttattgaataggtagggtgattttaaaatttaagagaagcctgaaagagcaactgccgtccttaccagaatcaagatattttactgctaagggcggcagttgcttaatcctttctgctgggacggcagttgcgtgcaaacgctttattctgaagatgattgtgacaccaaagtgtttgcccaatcttgtgacggtgagtcggtgaccttagcataagattaatcataaaaatcataaggtgttggtggatggtcgaacatatccatccacggtgtggagagacactactttcaatttggcaatcatagtctccgatagggaccctacactgtaatttactagtttttttttactaacatgtaattaactagtaatagatcgattgtttgtttatctagagatgagtatacataccgatcatgagtggcattgatcgtttgtgctgggtgtcagcaagctgcacggtccttctgtagctgtagcaaatcatctgttctgtgtgtgtggatcggggctggctggtgccagtgtagctagcattaccgatcagacttattgtatctattataattcaactaaattttatttagttaaattagaatgaatgaattgtcagcgggtcgatttgtgttatccctatatttactgacattttgttgtctctcgctgctgtattggctgatccaagtaaaacttttttctttaagaaaaaaacacttcgccaaccttaaatttatgtgtaataatgtaatatagaaaaaaaatatagatgaactagtagtaattgatcaattccgggggataaaattactagaaaaaaaattatctgctccagtgatgaatatgaagaattctccctccgtgggtgcatttctccacttcttcagtgtgaagaaactgggcctgaccatgtggcccatatcaggattgggcttacgggcctttttctggccttgcatcacttgtatttctccgtcgagctcttcacagaaatttcactgcacggtgaaaatgcagcaacaatctggatttcagctagagtagaaacgctatggctcatcggaattaacagcgtaattgcgtgcttttatcccaaaaccctagaggatagatggagagcatactgttaatctgcaaaagattgaaggaaaataaacgaaaggatgtttatgcctgtcttaattagtgtccaaccaaaacaccatacgaactgaaaacaataaatcaaaatgaaactaaaagaaatcaaataattgcatgcagtgagcttgtgaaaactctggaaagaaagggcgtaaaaaaaattaaaaggggcattccgagaattgaactcgggacctctcgcaccctaagcgagaatcataccactagaccaaatgcccttcggacgttttaacttttcaccttgcctttttaactgatgcgcacatggtaggtggttgaatgctatactaactgaagaccattatcagacagataatagagacggttttcaaaaggcaaatgtggactatttaagaatattgtttttacaccgataaaaatataagaaatgggcattgtgtttccataaatcgggcatgttttttcccctaaatagccgaatgattttgtgatgactatttgaaggtacaaacgaatgaattaactattgtgaagttgaaaaacagatttaaaatttatatatagaaaatattttgttgaaaatggcaccgttttaggagctcacgaagcatgtcgcattagtccgttcttccattgcttaaaaagaacatgctataaatgaggtttttaataagtcaattaaagattcatgacttgaccgaattaggtgatcgagaccaaaactagagaattggtaggaatatactattttgaggagttaatgttggcctgtctccctctcttcgaaaacaatgaaatttgactttgagattgtgcagaatatagtatagaacttcattccatatactcctatgtatatatactgattgagaattttgtctttaaaatgcacacacaacaattatcagaaaaatgcacacaactatacgctcgggtcccatttgccgtactctatgcatccggccaactgcaataagttaattacaactggcttaagatgtcagtttttggcaactaattgaattgtatctaactaatccatttatggctctctgtcaatgttgatcaagagatatcgatcatctgtgaatcagacaccgatctgctcttaatctcctcgatcgagcaatcattagaagtcgtcgtttccatgtccaagacagaatgatcgatcgagctagctaggaaaagaaaattcacttatatatattgctaggtaggcatcaacaacttgtactgtacaactatatataacaataatatttgtgtcaagcgcctaattaattctccagctgcaagagcaaatcactgtcaattgatctacttgcacgacactacaacgagcttaaaaaaacaattaattcatcataattaagtgcatcaagatatatttacaatgccgtgcaagaagtactgcacaaaacaattaaaaaaccacatggataatatcccatatcatgatatggtctatgctgtaacaaaaaaattaagttgcacaagcaaataaattaaggacaagtaatcgcaaaaaaggattaaagaaaaggtaatcatctatgtataatcagatgaacaaatcaatagaacacaactcgatcgacctcttcccttgctgcagccatggctcatgcgtgtagagccatgcgagcaattaagggaaaattttgtaaaccacctaaattatctacaattttgatgaactaattaatttacaagcctatacatatgcaaaccaagatgattttaagctcatttcggaatttctttttcgattattacgccgtgcaagtgcaaggtcgcgagaggaaaaccctaattggcgaccatgcatcatgcacagcgactgcgtcgccgtcgccgtcgccgttgctccggtgagatttgtatcattattggtgctgcgacggcagcggcccgaagatgtcgaggaaggcggacggcgagccgagcgcccccggcgcgccgacggggctgaagaagtggtcgccgacgtgctgaagccagccggcgccgggggagacgagcggcgcggcggcggcggcctcgcccttgagcgcggcgccgcggagcgggctgaggtcgttgaacaggaaccccgtcgacggcgacggcgacggcccggccgccgccgccgacgacggagaggcgagctgctgctgctgccgcatcgtcgccgtcaccgacacggacacggccgagccgccggcgggccggttcagggcccgcgccttgacgcgcaccggcggcgcccccctgcgcgcctccctcggcgacgacgacgccgccttcttgccgccgtcgcccgcggccgccgcccccgggccggtgagccgctgcaccagcgacatgaactcgtgggcctcgacgtggatgatcttgggcgacaccatgtaaatgatcaccggcttccgctgctgctgatgcgccgccgatttcccgatcttgcgcgacgccgcgtgcacgccgagcgccccgccggcgccgtcgaagctcgcggcggccatggatggatcgaggacggcggcggcggcggcggagcaggtggtgcaaggtgaggtggacacgaaagagattttgagtgggacagcaagaggctaaaatgggtcgcgaggtgcaagtgagatatatagatagaagagggggaggcagccttggcagcattagccattagggatttaaagagcggcttggtcaacttgagaaatcgaaggcgacaggacaagagtgatactgcgtggcacgtgccactcggtccatccaatgtgttcgtatctatgttgtcaaagctgtgcctgaattgcattcacggggctgctcgtgtaatatttatctaccgtcgtcttttcatagtttaaatgaaatatctactgttttttttcaagaaaaaaatctctactattctcgataaaatgttattgacttgtcacacttattcattcgttatttaagttttgtaaaatacttttataatttttttatgaaaatacgtgtttggactatatagatacaccaaacaatatactataagactgtttttaagttaatcctcctatgagcaggtacagtagcaaactataagccagctataaacacatatcgaggagatgaaagaagagagagatgagcagcgagctacaaatttatagacagctgcagcacatgctccaagtcacaatgtgtgtatgacaagtgggacaagatattaatagtgtagtatatatatttatacgtaactattatataatttggctatctattatattattaaaggaatagaaaaagaatcctccacgttcgctctcatggcctagaaattctcacattaatcggagaaaaagaaaaaacagagtccatatagaaatacaatttagaaatagttgaaattcggaattaaaatataaggaatattagaataggagactagagtccatatagaaatacaatttcgaaatagttgatattcggaattaaaaaataaggaatatttgaagaggagactagagtccatatagaaatacaattaggaaataactgaaattagaaattaaaaataaggaatattagaagtagagtatagagtcgtagaaatacaattataaaataactaaaattcgtcattaaaaataaagaatattagaagtagaggatagagtctatatagaaatacaattaagaaaacaaaatagaaatttggaattaaaaaataagaaatattagaagtagagtatagagtccatatagtaatttaaaactaactaaaatttggaataaacataataaaattaaaagtagagtttagagtccgtataaaaatacaatttataaataactaaaattcgaaattaagaaaaacatgggaagaagagtttaaagtcaatataggaatacaatttagaagtaactaaaattcaaaatttaaaattaaagaatattgaaagatgagtttagagtccacatagaaatacaattagaaataataaaaattcagaaataaatataaataatattggaagaagagcatagagtctatataaaaatacagtttacaaaaaattcggaattaaaaaatagaaatattaaaagacgagtctagagtccatataagaatatatataatttacaaataactaaaatttgatattaaaaataattaataactaacacgtatataaaatacaatataaatattacacattagtatttttgtaaagttattgcaaaatttataattatattgtcattttaatatatttgaataatataatgagaaaacatatatgctattatttgagagaaaatataatgatgctagccgcgcaatctgcgcgggccaccatgctagttaagttaactatagatgatttggagctagtagttgggtatactattaaacttgctctaacttcatctcactcgttttccacgtacacgttttccaaactgctaagcgatgcatttttttaaatcatatttaatctattttaaaggtttttagttaatacttaattaatcatgcgttaatgcatattctgttttgcgtacgagagagaacacactctaagtaggaggagtaacgggattaacttttcaatctagaaggattgtgtctaaaattgggtgtgttaaatttttatctatttgctactaaaaacatataaggggctatgtaagattatgagaaagacccatagatcttaatccattacctctcctaactagacatgcaaacaatgtgattatagccgttttaagtttcagtacatagaccacaaaattccgacccaatccaccgtacctagctagctagagcaaaacaaaatattcaaacttcatatataaatgctcttctttctccacacatgctggcggctaatcaccagcgagctaaatgcaacgcacaaagcgtgtacaccaaaagcacgtattcgtcctaccactactaatctattcccaagttacaagcagagatagacgacattatggtcggccacaccagatccccacacacgcgcacaacgccaacatcatgcaaccaacatttttgacaatggaacagctagcacgtatacgtccctccggcccctgggccccacctgcaggccacaggaaggcgagacgggacgaggaagcagagaggcagaagccggctggccgtcgacgtggcatgaaaatctccccggccattcgtagcgcccaaaaagcgattacaaaaccgccttgagatagagagagagagaatagaaaaaaaaaacggccacacccctcttgccgttattttacacttgatgtcgatttcgcccggtctcacgctggcccgtctcacgtacgtacgccattggccgcccggccggcctgtcgatcggctcggttgcaaagtcagctcgatcgctgctcacacacgcggaagcccatcactcgtcgaccggtccgcgcgcgacgatgacgacgaggagcacgcgatcgatcaggtcgagccgctcgtacagttgcatgcgcgtggtcggctggtcgctgcattggcgcgcggccgcaattgggatactgcacagtagtgcagaggagggcgagcgtgtgccgtcgtcgtcgtggcggaggggaggggaggatggcaggatgcagcgttgcgcgtgtgcggtgtgggttgacggtgcgattttttcagaacgtttcgggtctgcgcgtcgctggtgactgggcgggtgggggtgcatgcatgtacgactacgtactagctgctaggtggtaatggtatacgagtgcggcgtgacgagagcgtaaaggccccgctccagaaaagtagcgaggacgatgcgcggaagctggtgatcgaaacggagaaaaatcatatggagtaagtacgttggagtgcatgcgcgatggagctcacgcgcggtgtccttcttccagttctgctattaatctagtacttagccaaaaccaaaccgttagacctatatccaacatttggtacctcgagatatcacatattgcaacgcacgtacactcgcatatgtacagtaccgtactgtgcgcatcagctgcgcgccaggaacaatccaattcgccgacgcgttcgcgcgcccatgcaaccacagccacagagaggtcgacatgcagtcgacacagagttggtggtggggaacacgcacgtatagtagccggacgcggtcccgctgtacgatctggccggccggcgcgcggcggcgtatacggcgcgatcgcgcgcgcgcgtcaaaccgtcaagtggaaaagtgttagcagcagaaaaaggttagcgagaccgcgggcacgaagcggtttctttttttgttgtatgtttttcgagttttggcagcaaccgagccttgagacgaggccaggagcagacaaagggtgcccacatttgctacttgctccatccaaaagtctagcacatatttttatttaattttatgattccttttgtcatatttatagtctatatgtactaaattaaactgttaactgcaacccaaaaaatcatcttaatccttagaacaagtactataagattcttaatgctatccttaaaaatacaacatatgacaaagtgatgaggtggaaaagagaaccaagaagagggtgagccaccccttatgctagggattgagatcctctgactttaagtcactgatatatgggtccactatctagagagaacatatgtcagtgacatacgttagaaggaagtaagtctgaagatactcttccttatgtctacacatactcaaagaacaaaataaaatagtgtgagaatgaaccaaaagaaatattggggtttgtatgttggaggtaaattgttgtacatgttgcctcttaatcaatgagtaaatgatatggctaaaattggaggtagcagtcagctgcactataaaatttgctcttattgattacatgtatgtatatagttttttggttttgtcacagtggataagttaatttctcattggtcttggtgacaaatgaaatatgacttagacttttcgatagagggagtattgtggaaggccgggagagacagtgttggataaaacagggccttgtttgcaaagttagatatatctgagcattgaccaactcttcccttattaaagtaaaacctaatccccgaaaatgggtttttctataagaaaaatgggatccaacaattatcctattgaagtgaaaagaatttagaatccccaatcattctccacgtctagggaatagccacattctcccaaaaagccgatcgcatacgggaggagcgcgatcgatatcggtgcatggaagttgtgcgagcgagatcgccggcgaagagaggatggcccactttttttattttagggagctaggtttaggctatatgttggaaagaagtgtattttaaatccttaaattcttattagaggttttaaaaagagatttaggggatagaacattagatagctgttggtgatgctataagaagagagaatggaaaagttggtttttcaatttattattttagattttatgataaagcgattactgtgaggtttgatccatacgaaataattcgacaccattcatcgctaaccaatgaattcaacaagttggcgcatgtataagaaagtgcttgaaacttttgaaatatcactttttgtccatacgtgatgatttgactcaatttgtttcaaacatactaggctgtgttcagacgttgaagttgggaactaatgcctcacgcatgaaaaacgaagtgattcatcagcgttatgattaattaagtactagctatttatttaaaaaatagattaacatgatttttttaaagcaactttcatattcttttaagaaaaacaaaccgtttaatagttaggaaaatgttagtgcgagaaaaggtaaattgggaaacttaactccattcgttgatggagtgtaacggtagctgaaaatttagcatcacgtgtccacctaacgagcccaagtaattgcccgggtcactaggtggtggatccacccctagcagcgatcatgtgaaagcaatgacttaaactccaataaaacacatagaggtggatgggtggaagtggcaaatttagagggaagccatgggcgcggcagtgtgttgaggctagcgagcatctattggatcaaggagacgtgagcggtggtgacactctatctacatgcatggtttacaaaaccgtgcggttatcatggttatcatgtgtgataacatttttcaaaataacctttttcaaaaccacggtatatacctaatggtaactgcatggttcacggtaaccatgcagttaccgcaataatcgctaaagtgtgggattgttaccgcaataatcgctaaagtgtgggataatagtaaccctaaccaaaatggtttactgaaccctacctatgtgaaagattcgataaaagagaagaaagggatgttataggtttatagatatacatggaccacgaagcagtcttagcagtcccaaaatgactagaaagctgagggctcgttattgttttttttgtgacgttagaagttcagatttcggaaaaccttcaagaaatttggcaaacccagcccctgaaccggtcaaaacgaacatattcaaacttatattttattaaattttacgactgaaaccacctagtacaaaaccgcttatcgctgttcatggcccagtttttttctcctaactagtttttttttaattctattgactattgtaccttgccccaacaagtactattcaatggactgtttatccctgtgatgttgatgacaaaagtcaataccccatattgcaatttgcaacaagtagttcatatgcgtacacagcacatgtggtcagaaccaaatgagaagcctacagctgatggaaaatacagtatttccgttttcacccagaactgcacctcaaagttgacatatataaccaagcactaacaaatactacacaacacgggttaaatcggaataaaaaacgtcactggtgagcgaagattaacctaaagcaaccgcactttttccgtagcttcggagctgcttcaatatgtatgcaatgcaaaggcaaattaaacacagccgccaggtgcagatcgcgctcattgctaaagattagcaggtaagctggtaaagagcacaaaaaagattagcaggtaagctgggtaaagaacacaacttaacacgtcttcccaagaaaattaatcagcaacagctgagcgagtaccttgtttcagagatggccatcactttctcccggtttgacaatgcagcagcagcaggaggcatgagacatgacctgactcagactgttgctcttccttgcgcttggcccagcacaaccatagaagcgtacaagaaaacgcccaacgtggagctgcaagaccaagtctctggtgttaacatgttgttaggataatccacttttgacaggttccaagaagataccttgtcactttaaaggcgtctgagatcttcatcagatgtcgcttttcaaattttgattgaattccaatggaagtcacttactcaccttcagaaatggctgcaaatgatgctccaggatgcaacacaagttaagcattgtcagaaaaatcctttatgaaggacacccggttgtatatttaccagataaaatgcaaattacctcgagattttatttgcagtaacataagattcagtcacctagtatggacagaagcaagcatggaactcaacctccaagttggaagcaaaatctaggattcgccaacagtgcatcaatatgaataatatggaattgtggatagttctatgaaagactcacaacttataagtcataagagtgcatcaccttcagatgcagtgcacacatcttaaggtgatttgagactgatgagtgatgaagatgatgacacaactaacatgtaagccaaatgacagtacaaaccataaaagaagaatatgtcaactcccatgttcttggacaaaacaattattttcatgaattagcctatcagcagcttgtcccatttctctgaatacatgttagttgatcagcttgctacacagaagattaaagctgcaaaatacatcattggaatatcttgtaagcttattgggctaaactgaaggtaataaagaaaaagtgccaccttgacttccacagaaataattttagaagtgttcacggtaatatatgaaatcctttgtgtggtttgtatcatacacaacacacacgcacagacaaaaagaaggaaatggacaattggacaaatatttatatcaacaacttgataaaatagttgtcatacattatctccagcacgccaccgtcctccctcaagttgactaaaagaattgagaagacttttagaattgttttgatgacattgtgagaaacaaaaaaaaataaagaaggcacatcatgccttagtaacagtattatatagcctctctcaacattcaaacctaaattactatagcatcactacaaacttagtggtttgggatcaatcaaaggtcaaaatttagaatatcagagatgacagatgagatatacaaagaatagacataaattctaaattcctaatcataaatagcacattctattgtaatgcaagatgctgctttgggtaggtactagaaaaagtaaggagctaactgaacaatttgttggtgtagatatttgggttggtttgaaccttggatcaaagatcaagattcactaggtgtagaccattccatgaaggtcatgatctctcatgagcttcttccaatttgcatacaagctcacgaaagagctctgcaatcattcatggtttttgtggtccttatgctctaacataaaaaaacattttctttgtttcattctgttttgtacataggtgtggctatacaatgtataatgtatcacaatgttaagcagcagttagttagagacatagtgatgtagaaatgtgatactgagcactgtcatttttcaagtatctgatttgttcatgcgtacacagaacatctggttccgtcttttgcacaaatcaatagaccccactggctcactgtgaaatccatccacatccagaccacttcttatagtcacaggtaaccaaattggcgctattagtaaactattctacaccgtgaaatccatccagatcatatatgagcatttgaactagtgtacacaaattccacatgattaaacaattataggttcgtccaaaatcagtctgtgtggtaaatgtggtggacaaacaggactggagaatgcactatggtttcagagaaacaatatctatatgttcacaaccagtataactactgggacaacacacttacaaatgtatgtacaacaaacctgtgagttgtgacagattaacattatttaatgcttagtccaaaccacgttgggaaacacagatacaataagatttgcatgtgcaggttactattcattaaagccatcagggttttcagatttcatataatggcgaaactttacatcgcgacaaactaagcctcaattcaccgatgttgatcattctttttgttaatagcagaatgctttagatcatgcttgtaaagaagcaattgctttattgggctcaggtcccatattatgattgagtaacaatggatgaaactctcacgcaccctagaatttggaatattgatgttggacaggtttctaaacttgttgcagataaatacatgagaaagactaacaggggaaaaggctaagtaataatgattatagaaacaaatcttactaatttaaatacaaacataagataatcagatgatatcatctagtatgtctatctcatgggcctatccgggatcacatgccgcaatgtatgaactgtggcaattccatagcatagatcaaatgccaattgagcaattggaagctgaattgtgcgtgcgatcgcaccataaacagcggcgcggaagagagctcaccacctagaagtccatctgcagccacttcttgtagtagacgcaggtgctcggcgagataacgccatccggcgagcactcatcgatcctggggcaaactccacacgggatcctctccatcatgccgccctgcaccgggccgcccctccggtagcacaccctccctgccctgaggtcgccgaactcccccgccccggtgctcctcacctcctcgacctccctgtcgagcgccatggtgcgcaggatgtccctgacctgctcggtcgagtaggctaggttggagcattccctgctgatgccctcgtggatggactccgccgtggcgacgccgagcttgtcgatctggtcgaggcacctgcgccgcgcggaggcgacggcgtcggagtcgagctggccgttgcggtaccaggttcccccggtgatctccggcgacgggtcgatgcggacgtccatgtagatcttctcggcgcgcttgtggacgctgttgaccaccttgaggacgcccttggaggtgaggccgcggaggtgcttggtgagggtgctcgtcggcatcccggtcttgatccggatctccgtctgcgacatgcccttgtccccgccggcgaacacgagcttgtagatggggcgctcgtgctgcgacaaggcggcgaggacggtgtccgagaggaccgccttcggcggcggcggcgccgcggcgatgggtttagcgggcggagagatcttgggcttggtttccggtggggcttccggcgccttggccggcggcggcgggcgcttccgcggcggcatggctcgtcgacggcgacggtggcggcggcggcggcggaggaggaggacgtgggggttttggggtttcccactccgcaactgctctgctctgacttgtggcgaaagaaaatgggccagactgcatagtgtagctaaatttcatttgggccctcaagaaagtgagccgaaatgtatgtgggcttaatctcgtttgggcccccaggttcacaaaattgtgaaaatgggctaaactgtgggcttaatttattttagtccctacaagtttacaaaattaggaaaaggtccattttgcgtctctccaaattctcaactttggttgaagttttcatttacgtctcagtctcaaccactaaaaacaggtatagaacattcctcaattttgttaaacaagtgcaaatcaaagttgagcctagttaggcccacgttgttgagcctggaacatgattatagtaaactacaaggctcttgagatcaaataagcatggtcatcaaagataatataaacatgatcacaaacagattcactatatgatagtcaatttgattgtgcaaaaggatacaaatatcttatttgatcacctaaacagcaatacttgccgtctctgaataaattttacagacatcttattttcccctccagtaaaacttttttcccattccagtaaaaactgcgcaatcaactcaatttccaggcaacaaacaagttcagtggaagtgtgctacacatgatgctaactcataacaagacgttgcacaactttaacaaaatcatctccgaatcgagattgtcaaaatcagaattgttatactgcaacattaactaattctgtaccgagagttcatgaaagaggatgtagatcagcaaaaagtacaggatttaactcacaatagtgaatcaaaacatctcagttctgtctgatggttatgatgggtttctatgattttacaatgtatactgaacatgtccaccattttacaactgttaggaatcctggaatcatacaaattactgaatatatgacaggggaatgagatccccggtactatctccagcaaatgtcaagatcaaggtcatgcagtgtacataaccatgtagtgaaatgccggtcgtgtcatttggcggcctgctcaatcaccggaatcttattccacagttcctgctgctcctctggcgaactgtcgccctggagaggtggtaatgagaatgcactaacagtagagcttccgcttcggatctccttcagagacctaagcgccgcgaccgtgcccttcatatacatgctttccatgtactcgatctcatctaactctggaatagtgccaccattaaccaaggatgaactgggattcgaaggcttgtcctcgttagtgctatcgcctctcccatcttcactcgatacagacagttcgtttgatggtagaagctggtccagcatggcctcacactgtttcacaagcttgtacaggaggtcagtggtgaagaaaggctgctgtagcactttctggatgaaaggcagacggatcagagccccagtcctcttgtcatacttcttgagaatcttaactaatcctgtaaacagcaacatggaacgtaagtatcaactggtgaaaatctaaaacaaagtacaagagttacatcttccaaatttcaaatagcatccaatccacttccaatatcacaacttttcttaaagagttttccctcaagagaataaacagggataactgacatgagctattgctagtggttcaatcagactaaacattttagtttaggtgatatctgcccaaactgatggaaatagaaaatacgcccttgtatggcttacaggctgtggcatctgtctgtctgaggcaccaaaaccatttgtaacttgtcacatccctagctaatgaacctgaattctcgtgaggcatggtccagtaaattttcatatcaggaaagctagcatggtagtgatgtgtaaagggtaccacattgccactaaaggagatgctagtcaatttggttgagataggataacatttcatattgcaaatgataaccagaaaactttcagacagttgtacaacactaatatagtttcttattcgcataagcatacgaaatagaccagcatgatatgagcaaaatggcagcagaaatgtattgtgcagttgcaaagcaccaatgatggttattaacagtaacacattccagttcagggcttcaggcatataagaagcatgcaacttgcattctgttctgttggttgagcaaaacatactaagcttgcatgatgcaaaacaacaaatttactttttgtgtgacatcctcatctttagaatgtgttcacattcgaaaagtcgactccccaaattagtgtgtgttaacctggcccaatatagccatataggtctgtgacaccatcaacttgcatcttgcaaaggaaaaacagaaaaaagcaagatgctgatacaaagagtggtcacaggtcactggttcacagtacgtccaccgaaaccattgtccacaagcacataataacacagtaaccaaggtactcattagcctcaagttcattgcagctagcaaaaaactgactttaaaaagtagtccactaaagaagcactaggatgacgaatagcatgcaaagttaggaccatcaatcacatctcagctaagcataaaagagtcaactaatgaagatcatgaaattagctacacaaatttctgttgagcaataccatatctttagatgatatgcaaaactaatttcttttattttcaatagctggaacgcaaatcacaaacgtaacatgaattgcactttcttgtttcgttaggcatgacttttaatcagaagactcgtcaactgatgaaaaatatttggcaatgaagcatgtgcccccgtttaccaaatatgtattttgcgccgtactaaaaataaaaactataaatgtctttgaaatagtttataacatattgcaaaaattagcctgcaaacttgtctactacagtatttcaggcgtgaatgcttcctgggaatttagaacaagttaatttatttatctaactgcagatgactgtacacccaactttttgcaaattgtgcatatagtattattaatgcatctacggaatttcaggcaatctttgaaatgatgcatagtgaatttaattttggatttggtgaggggaggcatacgctgccctgcttactaaatcaatatttctaaaacaactatggagcttatgatagaaatgatgctctaacatcatattcaagtgagtaattttcgtcccaactgccaacagaaaccgacctagatttaattgagttgtatgattaacctgtaacccccaggctaggaatgaaaatttccagatattagaagccactcacaatctcacattgataaagaggaaaatcaaccactcagcattaaggcataacaaaggccaaccgaaaaatagcaaagcagtacagttgtacatcattactttgcatatgcactgcatatgctgccagtggacaggtaaggaagcagataatctaccagactaccatggaacactgcagtagagggcaaggtcactatactatactacacactactgcatcatcatgtgaaccctgaatcagactgtatttttagtgaaaaatattgccaagataatatctgataccaagtcaattattagtcaaatatttcttgtagaaacttctatgcaccatttggttggtgacgaactgtattacagcctgttgaaaaggataaattttttgacctatttgtttacaattgttatatactacctccgacccaaaatatagcaacttttggctatgaatctggacacagttgtccaaattcatagctagaaatacttatatcttgggatggagggagtaccttcttatagcgagtcaaaggaaaatctgttcacgatagaaggatgcatgacacactgttaccatttcaaattgcagcagaaaggaacagagtgctccaccataaacaatgttagcactcatgtggccatactataaattgcttgtctcgcacgagaaaacaaactgtttatatacagtgcccccaacattagctgctgagcccaacctcaagtatccattcatcaatagagagcaaaaacgtgtgcgcactgaattgccatacaaggatccattctccttgacagcgacacgagtgctgcgtagcggacatgcgaaaccatagctgcccacaaccacaataagtcgcctatttcttgacctatgttcaggaaacttccattactcctgcctgctctatgatgcgtgctaaattacctttctgagaacactaataaactactatattaaccaatttttttctacctctcttactacctccccaatcaaaaaaaattctaataaggatactaaactactatgttaaccagtttttccaacctctcttattactacctccccaattcacagaacattccaagaagagttaacaaacaacataagcaacagctaacgaaccctttgcaataatataattagtgaaagacatgtgaaaactgaaaactacgggtgttgcgatgcggcgggtggggaagtgcgtggactgggacactcaccggtgtagttgagggcgctgtagttctcgagcagcaccatctcgccatggaagtcgacgatctccttgcgcacccgcatcagctcctccttcgactccctccccgccgccctcgccaccctgtcctgcagctcctgacacacacagcgtcgatttcccaaatcagaaccaagaaactcgagaagaagaagaagattcgaaccgaagcacaaatggcgatcgatcaccgccgcaccttctggcggatgatgtattcctcctccttctcgacgaagaaggagttgaacttgtcgagctcggcctccaggagccgcatgaagcccgcctcctcgggcgtcatcgccgcggcggcggcctcctcctcgccgccatccgctgcaacgcgtgcccgcttcgcctgcctctcctccccacccccacccccaccaatcagcttgagccgcttcttgagatccttgtacgacaagaacttgtcccgccactccgggagcgtctccacgatctggctactcaggctcttcccaaacttcatcctcaacaacaagagagaagaaaactgcacaaaactgcactacggctgccaagaaccgatcgaattctcgccgcggcagcggtggaggtggtggtgaaatagggttgaggaggagaggggggaaagggaggcggaggatatgcgggggagaggaggaaggagacgatgggaatattcgcgggggaggatataattgtgtttatgtgctccgttcgctttcgcttcacaaatcacaagcgggggaagggggattggggtttttttttttttttttggggggggggggggggggagggggggccggcc

SEQ ID NO: 9875 - DNA, 1320 bp, Oryza sativa
cgatggtaggggcacacggctggaatgtggtccagactactattcctatatcctcgtgggctagccgcctggccgggagttaaaaagtctatgtttattcgtgctgatggatctgtactatatgagagcggtccagaatgtaagaattatttatgtgatttttaaatggtaaggagctagatataatagagtttttgactttgagtcagcaatatgcgacgaagcagactgagctatcaatttttaaattcagtttgatactcaaggtcgaagtccattctttcataagagatgggattgaacccctaatatagggagtataattgtggctattgaaacaaagccatatttcccctggacaatgcaaacataagacttgctatgtaattcatctgtcctaaaatataaatatttttaaatctcgacacagtgttcgagatactactttgataaacaatatctataaaaataaaatgttttaaataaaaagagttgcatattataataatttgattaatgataaatctagtaacatcaatttgacattattgatcttttttatttttttttgctattaatagtcaaagttaaaaaatggttgatttggtactatgctgaaaatgcttatattttagaacggagagagtactaacaagatagatagagtagttgtatatatatatcacaatatcaatctttccctccaagcatctactccatagttaactactccctccgtcccataatataagggattttgagtttttgcttgcaacgtttgaccactcgtcttatttaaaattttttgaaattattaattattttatttgtgacttactttatttctacagtactttaagcacaacttttcgtattttatatttgcaaaaaaatttgaataagacgagtggtcaaacgttgcaagcaaaaactgaaaatcccttatattgtgggacggagggagtacttaccaaactacgttataatcgtttatatatacacattacggtgctacctagttcaccttttaataatcaacaatttttttaaaaaaaataatcaaaaatttcaggccctgtttgaccatgttcgaagggaaatatgtaaacatgcaagtacaaatagctttaagaaaatactaatatgggttagcacttggagcttggaagtcgtatgttcttgaggagagctaaccgacttgtgattttctttttgttgacagtattatttaagtagcactctacttccatgcaaagatatccaacagaatattcctataattaattgtcatgcgtcttgcaatttgacagggctgcagga

SEQ ID NO: 9876 - DNA, 14679 bp, Oryza sativa
aaaactatccgaatagccgtgcccgcggttatgggcgatttgagcaatgtttttcgtgattagtctcacacctctcacaataaatatggatggggatacttgctaataatttgcttagctcctggtttggagttagatttgttcagccgggtatggttgttcaggatggttgggcctgtgcagcatgggtgtgctgttcagtgttgattaaaatttctgattaattactccactgttttatttctcttaaatgttttgctaaatgctgcttttgcaaatgagcctatattatgccatcctttggtatctttgtgcacttgcatatttgctgtgtggcttgttgagtatgtcatatgctcattcttgcaataatcatcaaacctcagttgaagataaaggatccagaaggagaagacgtttggcttataccccagctgagctgcctgtgggagtagagccggagcttcgctagattttatttttccgttgctgttttcttttcttttgtaagtattaacgatattattatgatagatttgtatattaaattgtcagtttgtgtacctcggctgattcctggacgaggattttatgcacaaataagttcggaaattactagtgaattgctgggcgtgacatcctgctaagggcatcggctacaacatttgctttccccgggtgataatggatttccatatcataatctttaatcaactctaaccatcttcgctgacgcatgttcaaatcaggttgagtgaaaatgtacttcaaacttttatgatccgtatatatctctgtacggttaccgaaaagataatgacgccaaatcttcaatgcatgcaccacagctgccaattccaggtcatgcgttgggtagttattctcatgaggacgtaattgcctagatgcataggcaaccacctttccttcttgcatcaacacacaacccaaaccgagtcgggatgcatcacaatacacttggaaacctttcctcgtatcaggcaaaattaatacaggcgcagtcactagccttttcttcagttcttggaaacttcgttcacaatcctccgtccacttatacttcacttccttctgaagcagacgagtcattggtctggcgatctttgaaaagttctcaataaacctgcggtaataccctgcaagtccaaggaaactacgaatttctgaaaccgtcttgggttgcttccaacttaatactgactccacattgcttggatctactgccactcctccagacgagatgacatgaccaagaaactttacttcggacaaccaaaattcacatttactgaacttggcataaagctgatgctcacgtagtttctctaaagctagacgaagatgctcttcatgttcttccttcgtcttggagtaaataagaatgtcatcaataaacactacgacaaacttatccaaatattccataaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccagaatggagatctatcttggagaaaactgtagcaccttcgagttgatcaaacaggtcatcaattctgggtagaggatatttattcttgatagtaacctcattcaacgctcgataatccacacacattctttgagtatgatctttcttctccacaaagatgactggtgctccccacggcgaagtactgggtctgatgtatcctttctgaagcaaatcatccacctgtttcttcacctcagctaactcgttagctgccattctgtatggtctcttatggatggggttggttccaggtaccaagtctatccgaaactctatgtctctcttaggtggcatacctggcaaatcctcgggaaacacgtctgggtagtcttgcactataggaatctcttgtagagcaacttggtttaagaccacaccatgagatttaggagaggatgcaaagaaagaaactgtttccccattgctattggttaaagtcaccttacgattggcgcaatctataactcctctgtgacgagataaccaatccatccctaagataacatctaggtctttggattctagcaagataagagaggatgggaaaggaacttcttctatttctatagtaacggaaggacaatactgtgtcgaaaatacctgattgcccggggtattaactagtaaaggtctcccaagactaacaacttccatcccatgtttgcttgcaaaacttttagacaaaaaggaatgtgtagcaccggaatcaaaaagcacagttgcgggtatagagttaacaggaaacgtacccaaaacaacatctggtgcattctgagcttctgctgctgcaacatgattaacacgtgccttcggtgctggaacattggggttgttcgggactggagcgttcttcacacgccgaggcttaggacacttatcagcataatgtcctggatcaccacaattaaagcatatcactggcttgcttccctgttccttcctgacaggctggttctgaactggagttgctgcaggacaagcaaccatattgcggttgtcattgccacgattactagtattgttgttgtagaactggcgttggggacgggcaacagatgaagatcctccttgagggtacgatggagcttgaggtccagtaatgagacgcggcctttggttactgccctgttgtgccttaaattgggcagccctgcgcttcttctgctctatacggttatacttgtcttcctgacgaatcgccttgtccaccaattgttggaaatcccggaaatccgtagccatcaaagcataagacaactcatcatttagtccctctaaaaacttctcctgacgctcttcatcggtgcgaacatcctctggagcatagcgagctaaacggttaaaatcatggaggtactcagtgaccgaacgagatccctggttgagtgctctaaattctctcttctttagagctacaacacctgacggtatatgcgtcttcttaaaagcagctgtgaattcctgccaagtaataggttctcctcccgccctgccttggcgaaaatgatcccaccattcagcagcgggtccatgcaactgatgcgaagcaaaagaaactttctcctgctcagtacactggatcaaatccaacttcttctccaccgcatgcaaccaatctcctgcttctactggattggtggtgcttgaaaaggtagggggtctcacacgtaagaaatctgccagcttattttggggaggtgggggtggattctggttctgattatttgcttgctgattctgtgcctgctgcactaacaggttgatcagttgtgtctgttgagccagaatctgagctagcgtgggttctcctccattgttagtagctccacttccacttccacttccacttccggtgcgcgtgttcaccatctgacgataagcagagacaacaggaaagaatgacagagagacacccttagaacggagttatttaattaatttaaattctatattgctcttaactgtgtatgattacatttaagttgcattaacactatctcaccaactatcttacactctgacaagcaaaagaactagactcatgctgttacatcccaccaatgatgtaagcaacaactaaacccacacactcacaagcaaacttaaacaagcaatctaacacaacgaactatggcaacgttctaactaagcgtctacttccgccttgcgtcggaacgaaacgatgaatcttcttcctctggagtagctggctccctttctttatgatcttcctcttcttcctcatcacttatgatgtcgatgacaggttcagcacgattgggcatagcttcacccatcacgcgaatcttcgaagctaactggagacgaggtggcggacaggttctctttcttgcagtgaggcgaagcttggatattggcggcggcgtttctcctttaagttcagctaattccttctgtagacggtgcaccttgctcttcaacttgcaaatcttgccttgattccagttttccctgtcatgagctgctttgtctcgctccacacttactgcatccatagcactaagcatatgcaccacatgcatcagagtggcactctcttcaccatcaggacaggtataggttccatagtcttgaccatgagccttgtgaggatgatactggaaagctgatgaatccaactcttcttcaaagtgttgtcgcaactctccaatggccaccaaagctacttcttgacaagcatggcagtacgatcttcctccaacttcgaacttaaaggacggaaggtcttcactatcactagccaatgtcacacgaacacgacacttctcctcgtcggggtcatgggaaatttggcgatactcgggagcaacttcatagcctacctcaaaagccatcaacctcaactccctgacgaatcctaacacctcgatcaaatttctcggtgaatggggcggcatctaaagaaacatagaagagaagaattaatgcatatttttctaagttagctgcaccaactagacttaactgatttttgacccaaaaggaagaaaaataaaagaaaagacacatacaaagctattttataaatattttttttagaatttaactttttagacaggggcaaatatattattattttttttaacaaatatttaaaataaagctaagataattatgatctattataagcacggtacaatgtcaccataggaaagataagtagtactagtgctaacatgattaattcgataccataataaatgtacagtgccgactaatcaataaaattttgggtaaagagaaaaagaaacattttgaaaagaacaacctttttcttttaaaagaaaagaaattgaattaaataagttttgtgcataacctcgcatgtgctgccaacttaattaatttgtaagagaatagagaagagcagttctatttttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtctaggaatcaaccgaggcacacaatgacaatattgataatagagtacaaatgaataactatttaatattcgcaaataataaattattacagaggtagatagttcctctcaaagaaaaataacattctacgcagcggaaaaataaaactaaaacaatctacggaacagcgatggcgactccactccacaggcaacttaaccgagaacaagcctaatcctccagatcatcaccttcactgagatactcctcttctgatgaatgaatattgcaagaatgagcatataacatactcaacaagccacacaacaaatatgcaagtgcacaaaataacaaaggatggcacaatatagctcatttgcagaaaacagcatttaataaatatttaagagaatagtaaaacagttgtataattaatcaatattaaataaacaccatacaacatacccatgttgcataggcccaaccacatttgaacaaccaaccccggttgaacaaattaaacctccaaaccaggaattaaccattccaaaccaggaactaaattaattaccacataattaccattaatgagtagtgtgagactaatcacgaaaaacattgctcaactcacccataaccgcgggtacggctattcgaatagattaaaactctgatcagaggtgtaccactgtacccacaagacacaaccccacatcatgtcaccatgtgcctcaataccaccacggtacctcggaaaggagtcgtgacaatacccctcgcataacacaattcaccacagtgcaccgtacctggattataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttatccaagttttaattatcaattaattatcatcacacgatttaccatcgtgagctaccattgaatataaccctaattaataataataattatgtaatataatttatatttaaccccatttagttagctaatgtttctaagcatggctaagcaaacctacatatagcatttagctgaaccaatccaatatataaggttcatgccaatcaaattataacccataggaaaataaagtcatcttcggccattaaataattgggaaaggttcaccacccgatgacattcaaaaacaatgcatagttgaaaataaaataatagctttaaacgggatcaacatgctcaaagggttgtttgggatctgtgtgacttgccttgggcttccacaaatgcttcggaaccttcctcaatggaaacgctctcctccggaatgtcggaaactaaagcaaataaacaaaatcaataaaacagtacaaaaacaagcataaacagtacatgtggatatttttaacatgtagatcttgattttagaaaaatttagaaacttgaaccacctaaaacggatctacggttatttaattatgattttccgaagttttaatctattagaaaatcgggaaaaagaaaaagaaaaggaaacgatgacgtcagccctggagatgacgtcatgctgacgtcggcacggcggccggctcgggttgaggagctcgccggcgctagagcgatcggccgggcgattggagggcatctacgcgtagagggcaacgaggcgaacccgttggtactcaccactacggcaaacggtgcacgacggcggccggcgacgaggaggaaggcggcggcggttcgggtcgacggcggcgagcgggctccggtggtcggcggcgagagaggaggggcggccgggcttcctctcaccacggcgcacctatcggcggcaacggcgagcggcggcgacggcggagacggcgcggcggcgttgccgaagacggccggcggcggcggcgaacttggagcacgtcgcggcggcgctaggaggcacgggagagctcgggaaagggggcaaacggaagagaagaacaaggagaagctttatatggcattggatcgaagagatcgagctccaaacgggaggaatcgattcgggaagaaatcgaactcggtttttagggataaaacaaaacgaattcgattcggagagaatactcaacggatttctttgtttcttgaggggaaagaaagaggagatcgagaggaacaaaacccctcaatcaattggaagaatccgggtcggatttgggcggaaacggcggcgcaagacggcggctcgggctcggtctcggcggcggccggaggaaggagaagggcctgacatgtgggccccacatgtcagtgtcccgagagagaggggcacgggcggcggcggcttgggccggcgtgggccgcgcgcggggagagagagaaagagagagttgggccgaaaacggtccaacggctaaagaaggggttttttaaacttttttgaataaaacaatttgtgaaatgttgtttcaattattaaaaatacttcccttgctcaaataattcccagaaaaatctagaaaatagaggagcaagcatagtatttaataaaattttatctagctcacttttatgttgaaaattttcctagaaaattagggtttagcttgtaggcttttaaaataatttctaaaaattccaattaaacaacaatttatatatttaagatttttagggtgtgacaaacctaccccccttaaacggaatctcgtcctcgagattcagaagaactagcgaatagatgaggatgagctgacttcaattcatcttctcgctcccaggtggcttcttcttctgaatgattactccactgaaccttacagaaccgtataacgcgattcctggttttcctctcgctttcttccaaaattcttactggcttctcaacataagttaaatcttcttgaagctctatacgatcaggatcggcttcctccgtaggtacacgtaaacatttcttcagctgagacacgtggaacacgtcatgtattcccgccattgacggaggcaactctaactgataagctacttcacctcttcgactcacaatcttaaaaggtcccacaaaacgcggtgccaatttccctttggtttgaaaacgatgaacacctcgtaacggcgtaacccgaaggtatacataatctccttcttcgaaagccaaatctctgcgacgattgtcagcatagctcttctgacgtgactgagcaacgcgcaacctttcttggataatcttcactttttcttctgcctgtcgcaatatgtctgtcccgaagacttgacgttcaccggtttgatcccaaaggagcggcgtacgacattttcgaccatataatgcttcatacggagccatttgcaaactagcttgataactattgttatatgagaattctgcgtacggcaaattcttatcccaacttccaccaaaatctagaacacaggctctcaacatatcttctaaaatttggtttactctttccgtctgaccatctgtttgagggtgataagcagtactgaaattcaaacgggtacccaattctaattgtaatttctgccaaaacttcgaagtaaactggctacctctatctgacactatctttttaggaacaccatgcaaacataccactctggccatatataactctgcaagcttatgtcccgtataggttgtcttgacaggtatgaaatgagcgacttttgtcaacctatcaaccactacccaaatagaatcatgtcctgccgacgttctgtgtagaccggttataaaatccattcctatttcttcccacttccactctggaatcttcaacggttgtaacagaccagctggcttccgatgttctgccttgacccgctgacatacatcacacagagccacatattctgctatctcacgtcgcatactggcccaccagaattgttgctttaagtcctgatacatcttagtgtttccagggtgaatcgaatacaaagtttcatgagcttctttcatgatggtatccttcaactccttattatctgggacgcaaattctttctcctaaccatacggttccttgctcatcttctacaaaaccgatggctttacctcttctcatgttcttctttatttcctggatatcaggatcattcacttgagcttctctaatttgatcaaacagagtaggtttagcttccaaagtagccactaaaccttggctgactattcccaagttcaactttcaaattcttggcataactcccaaggtaaacgtctaccttctgacatattacagtaacttttcctgtgtcacaccctgattttcgtcttagggtttataaattatttaataaattaataatagattttatattaaatgttctttaatttacaagtgaagttaaatgtgggaaataaaattttctaaatataaagcatggatggatttaatttttattaaattctccatggttaattatactctctggaattttctcggatttttcggagctcaattattaattttaaaaggttaaaagagaagatcttttttttaatttgctaaatctcaatataaaattgagttagataaaattttattaaatactttacttgttcctctattttctagaattttctgggaattatttgagcaagggaaatatttttaataaatgaaacatcatttcacaaattgttttttttaaaaagttccaaaagccctcccttaagttgttgggccgattttggcccaacattccttctctccctagcggccgagccggcccaaaaccggccgagtcggctcaagccgagccggtcacccctctccctcaagccaccgacaggtgggccccacctgtcgggagcttcttcaagctctagcagccggccggccgaagccatgccgtgcccgagccgccctcttctccactccaaatccgctccgatctctcccaatttcttccgattgattgaggggttttgttcctctcaatctcctctatctttcccctcaagttttggaacaaatcgttgagtatcttgttcgaatcaaactcgttttcgagtttatctccaaaaccgagttttaatcttctcggatcaattcctctcgtttggagttcgatctcttcaatccaagcctatataaagcatcccctcatcctactctttagtttgccccctttcccgtgctctcccgtgctccgtagcgccgccgccacgccgagcaagccgccgccgccgccggccatcgtccagccgtgccgccgcgcctcctcagccgtcgccgccgcttcccctcgccgccgttaggtgcgccaagccgtggggaacctcggcagcctctcccccttcgctgccgaccaccgtagctcaccgtccacgtgcaagccgagccgccgcctttgtccgcctcgtcgccggccgtcatccgtcgtcgttcgtcgcgttggtgagtaccaacgggttcgtctcgtcgtcctctttgcataggtgtgctccaaagtcccggccgaggtcccaatctccggcgagcttgccaaccctagccctagccggccggccttgctttgctgatgtcagcatgacgtcgtgatgacgtcatcggtttttctttttcccgtttttctaatagtttaaatctttggaaaatcatatctaaataaccgtagatccgtttcaggtggttcaagttgctaaatttttctaaaataaagatctatatattaaaattgtccataaattgaattaaatttatttaattctttttaaatgggctttaaatagatttaatcttgtaaaattcataataaattcatttgaagtcagattgaggccgttcaagtctcataattcatttaaaattatgatctacatgtttgtttactttttatgtactgtttatttggtttttattagtctttttcttcgttttgcgtgttagcttgtcgtttccgtcgttacgaaggttcgcgagtgcgtcggaagtgttcaagaagattaattgaagactgattattgcaaggcaagtcacacagatcctaaacacaatcctttgagcatgttgattctatatttaaattctctatttatttcaactgtgcatttattttcgaatgtcaccgggtggtgtgaacctattcctttgttatggccaatttgcattgaatatcctattccttgataccttgggtaataaattgattagcttgaaccttatgtattggtttggttcagctaaatgttatatatatatataattgcttagcaatgcttagaaacattagctcactaatgggatgaatcaaatatactacattattatttatgcttatatttaatggtagctcacgatggttaatcgtgttatgataattaattggtaattaaaacctggttaaggtgggttgtgagcatatggttttgatggttgtgctcatgacaattaaggaccggttcgcgagctactgttgtgaaacattaaccgtaccaaccacaagccagcgtgggcaacggctttatctcttgtatagcatgattcattatagtgtgccagactgtgaagtggcgagaagtccatgggggtcgctggggagtccatgcctctggttgtagagggggtgattatgatccaggaatggtgcactgtggtgagttgtgttatgcagggggtaatgtcacagcctctattcgggtactttccagtatcgcgacgcatggtagacatgatgttgaggttgtgtcttgtgggtacagtggtacacctctggccagagtaaaactattcgaatagccgtgcccgcggttatgggcgagttgagcaatgtttttcgtgattagtctcacacctctcacaataaatatggatgttaatacttgctaataatttgcttagctcctggtttggagttagatttgttcagccgggtatggttgttcaggatggttgggcctgtgcagcatgggtgtgctgttcagtgttgattaaaatttctgattaattactccactgttttatttctcttaaatgttttgctaaatgctgcttttgcaaatgagcctatattatgccatcctttggtatctttgtgcacttgcatatttgctgtgtggcttgttgagtatgtcatatgctcattcttgcaataatcatcaaacctcagttgaagataaaggatccagaaggagaagacgtttggcttataccccagctgagctgcctgtgggagtggagccggagcttcgctagattttatttttccgttgctgttttcttttcttttgtaagtattaacgatattattatgatagatttgtatattaaattgtcagtttgtgtacctcggctgattcctggacgaggattttatgcacaaataagttcggaaattactagtgaattgctgggcgtgacaagttggtatcagagccatctcgactgtaggataagccaaatggtcaaacctgaaggactatttttccgaaaaaaataatttgtgaaaatttctcctttcttccttatctagaattctttgcaaattgtttcattgtctactctcttccctctttcaacttgagtagttgttaaacttgatggagaaactcgaagacgtcgatgttgtcaacttctgcaagtcaagtggatcgaggaataagaagatgatagtcgaatcaaagtgttcagctgtcaagatagagtgaagtttggaacctagtttagaacctatgccgccaaagtgtctttgaagaatagttagtagggtagaacgctgttgtttgctttgtgtgtaggtatggttgcattcccgtcattgatgtagtccagtgatgagcgtgcaactgtactaggttgtttgtttaatcaacttgaacaatataacgaactacacacatcagatcagtggtaacctagttaaggtcttatctttagtgtaacccctctccttctatcctttctaatctgcaatagatggtgaacactcgcgccagtggaagtggaaacaataacaatgaagagaacccaactcttgctcaagtgctggctcaacagacccaattgatcaacatgttagtgcaacaaatgcagaaccagcaagggaacaacaatgtcaatcctccgccgccgcagaacaagttagctgattttcttcgtgtgaggccacctaccttctctagcactaccaacccagtagaagcaggtgattggctgcacgctgttgagaagaagttggaattgctccagtgcacggatcaggagaaagttgttttcgcttcacatcagttgcaaggatctgcttcagaatggtgggatcatttccgaatgaacagagcagaaggacaaccaatcacttgggcggagttcactgaagcattcaagaagacacacatacctgcaggtgttgttgctttgaagaagcgtgagttccgggcgcttaagcaaaaggatcgtaccgtgacggaatatcttcatgagttcaatcgtctagctcgctatgctccagaagatgtgcgtactgacgaggaaaggcaggagaagtttttggaaggcttaaaggatgagctgtcagttatgttgatctctcatgactacgaggattttcaggagttggttgataaagcaattcgactggaagacaagaagaacaggatggacaatcgtaagagaggaaggattgttttccaggaggcacaggatagtagccagaggcagcgtatcaagccactccaaattggtgaaccttcttccgctagtcaagggcagtcgcaacagttgaacatcgctggtgagatcaactcagagactaatgcaagcaataaagacaatgatgagcaagctactcagtcagtgtcagttcagcaggatcagtctcaagtgaataacagtaatggaagggagcagcgggtgtgtttcaattgttatgagccaggtcacttcgtaaaagagtgtccgaagccgaagcgtcaacagccacaaggccaagtcaacaacattgtcttcacaggagcgaatgcagtgccggttgtgtcttcaagtgttacagctcagcgaccagtttcaaagcagtagtagttttctttaaagccttagaataattatcggagttatggaataagatagactgcagtttacctatgcctttttctttctagccgttccgaatctcgggacgagattctttgtaaggggggtagacttgtcacaccctgattttcgtcttagggtttataaattatttaataaattaataatagattttatattaaatgttctttaatttacaagtgaagttaaatgtgggaaataaaattttctaaatataaagcatggatggatttaatttttattaaattctccatggttaattatactctctggaattttctcggatttttcggagctcaattattaattttaaaaggttaaaagagaa

SEQ ID NO: 9877 - DNA, 30467 bp, Oryza sativa
gcatccctaccctccacttctacactcgctcgctgtccaaagagatgcggcaaattgagcttcgattatccctttggcataggacaaggttgtttccgccatgtcgatttcagtctcacatgcgacatggccactcagcctcctaaactcttcctgaacaatggatcgacagaggttcttggtgatattggggtagatggtctgaatatctattttatccacttcaacttaattccgatcacctccacccatgtcatccctataaattccggtggtgatgtctacaacttttcatggaaaaatccaggggattcttttacctttgcacgacagggcatgacatttgttgtcaccagctgtgacttggatgtatacatggtagatcaagaaaaaagcacacctattttgcttggcactatcgcttgtcccagcaaagagattgctgagatggtatacagacaggattctgaaggccctggttggtacactatagattcactaccagctcggacagttcagttacagtttgttcgtcacaagaccggtaatacccaaaagtactttaatctaaccatgttgtgggatagaatcaacattactgtgaaggccaaccttgcttggaatattgtggaccaaacaagatgcttgaataacatggaggatgacaggaagaaccatgcttgtatcagcaatcacagttcatgtgtctcctcgcagtatattgatgttggctatgcatgccggtgcaatgatggctacgttggaaatccctatattatggatggctgcaaactcgatgacggtaatttcttcatcatagcttttttttttttaatgttgtatcatatagtacctgcaaaagtccaaaatcagtgcctttatactcaaaactaagttacgcaaaaatagttttagtatatcatttttatacaaccctacggatataacacttcttctacatgctaactcacttgacttcttgataactcaatgctataaacctatatatttagcactaaataaaaattatcaagaaaaaaaatacaaatttagatttagcacaaaattgtttcatgcacaaagcaacaggtttattctataatatcacaaagctaagagggtcaactactaagagaggtatctgccccatgattaattaaggctctatttggtagtacaacttaaactccaagagagaattggatatcattagcttcaagaaatctagcttggagcttgagttatggctggattagagtttttaggttgagatgacttgttcacatttgagactagttttaaagatcaaactgctttactttaggttacaaacaagattttctccaacaacgtcttgttgttggaggcatagcaaataaaacatgccactatggttgaagttggagaaaaaaactatgaatattttgatatataaatatatatatatatataaatatatatatatataaatatatatatatatatatatatgcttggtacaatctcaagaattatggtattagtacagttaacagaaccacatctagtttatagctactctctccattttatattataagccgtttgactttttcttagtcaaaattatttaggtttgaccacgtttatagaaaaaattagcaacatctactacactaaattagtttcattaaattgaacattgaatatattttgataatatgtttgttttgtataaaaaatattagtatatctttgtataaacttggtcaaattttaagaagtttgactaagaaaaaagtctaatgactgagtagttgtttcttttatgtgggatatgtttctgcaaattttttctttcaaattttatactacatagcagatttttatggggtagaggtattacccacttgcatccctactagtgggctattttaagtggaatgatcgtagcagttggctgatggattccatatgtaaggcccggtttatatggcaaaatttttttgttttggggtgtcacattggatatacggacacatatttgaagtattaaacgttttctaataacaaaacaaattatatattccgccacaaaactgcgagacgaatttattaagtctaattaatccgtcattaacaaatatttactgtagcaccacattgtcaaacatggcgcaattaggcttaaaaatccgtctcacagtttacatgcaaactgtgtaattgtttttttatatttaatactccatacatgcgtccaaacatttgatgtgatgggtgaaaagttttttgttttaggaagtaaacaggcccaaagaattgctaaacttgttaaaagtgtagtcaaatgatactctagtgccacagttgttacataaatttgttaaatgtggattccatatttataagaatagctaaattgggtttcattaaacttactatttttccactatctcccggatcgaagtcttaccatttgatgcatttttcttcaatttagcttagccggtgttttacttgcaaaaaaatatattttgtgggcagtgatactagtgtccgcactacaggagaactcatcttttatccaatgccgcaaactacaattacaccggatgtagtaagaactgttactaaaatcactttattaccagttctaaaagcccaagtcctcaaaaatatctttagtttgctaaagatacatttttagtaccggctggtattacgaaccgggactaaagatatttttttttaaacatgcctctagggttagtttaaaaagaatgtatctctatccaagtcaaatttgtatagtaggtggaatggtaatacttatgagggttgaggttagagattttgagttcaaatcccatatcttcacatattttttgattttaccggaactaaaaattaagaactttagtcacgatttctttgtctcagttgctacaatcgaaattaataggggctgagaagtggtaccaaatatcatctctcctagtgccagatacaacatatgggattcgaacccaaaacctctctccacgtatacatttcttactttgtttcatacagggcacttgtgtaaaaagcatctgatattcttttgactctttaatttggtccaaaatttttaatgcatatttgacactatggatgatttcaaatgaaaaagttatcgactgtaaattaggtcatagatttcgtcaagctctacagcgtactttattatattatatgtgcacgtctagtagatattctccaaattgacttgagcatatctaatgcatactcaggtatataaacaatctcaaatattaaagttgacaagtacgtacaaagtttgttgatacaatattgataataaaatgtgttttgatccagcttcatgtctagttaataatcttttaaaacaagaaccattatttaagtatgcctgttcctgacttcctatccctgccggttcataggattacattgttgattctaaaagaaccggtagtgatgggacggtttggaaggccatttctacaatagcgtgtcaggtataatatgacataaattagtaatcccttcatcccaaaatataagcaattttagaatagtgataaatcaaatatttttaactttgactattaatagaaaaaaatcaaacatgtaaaaatgatattactagtggatttatcattaaataaaccttcctacttggtacctggttaattaaaaacatcttgtttttaagaaagacttgatgggccaagtttccttttaaagacggtgtatgaacctaaaattactatatgttttttaaattgagcgaagattcgcttgctatctatttgcatctatgaaggccatgtttagttcccacgcaaaaacttttcaccctgtcaaatctaatgtttagacagatgtatggagtattaaatatagacaaaaaaaactaattacatagattgtgtgtaaattgcgagacgaatcttttaaacctaattgctctatgatttgacaatgtggtactacagtaaacatttgctaatgatggattaattaggcttaataaatttgtctcgcagtttacacgtggaatctgtaatttgttttgttattagtttacatttaatacttaaatgtgtgttcgtatatccagtataacacgccaaaacttttcacccctgaaactaaacattgccgaaattatttgcttgtatcgactgttatatggtctcggataatttaaattttgttcatgtaactcgcaggttataacccaagaccacaaaaacataattgctctcgacaatgtggaacaatcgttgtcccatttccttttggccttgaagagggttgtgccgccagggaagtgtttcagctctcgtgcctaggcaagccaaattctgtgctgcagtacaatgacttcatcggtgttcagtatataaatgtcagtgaggggcttgttggcattaaatacaactcatctttcgtggagatcttattcaatatgttttcgcaattcagattttcatctcaaggagtagtatccaacatatttggtaaagggcctaacctgtatgtggatccaacggaatcagcctcggtgcagtgggcagttgccaatctgacctgccaacaggcgcagcaaaacacttcgacatatgcttgtgtaagtaccaatagctcctgctccagggtcatcagcaccatgcaaggttatgttggctacaggtgtacttgtttgcctggttatgatggaaatccatatatcccagatgggtgtaaaggtaattatctctttgaccaacttagaattcaaccagatgggatacatatatatatatatactatatcctcttatagttttctggtgtggaattctgtcttgtacaaatatgaagtctctaattttaatgtttcaaatatttttattgaataaacatttactgaatagttatttgatcagttattgttacactatacattgacatgctgagatatggttgcagatattgacgaatgcctacaaacaccacggattgcaaggaactttgccacaatactgaaggaaactacagctgcaccatgtgccctgatcatacagagtatgacgttataagaatgcagtgcactccaagaagaaaccaaagtctcttgttaggtagtctcataataatcaattccacactgacaaaagggtgtatgaagatattacaaatgcgatgttatcattgtaggtattataattggccttaccattggatttggtgtgttgattcttagctcgattgtaatagctatcattagaagatggaaaagagatgtccataaaaaaatacggagaaaatatttccaaaagaaccaaggcctcctcctagaacaattgatatcatcagatgaaagtgctagtgagaagacaaagattttctccatagaagagctaaaaagggcaacaaataactttgattccacacgtatcctagggcatggaggacatggcactatctacaaaggtatcttatcaaaccaacatgtggtagccataaaaaaagccaaagtcataaaggaaggtgagatcaacgatttcatcaacgaggttgccatactttctctaataaatcacagaaatattgttaaactctttggatgttgtcttgaaactgaggtccccttattagtctatgactttatcccaaacggttcattatttgaacttcttcatcatgattcaagtagcacattcccattgtcatggggcgaccgcttaaggattgcagcagaggccgcaggagctctatgctatctacattctgcagcatctatatcgatcttccaccgtgatgtgaagtcctctaatatactgttggatgcaaattataccgctaaagtttcggatttcggcgcttcaagatctgttccagttgaccaaagccatgttgttacaaatgtacagggcacgttcggttacttggatccagaatattaccaaaccgggcagctaaatgagaagagtgatgtctacagctttggtgtggtactcttggagcttcttctaagaatgcaacctatttttacaacaatgtcagggatgaaacaaaatttgtgtacttacttcctttcggagattaagaccagaccaattatagatttggtagatcctccggttcttgacaaggcaaatgaagaagatattagacaagttgcctcccttgctgagatgtgcataaagctaaaaggtgaagaaaggcctacaatgaggcaagtagagataacactgcagcttttacgaacagaaaagatgaccccatcacatgttagtccagacagaaaccaagagatagaatcactactgactcaaggagccattgaccaagtgattcatgctttagtaaatgttgacagagctaatgtagcatctcaacgctctcaaacctcatgctatagcttggagaaagaattcttgtcatctgctagcctaccacggtagaagtgtttatcctttgtcccttgtgtttggcgttctttgtacttaaaacatttcctgtgttcatagcacaaatttacatacatgtgtaccgtttatattgtaatgtttgtatatggtagttgtactcggttcagtataaaccacatcttaatgtatggactcaagaatgtttattgcataatattaatttagaggattaagttagttatatttttagacggtgaagtggcggtgcttcagctctgtggaaaacatgctggtgctagtcttgttatattattttttacaaaaccaatctactgatattgctccagctgcttccagatcacatggcccagccggttctagtgagaaggagatgaaaatactgtaaaacaccaaatatttaaaatgccaatataactatttcctccaagcttcttctttcccttcaagcacctgtttggacgagattctagcagctacaacttctcctagaatcagaatcttcccaaatagtctagcttttgtccagattctaaaaagttgtagtcgtaaaatctaaaaaatgaactagaaaccgaaaatttgaaaacctagtttctccagattctcagaggatagctacaaccagctttcttggaatcataaggtccttcaaataggctctcaatctctcaaatttttacctgattcctaatgcatcttagtgaaagcctccttctgctatagtgctataagcctagcacttgctctgcataggactcgttttgggtgtcagggcataacattttacagtctataagagaacagtgcagcttcagtagaaatgtcaccacctcaaaagccaaaaaagcataggaaagatgataaatctaccattttgggttttggtagcacaattattgtagctaccattgaatactttgtgacactgaagaatttctttgtggctaactggtttactttacttacaaaagtgaaccagcttttgtgtctcatacaatgaaaccaaacagatgttaggaaacaaagcaactcacacgaatacaggctacactaggcaacggggaagaaacacaaacacaggcaaacacacatgagagctttgtggcaccgaaacaacttgtgcctttttctctttttcttctcataaacacaagctagttatagatatatatactccgtatatagaaacacatgtagtcacgagctggttagcacgtgttccactaactacattctcagccagtatacccggtaactaaccactaactaaacctctaagctaatgcatattcacacaactcagtctccgatcagtgcatgcatgcaaactgaccatttcctactcctaaacttgtgctcttacctcctggctgtttattggcgcactactcactaagccacgcagcaccaacgtacacagctagctctccacgccatgcaacacacacgtatgcatctagataaacatgctgatattaaaaaaacaacagattcgtgtgcagcattacagaggtaatcaagattaatttataataacagattcgtgtccagactactggagaaaccatctttcgtcggtcgtccaaaaaccacaatagtcccggttcgaataggaaccgggactaaaaatgtttgaccaaccgggactaaagatcatttttagtcccggttcaaagaagttaccaaatctagttaggccccaattaactttagtcccggttggtataaacaaccgggactaaaaatatatctttagtcccgtttgtttatcccaacaggtaccaaaaatcctcccaaaccgcgcgcgcgccaagtccaagacttatcgatccccttcccttcctctctccctctttaatatcggcctcatctcgatccaaatccaaccgcgtatgcacttcccctctcctctccccttcctccgcttcacctctccggatcccccctctcctccccctccctaccaagtcctctcctcttgctctctgggtcggcggcggccgctgggtgggcgcgatggcgggtgggtgggagcggtggcgaccgggcgggcgcggcggcggcctcgcgctcccctccgccagatccggagcggaggggatggcggcagcggcggccggtggccggaagcgccctctccagctgtgcgcgcatgcatggaggccggccgggcatccctctgccggagatttgtcttcttttttaaaaaaaaattgtgattcattgtattgattgagatgaagaatttgtgattcgttggatggattgagatgcataatttctttttttgttgagaatatgtaattcattgcatggatatgagatgtataatctgtgatgtatttgatttgtggtatttgggatgttagtttgatttggggatatacatcccactggatttgggagaaaatcactagaaaaaaacaataaaaaaaaagaaactaatcgggactgccgctgtactctttagtcccggttattccacccgggactaaagatatccatcccggatttgtaatcccggttggaaaaccgggactaagggggttcccaaccgggactataaaaggtttatccagtagtgagtagtggcagcattacagaggtaatcaagattaatttctaacaacagattcgtgtgcagcattacagaggtaatacaatcagaatttgggccatattcaggttcatgtaattgtttttttttttttgcctgctgccttcatttcatcaaggactaagtctacgtgtctccctcatcaaatagcatccctcaactataaaactgggtataacacctccctcaacgtaaaaaaaatagatcaaagataatcccaaggtagtactaacccggttttggccacatggcatctacatgacacttctcaatgtgaaaatcgattattgcatgcggccaataactcgctggctgtttgggaagatcgtgtcccctatgtgatataatacttcccgctatttctaatctaaatctgaaatactatgcatagaacctaactgagttattgttcttagcatataataattagaatttttgcattgacaaataaacaaactttccatatataaaacagaaaacatttatatacatatatctgttagtgatatgccctagaggcaatcatagaaatgattgtatcacatactatgtttacatatttatccgacattgttccttgaaatagataactcattattggttaatgaatatgtgattctttcatgagactctttatgttgtttgttactatttctaaaggatccctgatcaaatatcatatgtggaacaaatatgattagatgatcagcacatgtattaattgatgatcgtgtctcatggatcatggtatagagataccaaattaataatgtggacacatgttagtgaacatgttgttggatagacccaacatgagacactgcaagagccatatgtgttgtgtcattagtgatctcatttagtgttggtgttgaatccttagacctgagattatcatggttcccaacatatgtagtagcttacttagggactgctaaacgctacttcgtaatagggtagttataaaagtagttttcggttatgctatgaaacatgtagtgagatatgaataatcaagatgggatttgcccgtcctatggagagatatctctgggcccctcgatgttgtagattatggaagtaaatggccatgccacaggtgattgaggagtcaatcacaagttatataatctatcaacaagttcgagtgaatgattgagctattagaggatggcacatatctagccttgagcttaatctatatcgtgaggcaaaggggttcatacaagtatacactagaggttcagccgatatgatctttatgtatgcccggtgggtcaatacgttctgctaggggccgctgttgacacgtggactgaaaaggagttttcgggttacagccgagtgtacatgaacctacagggtcgcacgattaatgggccagaataaggggattggatggagatccaatatgagtttaattcggacagggatccgaataggagtccaacgggccttggaggcccgagtgatggatcctatatattcgtgagaggtgtgaccggcggaggcattgcatcacgtgagaaactctagccgtcacttccctccccgagcaaaaccctagccgcaggcgggtgctagcacatctgcgcgtggcgttccgtccctgtatgtgtggataccggtagaggcgccactggtttgcggtgctaattggtgtgggagtacggcgaggagaacgcacgagaagaagaaggtcgagtcggtgcgatcgactacttcctctacatcgatgcgcgctacttcgcgagaattccttcgacttcttagcgcccttttccgctgcgcagcgcgtcgagtgctaacgatatatgatctaatacttgcatggttcctggtttatgtgatataaaattttgatttatgctatcgtagcctacgcgtatcccaacaatatctatacatttaaacatttctgtcccaaacattacaaattagcgattgtttcaacacaaacgaaatagtaaatttttactgcatatgttctttccccactctcttaggggcttgaatttatcttctaatgccagctgactctcattgtcgtaagattgccctagtgcgttgcagcaatcacagcggataaagtggcaaatgtcagcgcataccttcataattgttgtgttgtcgaaccggtttgctacataagagatttcaggggtctgaggaaaaaagacaataaatattacaaattgaattgcgatgaaatattctgtatagagaacaatgttaggacttacgtgattgatgtttgttgtgtacctcctgttgaccctaagcatctccaacatgtaatacccacataggttagtgctcgagggttgcttgaagcactgcgaacataataattacaccggtcattataaacaagtaatcattcaaagaatttgtgttcatggaatatgtcagtaccaccgacctatcttgacgtgtagctttgtcctttccggatcctttactgccccgtgatgtttgcggtaaaacctaagtgtgctatgctaataaaatatttgtttgagttacttaaaaattctagagggtaaatttagaattgtgaggaactccatgaaggtttccttgttttagtgtgtcgggtcgagtgctacaaccgattagtccctcgtatatactacgaataagatatagtggtcgctacaaacaagaaagatttattagagacttcatttgttattaatgatgtattactacataaataatgatgaattaagacatttatgtctttgtgcgagagcgtcccaagtatgtcgctacctcggtcatcttatccttgtgcaatttcttaatgtatgcttccttttcctccgatgtcttatccttgtgcaatctccgtctagctctcccctctcttccaggtgatctctaggccaacggccggtgaggagaggaccagcggccggtgagagaagaccaaggaggcagcatctcctgtctcccgggtgtggaataaggagggccaagacacacagatcatgcgcgcatgcgtggattacagctgcatgctccaccaccgcgccccaccatagcaccagcgcctcctctagccctcctgtggccacctgttggtattttctactatcatagataaatacgtaagaccatgaatacttctgtagcacttcaccttagagtatttcaagggtatcgaatcacaggaaacgtgtgtctatatctaacaacaaaatcctctccgagcacaacaacaaatggtaggcttcggctagagggaatgcatatggtttaattaaggaaaaagtacgaattattcccccgccccctgaactatcatggtcaaccgaattacccccataaacccaaaaattagacaacgttcaccctcaactttcaataccggacaaattatccacctcgaaccaatctagagcggttttgtcctatgtggcatacgcgtggcaatctagttatcattttatttattaaaaaaatatgggacccacctgtcgtactcctcttccccctcttcctctctctcttctctctcccctcttctctctctctctctcagaagttgccgagagcaaccggcgatgggcgcggcaggtgatgggcatggcgggggcatggcgtgcggcgagcggcgagcatggcggatctccccaccaccgtttcctgttctcccgctgcccgccaccggatctccctgccaccgactcctccactgccgccgccccccgccagatctccctgccaccgacgcggcgacgcctcttggaagccgtcgccgacaccgcttctccatcgccgacggggttcgcctccacctcagctgggccatcatcgtcgaccaccctacccaagccatcactgcccgctaccggcgtcatccacatcggtgcaccacaccctcctccaattcctgatccaccgccggcctcccttggctgagtcatcaccgcccgccgccggcgccatcctccgcatccctaggtagagggcgggcccgatccaaccggctgtgcccccgccacgcccgctgcccaccgcgcccccgccatgccagccgccggccaccgggtcgcactcacgacgggcgtctgagagagagattgtgaggaagaggggaaagtgataggtgtgagtgcatgacaggtgggccccactatttttaaaaaagaaaaatgctgactggattgccacgcgtacgccacataggacaaaaccactatggattgggtcgaggggggttattcgtctggtatagatagttcagggtttaaaatatccggttttatggttcaggggggataattcatactgttgtcatagttcagggggtacttcgtacttgttcctttaattaacaatacttaagttaaaggtaaaacactataactctatgacataccgaccgtttagggatacaaagaatggacatggctatcaccacctgctgcctccctcacttccaggaagcacacaacaaacgaaggtaaccactaacctagaccaacgtctaagttattgattactactccagcctcacacaagaactttcttcttcatctagaattctagtgctggagcacttaaatactaggcgacaaacctgcaatgatggaaatatatctcactaatatagtaaattaaataccaaaaggaaacctcaaacacttactttattaaaagaagcattcgccgaggtacaaacgagaagagagcgccgacaattcaggcactcctccggaacttctcctcactctctacctaatttcaacactactaaagtgagttctactccactttgttgtgtttttgcgattgaatgagttcctccttttatagcctctaataaaggttggaatgacggttgtggaggtcagtgcacccacaaccgccatcaccatcaaatgtgcagctgccacgtgcaagggggtggccagggtgccatgtttggttcagccgaaccaggccgccaccttcagccatcgaccttcttcaaggaggttggcatgtggggccttatggcgatgcactgtggataagaccctttctggtcgattttgactatcatgtgggccctccaatccatgtgctcgcgtatgattggctggaggtatatttcgttgcatggaggatgtaaattctttgaaaatcacctacatgcatatatttaccaatacaagtggaaacaattagtaataaacccctaccattgagtttaatattaaatttaacaaccattaacaatacccccacaattatcctttacactcgctgagtgaagctcatggatttcaacagtgcaaggacttcctgtataatggtacaaacgtacaatgtattccagaccatacctggacccgtgaactttgaagtgtctaccatatcatcttgggtgcaatggctttgactcaagttgcattcttcccttgttgtcaagaaaatagtgagaatgaggcgatgttctgaagagtgtcggaattgtcggtgttctctgctcgcttgtacctcgacgaatgcttctttaataaagtaactgttcgagaattccttttggtattaatttagtagattaagtgagatatactcccatcgtagcgggttcgtcgcttagaaattatattaactgctctagtactaggactctggatgaagaagaaagttcctgcacgaggctacagtagtaatcaataacttaggcgtggtgtctaggttagcgatacatttgtttgttgtgtgctccacggaaagtgtggtggcggtaggtggtgacagccccgtccgtcctttgtatctctccatgtttgggtacatcataatgctacaaaccagactctgcttggcagactaggggagagccggtgcccaaagcaatcgatagggttttatctttatctttggtatagttaattaatccaaaggaaacctctctttcctaagcctaccattaggtattgtttttggatagaatttagttcctagatatacacacatgttcccgcagattcgatacccttggaatactctaaggtgaaggtatatagcggtattcatgcatttacaaatttatctatcaccgtaacaaataccaacaagcatttcttgtggcgttgccaaggaatggttgttgtatcatcttcaaacttggttcatcctctattttttcatttattttattcctctcttattaccaaccatagagcatcaatctattcaaaacttttctgctccaaagcgcgagtcctgtgaaccacctctttcttcaaaagcaattcattcatctagctatgaactccacctaactttgtagccatggttcggcaacaatccttctcgggtgttgatggttgttaagtaccaattccgatcgccaactagcacaatgagtaaagggaaaattagcatttcgtacatgtataccaataataaataatgtagatgtattaggattggtgaattaaattggttgcagaaattatacacaaaagtggaggagaaatgatgccggcatgcaaagaaacacacttgaggggcccacgagtcagctcaaaccgactcaaattgcggccaaccacttgttatccaccgaccaaagtcggtggagtaaggcggttactctagtgcgaactaggcctggcgtcgctcatctccctcctccacatggacgctccagatgatctcctattgacgattactatataataggtcggtggcctacaaaccaccttaatcaaccgtcactgaagcgtatttaaggagtggagattctcacttcacaacacacacctcaaggagcaattccctcttccactttgtaatctctatagtttctagtagtaataaagtttaggagcttctatcctgtagacttcctggagttctgggtacgtttctagtactttcctcattttataagactatggctgaattaatagaattatcttctttatttatttatgctcatggtttatatatttatttattgagtatgtgttctaagagtagtgtatgctttgtatatctgcttcatcctaggctagtcgatcaatgttacggtaatggtccaatgacctttataggttgctctagcttcaacttgttcatcggtaaggtgaaagtcctgaggagttagtgatattatttactggcataagcatggtttttaggctatataaatgccgttggatgcgagtctgccccacggaaaagtgaggtaggcagcaagtttgacagccatgtccgtcctttgtattcctcctcgttcgggtatgacataagagtgcgtaaatgccataaccacgctggcagaccagcagggagtggtctctcggtagtacctgggtgcatggaactatgtcctatgttgtaactgttgacggtcgttatcgatcagttttgaccgtcaatactaccaaaataggagagaactagtgatgcttgcaatgcataaatatgttagagtaataattttccactagtattaggtttactaaccttttgcagagaatgacaataaagtggaggagaatcgacatcaacttagatgataaatcaataggacgatgtcgagaaccagacttatgaatagatgggccaagaactcagaactaacacgatgaattgggccaaaattcacaagtatgcggactggagcaatagaggaggccaccagccgaaattgggctggattgggccagccccaggatcggccgaggccgaaccaatcttggcgccgttggatctaggttttggagtggacgtccaggattgcatcccaataacgattggagggcactccggagaattccccttccacaaccgtcataactacctttatataaggagctcactctcttcacttcacacacacctcaagcaatagctctctcttacgtcaaaaaaatcaatagccctctcatttctctcaagtttagtttagtagtatttagctggtggaataggaatagagtagaaatcagaatccggaagccttcggaagagttcgagtatggctctagcagcttttctcttctcttttgtaagctttgtacttttattagaatactcttataaatacatttatggtattgaaatactttccaagtatatgagtacctactttacgttatgttcttgttatattgtatgtacggctagcttatttaggagatgctttggtgcgggtataatgtttgcttgtgcaattactctatgtcatgacgatgatattagagtagtatctggtagtttaggcgtggtgtcttagattacgggatatcattatttggggttatatattgcggatgagtggttggccgctgatggtgacaactcagtacggttattcctccgggcctatatataatcctaagttaattccctggggagggtattcctccgtatttagccccggttgtatggtcatgacgggctgtcgtaaggaactcggcagtcaggggtggtttctcgacttactaggagggcatcggaaagagggtattagctagtatatcagttaaataggatgtatgtatactatgtatattagaagtataggaatagattatctttctcttttctttccacctagcctagataatatatatattgagaatgagtagttaatgcttgtatgccactctacccttggattatcttaacccctgcttagaatataattatcacaagcaatgcataaattattagtccagttctctctacatgatcttcccacgagataaaatatgatcttcccacgagataaaataaatacgatacccttggaatactctcgggtgaaatgctacgatggtatatccgtgcgctcgcggatgaactctataaccataatataccagaagtatttctgcgccattgctgggaattatatttctagtaatgtcgttaagaaaatagtaaccatggataagttaagtgtatactagacatgattactataaaagtacatatgaatcatagttacctaaagaaaactccgtactagatatttttatagacgtgaatcccttgtgtgtgtccactaccatatcattatttatcctaacctctgtttagactatggtgaattaattatacattgattaagagatataaaagaaagaacatatctttatactgtcgccttcccagcgaaaatataaatacgatactcctgggaatactcttgcgaatttatctgtgattgtaagaaataccaatatcgggcgcgaaagaaaaaatccctaccatcatccgcatgatcctgagcaattatattcatgcctaacaatagcgggcatgacacaagaaaccttaaagtggaaatcgtttcccttctttcttacagagggggcaaaaaagtggtacacccataccttaaaatattacatggcgaatgagaggaattaaaaagcaggttctgccttggtgtcttcccactaacgcgtgtagtctctctacgtatggaggttctctgcttccgacaaaatgagaaggaatccatcggtgtagcctaggctcggtttttcttcttaactcaagatggctagacttgtctctgcccgatcatgtgttgttacaacatttttggttgggtttaggcaagccatgtatctcgttacatccaccggaagttcgttcgcacacaaaacaacatcaaaaggaaggaaactcttatatcgtatcctggagaacacctctttcgtttgttgcgacaatatccaggaaatcaaggatacaaatgaggagccatcaaccgtcaaatcggaacatacatcctccacatttcaaccgttgaatcctcacccaaaccatggaaacaggacaaagaagaaattcagccttcaaaattacctttcctgtttgtgggtaactttttttttgaagattatggaaatacctcaaactattcttgccaaaagagaccaccagtctcgtgcagttctcctgtaccactcgagaaaattttcctcaaagatatggtgtaggaattaactaccgtcatgagtgatgagtggttaagggaggtggaactttcctctcaagcaattcagatttttgttcccgtccttaactattccttgcctcatgagagaggtcatggcgcaaaccctttataatcccactattggttcaaacattatgtccataacctttgcattaaatttcttaggggatgaaccattagcaccaatggataaaaccttccgagcccatctattcctatcatcaaaggtcatgttactcttcgttgtgccaataagacaaaaagatgtcaaggctatcctggattttcatgcattcaaattctccaaattctatattctcatagaccatcccatagaaaaacttcttacagatgtgccgcaaaccggtgtcatcaacatcaaactcgggataaatgtgtttccatcccgatcttatgatcgtgaaactctttgacagaacctataccccgatttcgagccaatcgaggaagtgttggctgtagattgtggttaagtatcgatttcgactgtcaactatgttaataaataaggggagaactagcatttcttatacgtatatcatttataaataatgtagttccacctgtattgcagaaatactacggatgcaggaattatacactatattaaatgagaaatgagctagcatgcaaagaaacacatgtccggcgaatcatgtgcgagcacacggattaatggtcccacaagtcagaccaaaccgacttaaagtgggaccaaactctcgtgcactgaccaaggggctcacctgtcatccactgaaggcggtttcccttgttcggccaaacttggagtggcacccctcggccccccatcctccacgtgtcaactccataactactcttaatgacggttaggggggtgcactgacctccctaaccatcaagtatcaaagtatgaagaatggacagaggacagtgctctgacatgtaatttttgtgatgtctattatattctttggaattctgtttacatgcaattttttctgtccctttttttatatttagagaggttttttttcaactacaatttgtagttgcagacatgcagctatgctagttgcacttccggatgttgtagttgacgttataaattttatgcaagttcagtgataaatttgtgcaactaatgttttttcatccactctctcccatctgctttttttttatcgatttatcactttcttgtttctcttctccccgtgggatgaatctggtgcttttttcccactagcttcatgtgaatggcaaaagtaaccccaattcgcatgcgtacccaggaaattagtttattgtgtcggcccacaccaaaacatgggccatgaaacaaaacataaccagaaacctatgagataagtttattttgccttcctcatgtcttgatccctcaaccacaaaacgtatattgcctgccccaagtgtaaaactagtgaaaaatgactcccctggtggtttttgacagtggtttcactgatgaggcagccttgtcatctgaaaaaatttaaaaaaatatgtcaaggcccacatataagtggcacttctcttcttccccctccaccactcacctctctcctctcccatctctctccccgcacaaagcacgacctctaccaagggacgtgcaaccaggggaggcaccaaaagcgcaagaggggcgtggaccgcagaaggatgcaggcacggaccgcaggggagaggctcgccggctgcggcgcacgtgtaggtgagggttcgcctaccacggtgtgcacggggggaggagctcgctggccacagcacgcgcgggggaggggctcatgagctaggacagcatggtgcctcctctatggtcagctccgccgacggcgatggctacagctgcttggcggcggcgttgccgacaaccttgccggtgtctggctgcttgagctcgccatgggaggagacctccgaggaatcctccttgagcttcttctccttcctcttggtgattagcttcttcagtcacctcttcttcttcctcttggtgggatgggtcatcaaatcgccgttgcagccgacgatgagatggctcctctcatcgctgtcggtccaaagggaggagatggagacctcgctccccttgtcgagatttgcagagctcaacctggtcattaccaacgccacctcccggatcgacgagaaaacgcgacagccacacaaatccagtagctcagcggtggtctccgccatgggagggcatggttggggccggcaacaggaggagtaggacctagcaggcagcagtgtcttgacatcgatggcagcgataggagccatggtgggagacagcggcacatggggttgttgaggaaaggggaaggggcggtgtcaccacagaacccgcgagcagccggccgacgatctcctccccacacacgtcacagctggctaatgaggtcctctttccacacgtggttgtctcactgcccgacgaggcatcgccgcctagttcctcttccgacaaaggtgccgacaacggccttccgcactcggagccatcaaatgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccataggcaaaactcaactggggtctgagccttggtcctctaactccatcttcagctcagaagcactacacttctgaaagggggaataatagcaagactgagtacaaccaccgtactcagcaagccacaccaacgatgcagatgtgcaaggggatacaaggatggtttgtggctatttgcataaaggcggttgtaaaacattttattgagcaaacagtaaaactgttgagtaattaaagtaacattaaatctccactaatcaacgctacaccacgttgaacaggcccaaccaacccacctgaactacagtgtattgggtcgatttattaattgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcaggcaacgggcagtcccctctcgtgccaaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttctagggcatcccgcgaaccggtccttaattgccatgggtgtgactagcaaaaccatgcacccacagcccaccattcagtcgcattttagttggataattacgaccatgaagcatggccagatgtctcgagcacacagctcaacaagatactagaatgtctaatactgcaattatcccatcgactgagctagtggtaattaagcatggctaagcatatagttctagctaggtcatcaaagtaacaccagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgtgatcttccgaaacgacgggaactacacgctggcacgcaaaacgaggaaaaactctaataaaaaccaagaaaacagtacataaaaactaaacaaacatgtagagctcaattttagatgaattttgcaagttgaatggctcaattcggagttcgaatgaattaggtatgaattttagaagttttaagccatttaaatgaatttctagaattaaactcgatttattgcgcaattattatttatttttacaaaggaaaaaggctatgctgacgtcagcaaggggtgaggcgcggaccgcgtcacaaaggggcgggccccacatgtcagcggcaaagcccaccgtggaccgagtccacggcggcagccggccacgtgggcgcgcacccgacgctccggatcggctggggccgatcggacggccgggggcagccgagcggcacgaccaggcaggcacgcccacaggcggcggcgaccgccgagcctagaccaccggcgacgacgccggcggcgagcggcgacggcgcgagagccggcgagagagtggagagggaggcggttctcaccgagcgaatggggcggcgagacgaagacgaggaggtggctggcggcacggaataggcggtggcgggctcaccggggatcgaaaggaatggagcaccggtgggtttccggtggtttggagcggcgaccgatctgtggcttgaagcggccgagccggtgaaggaaacggcacggcttggcggtggccagggcgacggcagaggtgcgactggaggcacaaaagtggctgtggctcgggttcaccgtggagcgggcggctcgggggtggaatggaggagcggcgtggtggccgggcttgccggcggagcagcgaagctagtggtggtggcggcgcggcttgaggtggacgggaacggcggcaagaggctgccgaaggcggcgaaacggcggcggtgctcgggtgagcgatggaatcggtgtattgattgtggtttggggaaacggagttgcggacggtgtgcgacaatgcgtggcgaggccggtggcgcaagcggcgtggcgcggggacggctacggcggcggaggtggccggccggagatggcaaccggcggcggcggagggaggttggtggtggcggagtggtttcgggcatggggaagcttgggaaagagggggaaacggaggaggggagcccgggggtcgtttttatagcctcgagagtcgacgggggggccggttggcgacggatttgaagggggaaaggggcgccggcgacgtgggtgagtgggggcagtttggcgccggttttggaggggagaagtgggggaaatggtggaggaaggggatgacgtggggtggaccgcgcccacacgcgcgcgggaatcggaagacgcgcggggaggggcggcgacgtgggcggctcgggcggccatggcagttgccggcccgggctggaggttggggatgacaggtggggcccacgggtcccacctgtcggcctgagtgagaggggaggccaggagggaggaaaagcggacttgcgccaaaaggggaggcaagccgggccgcgggaggggaaggagagaggattttgggccgagcccgaaagggaggaaggggaagtttattttgttttctttttatttaaattagtttaatgaacttggtgactttaaaattatttcttgaactccgaaaattcatggaaaaatccggagagtattttagggcacaaagaatattgcgaaatattcccggccaatgatttttaagggaaaattttaattctcccattatttcacttgattaaattgatttaacttttatttaatttctagaaaatacattatttaatgatttttaaacccgaacgaaaatcggggcgttacaaacctcccactgcggcggcgcactctgaccccaacctctagttctctgagacaggcgatgacttttagggtttctagtcaaggtcgccatgaggtggcggcgcggccgccaccaccaccctttagtctcgcatggggagaatcggagaagggaggagaggaagaagaaagggagaagtggggttgacaggtgtgtcccaccattttttatttttactcttgtcgtttacatgtgagaccctttttttattatttttttattttttaatgactgagatgccacatcagcatactcggacaagtcaacatgccatgtcagcaaaaaaaaaagctttcaaaaccactaaaggagttaatttgcactggtttctgggagacgtgttatacccggttttacagttgactgatgcaattcgacgatgggcaagacataagggactcaaaatagacttactccaaaacctattggagtggacgggtgaacccgataatgacccaagagcccgtttaagcaggattagtgatccacgggccacttgttgctattgttgtatagctattggatgtatatatccaacggttagtagaatcgactaatggatctgactttttacaggcgattgaccaatagactgtcccgtattattacacaggcaaaatatagttccaataaaatcgcgtgaaaatgctactacctgacaggtaaggtgtggaagcgagacacaaacagatttgtctccaccaatcccctctcaggccattcatttcgatatcgttttctcgaactggaaaccgtcgcgaattgggtcttgcttgcaaattgcagtggtcgattattgcctgcccttgtcatcccctagcagaaacgtagtggtaacgctaacgtcgacgacgaacttaattagctgtactccttccatttcatttctgggtttcaatctgtacatataagtggatttttttaatagagagaatcagagagccccgtatgagtgggtccaatcggaagttagtttgtccggtacattacatgtcacgtactcgcatcctatcccttttttttcccatgcgtcaaccggtcaaacttggtgacgacaagttttgtgataatttggcaagttgattgtcaatacaagtatcaaatgtatggatttgatactgatatttgatagtgttgaatgctagagaacatgggattactatataatgtgaattattatatttaatcttaggagcaagtatacatagcagtatattgacagataagggaatggactagcgataagaaattactggaaacaaattaattgtattcttatattcctgtaactatcatatttatactcttaagcgcgagtaacgcgaactattttttttgattggagaagaaacaataaaagtgttcagcacaaatgatagttatttgtgcggtagtcgatatagccaaaacatgtatcatgaaggcaatggcaatgcgtccttcattctgtctgacctgggctaccaagtagacctcaagacataaggcccacaatgcattttggcctcgaatcagatccataaaaatctaaagacagaaattctttatctttgttgcccaggctccaccaacgcagtccgccgcctcgttttcttcttagttcccacggcgccactaacctttgcaaaaccgtcgacacagctcctcctcatctcggccgctccccttcccccatgggcggcgccgctctctccctctcctactggcagcaccgatgtgcctccccccactggcaacgcatctctccctccccatctccgccgcttcccctccccatctccgtagctcgaccgagttggcagcgactcgacgacggccactccataatcctcctcgcaagatccggcctgagagttgccggatctggccttggaaggcggcagtggtggcacaacgacagcaatcccatgcccccttcacggtaggcgtggcctcgatggcagctgctgccgttcaacgacggcggggcggccttgacgaaggtggttgcagctcgatacgatggcggtaaggggaccgtggcttcatgtttgggacacagcctcaccaacgttatttcgcccttcttctcgcgcgtcacggggatacgtcctgacaggttctaacgaggttcaggtggccaaatgaagctccctgatcttcacaagggctcgctgaacgccgacgtggcttggaatctccgaactggcgacgtgagggcgaacgccacctcaccgcactgtgaatggcatgacgtaatcgcgatcgaggtagccgcgtatggaggagtcgtaattaatgtagccaaaatgaaagtatggatatcgagatagcagaattgcatggcacacaagtgataccggccgtggagtgatcatggacgaatgacatggaccagggtgtgcagcagcgacgaggttggagatgtcaggcgagcgtgtgcatgcggctcaatcctctccggagtccgggagaaatcagtgaagataggtacgatatatatgaggcagtgggatagatgttggatccaatccaatgatttaaattttgcactgtaggactttgagtaagaaaatcttgtaaatgtgtagcacaagtagaccttagaatttacttaaagcacaagatactacgtcctccgtttcacaattaattaatataacactttctagcattactcatatatacatatcatatatacatatagatgttaataaatttagacatataaatgtgtctagattcacattaacttctatacagtggctaagccagaaattatataagattagggctaagaaatgacccgactaatggagtattagttttctgaaaaatttacatggtgaatcaacaaaatttaagcaagtttttggtggcaggtctagggctcaagccctagctgccctaggcctacctccacccctgcttctatatgaatatgagcaacaatataatatgaaacggagggagtagtatatttctcatcaaataaaagttactacttcctccgtctcaaaatataacaatttttaagtgggcgggatatatttagtattacgaatttggacaaacgtctatttagattcgtcgtattaggatatgtctcatccagttaaaaattgctatatattttaggacgtatatccagttagattcgaagtatattttaggacggagatagtaggttatattcttttgaggataattgttatacatgttttcgaattcgtgattaattaataatgtaacaacctaaatgtgcgctaattacatcatcatcaatctagtaacctagtaacacactgtattatctacgattgtactgacaaggcaggatctgcttcgaccttgtcgccgctaatatctccgagctccgccggagatggcggcggctgctgggcggtctcgccggcgtccctctcctgccgcttcttcgccgaaaactccgagacgtatccgatcacgtccgtcaggtcggcgtgcgacgacccgccttcctccatcgccgccctcgccttcgcggcgagctccttggcgcgcgccctcctcgccgtcccctcgtctccgccgtccatcagctcggtcaccgccttgaccacgccgtcgctggtgagctgcacgccctcggcctcggcggggaggaacatggggggcaccgtgacgcccgacctgacgccgacgcggagcacgtcgacgagcagctgctcgctgctgaactggtcggagaagttgggccacgtcagcgccggcacgccgtgggagatggcctccagcgtcgcgttccagccgcagtgggtcaggaacccgcccgccgccgggtgggacaggatggtcacctgcggcgcccacccgcgcaccaggaggcccctgtcgctgacgcgctcctcgtacccctcgccgtcgagccactcgctcacggcggcggccgtcgcctccttgatcgcccacacgaacggccaccccgactcctccaggccgcgggcgagctcgatcgcctgcgtcgcccggaggtgcgtgaggctgccgaagctgacgtacagcacggacgccggcggccgggcgtcgagccacgagacgatccgggcggcgtcgacgacggcgcggttgccacggctggcgctggagtcggcgtcgtccagcctggcggcgcacgtcggcccgatggcccacgccctcaggccgagcgccgacgcgtacgcgtccacgaagacgccctcgacgtcgcggaacgtgttgaggagcaggccgtcagcggtggcctcgccgtcgaccacgtcgcgcgccagcttctccgcgccgggccactggaagaagccgcggcacgtggccgtgttgacgacggcgcgcacggggaagcccggcacctcgaacggctcgagctggtcggcgacgcggtcgtacacgccgtgcttggcgaggcagtggatggcgaggaggaagtagacggaggggcagtgcagcacgaggcgcgggatggcgaggcgttcgcacacggccgccgtccacgggttgcaggcgtcggcgacgacgcagtccgggcggcgaggcagcgcgcgcacgtacgcctcgagcgccgcctccatgttccacacggccttgaagaaagccaggtacatggcgatgtccaccaactggtccatgttctccacgccctccggcaggccgaactccgggccggtgaaggtgatctcggcgagctcgacggcgagccctccccgccgcgctccctcgacggccgccctgttgcgcgcggcgttgaccggcgtggtgaccaccgtgacgcgcgcgccgcggccggcgaggaggcgcgccaggtccaccatagggatgatgtggccctgcgccaccagcggcaccagcaagaagtggagctccttcgccgccgacgccgccgccatcgcctccaactctgtttctcctcgcgcgcgcgcagcaagagcaagaaggtgaggaggcgtagggactagctttgcagtctagaggagtgtgtgttatacacgtcgacacgtcgtcgatgacgtcgacggcccgggttgttgcggggcgcggcggcggaagatgagatcgcggcgacgtggaagccggaaatacacatttattgtcacactctaaaaatcttaaatatataaattgttgtttaattggaatttttagaaattattttaaaagcctacaagctaaaccctaattttctaggaaaattttcaacataaaagtgagctagataaaattttattaaatactatgcttgctcctctattttctagatttttctgggaattatttgagcaagggaagtatttttaataattgaaacaacatttcacaaattgttttattcaaaaaagtttaaaaaaccccttctttagccgttggaccgttttcggcccaactctctctttctctctctccccgcgcgcggcccacgccggcccaagccgccgccgcccgtgcccctctctctcgggacactgacatgtggggcccacatgtcaggcccttctccttcctccggccgccgccgagaccgagcccgagcc

SEQ ID NO: 9878 - DNA, 3376 bp, Oryza sativa
aagcggacttgcaccaaaaggggaggcaagccgggccgcgggaggggaaggagagaggattttgggccgagcccgaaagggaggaaggggaagtttattttgttttctttttatttaaattagtttaatgaacttggtgactttaaaattatttcttgaactccgaaaattcacggaaaaatccggagagtattttagggcacaaagaatattgcgaaatattcccggccaatgatttttaagggaaaattttaattctcccattatttcacttgattaaattgatttaacttttatttaatttctagaaaatacattatttaatgatttttaaacccgaacgaaaatcggggcgttacaaatctaccccccttacaggaatctcgtcccgagattctgggatggctagaaagaaagctggtgctggcaggcggtctgactgatctgcttacacatgctgcctctttctgattcaactgaccgattgctcgatgaaccaaacctgcataagcttgctattctgttgcttcccataaactgacggaccgactctgattagtctgaccttgaccagaactgctggtgctcatagaacttctatttttttttttggactgaattgctaatgctggcaattagataaactgaggattcactttgctgaccggggatcggtgtagtttttccgaaaccttgaaactgacttccgtaacccacagacaatgactttgctcgacttgctcttgattcaaaccacaagtattttcaggaaactggcttggtctgtcctagtctggattgcggctgttcctgatgctacttctttaagccaaacggttgacctggcctcaccggcgtaccttcgaatttaattagacaacttgggatcagtgttactctgctgacgccttgcagctggctctttcaagtactaaccaacttgctgcactgggttgaatctttaagggaaacggcaacaaggtgaaccaaaactcatctctgcgacctaccccctcttacagagagtagtcatactttcgcgtgaccgggaataattgaactattgtccttgaagaaaaatcgacacttctcgaatttacgaatggccctgactttgaaaatagaaaacttcaacgatcaatcaaaataaagcaatgacgatgcactttcatccaggacaagacttggaacttaacccttagttgctgataggaaattccacataaggaaattctcatttagcatatgatctttctaactcttgactacttccccatcagttctacggctggcataactagcatgcttctggactcgactccatatacttctgacccatgtattggaacaatttctctttcaacttctgggaaacctcatgagaattttttttttctggaacttatagcggttgccttgaactatggaaaccattcttgtttcataatcacaccactagggtgtaattgccgcttaccatcctgtaacagcttccaaggttagagagttcccaagagtctctatatgatgtcaccttcaaatattccatccctcttttcatttgagtaccactgatgttgcctttagagagatctcatcatgtcgagtgttgagggtctaaccattttcactccgttggttaatcctttctttactggctcgcaaacaggttttggagcacaacaaaagtgcgatgagttagaagggaaactcttggtttcttgtaacttgcagatacacaagttaacttgcttttgcatactcaaaggtgaaaaggaaagaaccgcttgactcctactctattcaatattccttttccaactatatcactagattggaacttctatgcgcgaggacggtatttgaacaccaaaggcctgtgcacaattgttgactcttgcttaccgaactgctaatcagtagcacatttacccattgtgattctgacatggttgacttgtccttttgttggttacgagctgaagctcccataagaacaaaactttgactgatgacgttcctaagacaaccatcaatcctcttggtagctgaaaggaacgagaccttctcactgttggtgcaactcttctattaatttcttgccagaccactgagctggagcagcatgaggtgcatggctgatgttgataaccacattgaagtctgatgcttgagacattgactgcagtcgctgttgaagaattgagctgtctctctgtagttaaagtagctcactgattccctgacattgattgccctactaatgctgattctgtagccttgaagcagttgctagcgaaacaatagaatctttatcggtgcccttgaaacccataccttctgtaggtatcacttgttgctcctaggattagggcggcttggctgtgctggtctgctaagggcttggtggtctactgtttagggttgcgggtgcttgctcttggaaaacaaactggctttagctctgatcctgattccggcttgcatctgagcttgtacctgttgttggagacactgtcgttgcatttgctgcatcggactctgtggttgctgcatcaacatctgacacatccatcatctgaccttggctaaccataatctgaccagagcgaggtgctctgactcagctggtagcttgttgtctcggactgatccactgattctgacctcaacacactgcggctggagttactttcgctacatttgaccttgcatcaagctttgcatctcctgcatcaatacacccatcatctggtcttggacaccaaaagttaatcatgagcgggggttcttctggcattgggataccttgcagctttcaactgaaccatcgatctgtgactttaatacaccgtcgttgctcttctctctaacactgaccatcttctgcagggcggaagagaggtggaagagaggggttgctaaagataagaccttaaaccacttgactaatggtctgttgtgagtagatttttattgattcaagttgcttaagcaaacaacctagtatggtcgcatccccaccaatgacgcaaaccatacccctacacacaagcaaacaacacacgatctagaagctaacgaaactactcttctgggacagattgggtttaggtcatctctggggaaacttcacttgacctttgcggaacgacggctctggactgatcttcttggtccttgctgcatgaagctcgaggctcgacttgacttccgaacaggcatgacgctggcggtttgtcctccaggtttgacaactaaaagaattggagggacagggaagagaactttaaaagctgtttcgcaaagaaatgccgaagggcgagaggagacattttgcaatagggttttcagaaagcttgtccttaggttttga

SEQ ID NO: 9879 - DNA, 14271 bp, Oryza sativa
  unsure (1)..(14271): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattccactgctcttaagatcctcgaccggtttcgttgctgcaaccgtggaccttgtggaagccgtcggagcagactttgtgggtagtagacgcctggtcttggggttagagtaagcaatcttcgtgtcctccgactgctgcataattccagctgttcgagcggcagcagatgctgctctgcgaagcgttgttggtttttcatggggcatctgctgctgttgctgttggggcagtgattgcttctgttgctgttggggcagtgattgcttcggttgttggggttgtgcttgctgctgtttttgtggatacgattgctgctataacaatatcaaaagaagaattcaacacgaaaaactttagtgaaaacacaaaaaaaaaataacaagtgttaatgacaaacaaaacctacgtgagaaataacagaggatgctgttagagaatgtgttaaggctactaatgccactatgacatatattaccattagcttcgaaggtttttcacatgtcagataggataatcataaattttctacaatttgtcttcaactgaaacaagcctttttacaatatcataacaatttctgggcaagcgatctagcagtacttgtcagataattactaggcaagtaaagatagcagcaatggggcagaatgtcacaggagtacaggaaaactggggaaattttctgatgtttcgatttgacaagataactacgaagcgagaagtactgccagaaaacaatcagcaatttctatacactatcaaactaacagttaattcccagtttcctcattcatttctcattgttaaatattttaactaaatgatctcatgcctttcgtgtttgctcaagtcagtcctaagtgtctcaaacttacataaggaagtgtaataaataggaaaagatatattactgctgatgagtgatcaacactaatcccacctaaatcttgtgttgagcagattattttctgaaggaagaaagaaaccaccctacagattaggaagttggaaacaaaatacaatatgttttactcaaaaacagtacatgctccttggtgggaaccaatctggtacaatttgtaaaattttcctatcattatgcaatttgtgtaaagtatttaatgaattggaagttggagcattttcaaccaacaaattaaactaaaaattaagtggcatgtccaacagagtacagatatgccaacttgaactgatattttaattattgttgatcttgaaggttattagtgtggtaacaactacatattagtttcaacatcacaaacgaccttcagaggagctaacagctacattagtagtctgctgatcttacattattaatataactaggaaggtaatccacgcgattgcgcgggcatatctttgtttctggtgtttgaatctcctgaagatgaagattaagtgtttcacgcaaaacaaggtggtaataacgtgtgattaattgagttttaattattacaaacttgaaaaatggattaatctgatattttagaacaactttcatatagaaagttttcgtacgaaatgcaccgtttagcagtttgaaaagcgtgccattttaatccaaaagtttatcctcaaatttcataggaaacgaacagggcaatgttaaaatcttttatgatgactgaaaatttctttatatctatatgtaaagttcccgtaaaatgttcaatacaaatagttagttggtcttggtacagttagttggtcttggtacttcaaaatttgattgtaggtaaagaattggatccttggttacacatataaacttagagtaataaaactttaactgagatcttcagataatacggaactgattattctttgaatttctctatttcctttaatgactcaagaggattttatcatgatttatagtagtgccaaattaatcattgacaaattttattgcagctatgataaatttaactaaatgtgttggcacttatcaatatgaagtttagaagttcctgtggtggatatccataggttggttaatcttcagcatgtgactccctagcccgttagcagcctatagaagaggtgaagttgaggtccatatatgctagaagatgttgtaattggtggtttaatacctccttagaattttaggtggatgaaggtctgatttaaatataatacctatgggttaactattttacacgaaaatgagaataaaagtataagtctatgcatatgtatgcccaatccatgaaggacttatgctgatgcaaattttggagctagtgtattacatggtcttattcttgttttcatactcaaatgatatttcgtaatattatttactatactatttagaatactgacattgtaataaatatacagtgcatcattaaggttttcgttagtatcgatctccaaacataacatgaagaagctttttaagtatattttcatcaaatactaccgtagcaaaatctcattaagtgctacatctagtaaactattttgaatatgattgtctacttgcactactcataaatagtataacaatacttcggaataagtagcacccaccttgcaaattggacggtattcacccaacggtttgaaccgttcactctatctatctcctttcaatgcttaaaatttaatattaaaattgaagatagaaatacctacttgagttattccttagtattattttttccagattaaggggcattaattgaatgttttgatatgtagcatctttattgcaaagatttactatgtttttgaattgtacatattcaagctgatgtgacataaataataatgtatagataagggagttcaaggaaggtttagtcatcacaaattaattgttatggtcttcgatcgcttgttgctttgtctttatttttattttttttggaccaggcttgctgctttgtcttggtggctgttgtgacccccactatgttcttttagtgatgcaatggatggctgccaaccttgtggaactgaaggctggtcattctttctacaaccctatgcaccttgtaacgggtcactataacctcatacggcaccttaaacgtcttgctattagataccacacgtggatgtttttttctattacataatgtttgtacaaatatacagagcaatttaaatattgtctcgctttaatttgattagttttgacttttgttaatttaatgcctttatcccaaacatagttgaaggaactgctaaatattgtctttcgtgacattatcttgctttaatttgattagttttgacttttgttaatttaatgcctttatcgcaaacatagttgaaggtgctgttaaatatcgtctttcgtgacattatcttgctaagagtttaggattgaagcaagttattatggaacatctttggttcattctattttcgagtattacaatcatctcaaacatacaaccacaataacaatgtaaacttctatttctcatggaacttaacacaaagttggagtagttgcacagaaagtttggagtactacggcatgacacttatctacgaaactatgatagcaggacacctgcaactcaggtattagcaggcaaaagagattgtgcataaatatgaattgtgaaccaaacgtaggagtgttcaaaaggcattgattgatgaatgctgttccattatcattcaacaaactagaagataaaacattctgcttgcaaacctgtgttgagcgcgaccttgatgaatgagctggtgactgtgcagaagcatacttcaaaatgttaaagaatgtagtctggccaataattgcaaccttctgccagtaaaccacaagcatgtccccagctcttactctcaaatcaagaatactgcagtcgatatcattctcatactgtgaaatgtatggcctaaagaaagtctcatagacataggaggttccctatcataagcacacgcattattcttgaaggcaatcatatattcagtacaagaaaaacatcattattaaagtaaagtacctttgtccttgggcaccataagtatataaagaacatcagctttgcttctgagtacagtggtagccttcaataaaaccagaatcaattaagcattcaaaacagtttgtaatcaacgactgaggaacaaagatctcagaaaaaactaaccatgatattgcaaaatcaccaaatcgttccaaaaccgtcagtagcgcgactaatatcctggacacaaacaacaattcaagtggcacttgcagtgtatggatgtgggcaaaccatgaatccacaagaataaaaatagctccttaccaatattgacaccagaaaataagcttctcaatctcgggcttgttcagctctacggttttatagcattcataagcaggataagcataaccaaaggccaacctgcatcataatcatcccatcagaaccagagtacatcgttttttctacattatgcagttccaaccaaagaaaccaatgtcctcataatccgaatgttatgaagatgcaacgatatagattccactttttcttttggtgcataaaaaaagataggcacagattttagggccgtgtttgaacaactgaactgaatcaagacaggagcaatcgcaagcgcaaatcgcaggaaacttaaaaccatgggcaaacaacagattcctttcagtaacatcgtaagagtatcttttaatactatcacagattcactacacagttttagtgtaccattaatcttcagcggaataaccattgaccttaaacactcaaaacaacaatgactatcctcctccaaagaacggacgaccacagatgtacagattttcacagtgtttgagtggtgtcgatgctattccaaaggaagaagatgccagacaaatcgacgcacacgcattccaaaaaaggcgaaaaatataaacacaaaagatgaaaaaaaaaagaaatcggttcttgaatccatccccacggtcaaacccacaaaaatcgtgaagaaacaccgggagatttcgtcagattggggggacttacagtaggaccctgnnnnnnnnnnnnnnnnnnnnnnnnnnccgatctttctgcacaagaacagatccagtgagatgctgctactccgaaacaaccaagaactgtgtagggcggagcaaggagatgtacagatggaagcgtggatggaagaaggttggtgacggggctgatagatccggaagggatgcaagaaatggggaggaactggaggagtgaagatcccctcgctcaccctctctctccctccagtagtccactcccgtctgactgcgaggagtgaagacggcgacagagctcttcaaactccaccaaacccaacgggcaacacttcactagtgtctctctctctctctcacctctttttctactcggccgtacatgcctcctgttctcagatggataatcatgctgtactccccaactaaatggtgtgttcctttttaaaaaatcactaatctctcttactcaaaatgagggctgatttggtttaaagccaaaactgccatacaaaaatattggtattttaaacagtaattttggcaatgtttggtctactaccaatacttgtcaataccacacaaatgttaccaaaatattggcattggcaaaaatttactcatgatttggcattggcatagttacaaaccaaacaagccctaagttaacataaaatatactaagttgatttattttggaatgaagaaaatagatgaaaccttattcattgttgcatgataattatatatgggttgtaaaattttcttttgtattcctatatatttttctatgcgctttttatatatggtacttgatcgattatctaaatattataaatggtttggaggtatagcgtagccttttttttataagagagtcgatatgcatttttttgatgaattatttaaaggctaaaaccaattaaaatgatatagcatcatgatagaaaaataattaacattaactattaactatatttagtgcagatgaaatttatagatattagatagatagaatttgtacacaagttttcttaaaaggaattgagtaactttatttttttatagtttgtaataatttatacttaattactatcaagtgtccaaacgaactcacccttagtccaaacaagtgtatatttcttttttaaaaaaatctatatagagatatcttagaaaagtttttaaaatctatttttttaactttcttatatttgatttatcctattttgctctagaagagttatcataaaatgaaaaaagctattctctctttctgtaaatataagcacttttggaatagagctcaaacttttaaagtttggctgcaaatagaaaaaaaatcataaaaattgatgatgtgagaattatgtttatcttcataaaaatcttaattcctgtttaacttatgaggttttctgtctttttactcagtatttacttttggaccactaagactaagactagaactaaaagcttcgcactaaattactattattgattatatcagtttcgatttataagccgcacggccgcggctgaaatgtggagattatgggtaccccatatccacacggcatggttatccgactagtaataggggataacatatatgtatggaatatgtaacagatcgtgacttgggtattacgtttccttgtatattacggaacggcctaaagtcctggtttgataatattgtaaaatagatttaggaaaccgatgccgtattggttaaggtttctatcttgtaatcctgccccccaccctatataaggtgggcaggagaccctctagggggcatgagacaacctgatcgtcagatctatactacacccggtggattcaaatccccaaacaggagtagggtattacctctcattgagagggcctgaacctgtctaaatcctgtgtctccacatccatccacttttaggtctcgtgcgctaccccgttttattattgccgaattcatgtttcgacagttggcgcgccaggtaggggtgcgtcgagttcctcgtcgacgagtgcgatggaaccaatcttcaaatcaccgggttggtcgttccaatctactgctgttagattattttttgcgacaaattgattcgctttattgtctttttacatgcatgtaccggtgcctgatgcttttgccgatccaacgaacggcgctatcatctgctctgcgcctatgtgattctcgcgtcggcctcgtgatccatccactttaagatgcatcttgtgtccatgcatgcctgggatcgatcagcagaaaagcgggcatacgtgcattgctatatgcatctaatcttcctgctacatgctaattagattgattttggattatagattattaatcttaattttgctggttatttttgcctgcatgtctgcaccggttgacgaggactgacgaggacctatgtgtttccgcctgcacggctggcctttatgccgccgttgttgggcgtctatgacttcaccgccggcctgcctccgtcgccgccgactggtgcctccgcctacacggctggcctattatgccgccgctgttgggcgtctacgacttcaccgccggcctgcctccgtcgccgccgactggagtccccgcctatacggttggttggtcacaccaccgttcatgggcgtccacgtcttcaccgccggcctgcctccgtcgccgccgattggtgcctccgcctacacggctggcctattatgccgccgctgttgggcgtctatgacttcaccgccggcctgcctccgttgccgccgactggtgcctccgcctacacggctggcctattatgccgccgctgttgggcgtctatgacttcaccgccggcctgcctccgtcgccgccgactggtgcctccgcctacacggctggcctattatgccgccgctgttgggcgtctatgacttcaccgccggcctgcctccgtcgccgccgactggtgcctccgcctacacggctggcctattatgccgccgctgttgggcgtctatgacttcaccgccggcctgcctccgtcgccgccgactggtgcctccgcctacacggctagcctattatgccgctgctgttgggcgtctacgacttcaccgccggcttgcctccgttgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggttccactggcgccgactggtgtttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataatcgcaaaagtacccgagtagtaaattttgatccgtgaaactttgttctattaatggtgaactcatgtcactcatatgcatgtttgggaagtgcttaggccgactcccagtgcttggtggctatgactagtcgggcagagtgtttaaacgtaatgagtcatctgctcggggaaatcaaaattaacaagaggagaaatatatatttataaatattttaaaatacttgatttttttctcgagtattatatttatatcagatactactcatcctatatgtttgttctgcaggatccagatccagatatgcacaaaagggattcatggctttaagcttatctcttacgctctaggaatggatcagtcagaacatcaccgaccggccgcctcgtccgccgccgactggtgtttccgcctgcacggctggcctattatgccgccgttgttgggcgtctacgtcttcaccgaccggccgcctcgtccgccgccgactggtgtttccacctgcacggctggcctttatgccgccgttgttgggcgtctacgtcttcaccgaccggcttgccttcgccgctgccgactggtgtttccgcctgcacggctggcctttatgccgccgttgtcgggcgcctacgtcttcaccgaccggcttgccttcgccgccgccgactggtgtttccgcctgcacggctggcctttatgccgccgttgttgggcgtctacgtcttcaccgaccggcttgccttcgccgctgccaactggtgtttccgcctgcacggctggcctttatgccgccgttgttgggcgtctacgtcttcaccgaccggccgcctcgttcgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgttcgccgccgactggtgtttccgcctgcacggctggcctttatgccgccgttgttgggcgtctacgtcttcggccccggcaaacccgaccggccggccgactggtgtttccgcctgcacggctagcctttatgccgccgttgttgggcgtctacgtcttcaccgaccggcttgccttcgccgctgccgactggtgtttccgcctgcacggctggcctattatgacgccaactgatgctatcttcttcacggctggctacatcaccgtcaccgctaataggcatcatcatcttcaacgcaagctgtctacgtctactgctgactagtgccctcacctctacgtctggtttatacagctaccactactgatggacatcatcgtctaccgtcgccgactggttatgccgccgtctactgcaatgcaactttgtcatcatggtggagcgacttcatctttattatcttcggcaccggcaaacccgtttgctgctacttcgcaagtttttctacttcatcaaccatgacgtctcggcatctcggcatgcgatgccgtgttattttactacaacaagtggctctccaatattcagtatttctacttggacatcttcaacgcatatcttcaatcaagcaatgactattcaacgacaagaagctacagtgctcgactctatgttcagttgtttcccaactaaccaaagagtcgggggctacacaaatataagactcttaaaatttgacaaattttatgtcaagctgaagaaattaattcatcaactcacaagtcaactccaggagtcattatcctcgtctttgctttagagcagagttatcaaccaatcagctcagtttcgacgagttggacaacatcatctactttcctccaagtgaagcatctgcaacagctataacaacaatttgatggattattgtcactaacatcatcaccagcacctctgcttcatcggccctaacatcagctctgttgctaatggatgactacgtcttcgccgacttattatttcactttcatggttgctattgactggatcaccgacatcgttatcttcatcaacatcctgtcaagcctcttcaacatagcccactctattgctattgatgggcaacttcgtcattatatttgatcatctatgattgctgcttatcatcattacagtcggttgcgtttgtcgtcgccgactattttcttcatcttcatgattggtggatttcgtcattgtctttgatgcatgtctacatcttcaccgtcggcttgctttcgtcaccaccgactggtatcctcgccttcatggatggcttattatgtcgccactaatgggcatcttcatcttcttcacctgctgcatcgcctgtcaccgactgattatttcgctgccatagctacacaactttatcactgagcgccttcatattcattgctggctgatctgattgctgccgactggtttcttcgcctccatggctgtgcaacttcatcacttctgattggtatcactatcttcactatcaccaatatttttgccacctctgctgggcaatattatctctgtattggtcgtcttgtctctatgccaactgcgtcagctaccatcaatgaacaattgtgactacgtgctcaggggcttactagctcaaatacaagtattatatcttcaatttggacttgctctggatacatgcaacatgaattcatgatcatgggtctattttatatgctcaaagactggactatttattattccccgtaagggttatcaactgaatacttgcgccagttgggattcaattgttacatctattttggagtatcccataagggataatcactcagatcagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcgactttttaggagtcggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaaccatgtgtcttttagggacttaagcacatctgttaaagcagtgtgcgcatggcgtatgcccaatactttggaaatttctttattcacagcattcaagcttctttatagttgtcttgctatgtgaactttcaaagatgttgtcaactttaggttgtatgcatcatattttgccaagcagtcggtatatcacttggatcatattattcggggattcacaccgcatatgctatatattgatatcaagtcacttggttgattacaattatcaaaaccactcggttggttagattatttattccttgactatatgtttggttggttcaattaaccacatagtcgggggctgcacctattaggtgcatctattcgatgtacctgactttatttttcagccctccacagtcttcagatttggtaaaagtactcgggagaccatggcgaagatgattgaagcactcggctttggagtaatctagttcgagagaagattatattttcgactgtgaaggtctcaggggctactgtggagattatgggtaccccatatccacacggcatggttatccgactagtaataggggataacatatatgtatggaatatgtaacagatcgtgacttgggtattacgtttccttgtatattacggaacggcctaaagtcctggtttgataatattgtaaaatagatttaggaaaccgatgccgtattggttaaggtttctatcttgtaatcctgccccccaccctatataaggtgggcaggaggccctctagggggcatgagacaacctgatcgtcagatctatactacacccggtggattcaaatccccaaacaggagtagggtattacctctcattgagagggcctgaacctgtctaaatcctgtgtctccacatccatccacttttaggtctcgtgcgctaccccgttttattattgccgaattcatgtttcgacatgaaaaatgccttccaatcacgtcccatccaaacttttgcatttcatactgttcctgttttgcgttttgccaaatcctttgcataaatgtaataaatgcctattactttagttgaccgtcgatcatcgatatttaaccgttaattctctgcaatgactttctttaaatttatagcacaaagaaaagagcttcctcactaaagaataattcacaattatgcaaaaatattagggtgggccaaaatatacgaattcactaaatttttaatttcccttgaatttgaaaagaaaatgaatcgagtaaattccataaaactagaaacatactaagaaaactatcagaaagccatatttttttaaaacgttataattagtagtgaaaaaactactactccctccgtaataatatgcagctctctttatttaaaacatcatacttttatagatattgttggttaaagtagcattttaaaaaccgtgtcaaggtctaaaaatgtttatattttatgacggaggaagtacataattagttgtgaagttatcacatagaagagaaaatttgattggtagcgcagatcttatcttagtgaaaaaaaaatagcacaacaatcatgctcctccggctaaaggcatgttacaaacaaggatctgaacaccaaaagatattaaaaaaaataaaaagaagtcctcaagtcaactccttcctccttcccaaggacccaatcccgtcaccatggcgaaaagaagcagtggagagacatacatagtgaagagaatccattacatgccactgactttgtcacacgtctatgatttaccactgattttatcacattctaagatataccatcgacttttgcttaac

SEQ ID NO: 9880 - DNA, 2107 bp, Oryza sativa
acatgttgtttccctccgacatactagctcactggatacgatttttgagtactttatactaagcattccatcttaccattaaagagggaaagcataaagtgtttaccttatcaacttaccctgaacttaccatataaaggacagggaaatgaaacccctaatctttggatccctagatcttctttttggcggcgcacatgtgctccccctgtggatgatcacttttggctcgtgccattgccaggggtttaggctagctactttgggctagagattcctaggtcacaagtcacaacccacaccgtccacatggcaaaaactataatcatcacggcacaattctgcatagactagaggatgatcattcctggtacgttgcagtgttgctgaaagattttgtgtcgtgtgcaatggatctgtgctctaccacactcttggagaaatgcaggattacctaactggcagaggaggagttaccatgtaccgataggaagaccgataactgcggtaatcgcgcggttaccacagtgaagtgataaaacgaagcggaattgataaaaaaattgaattgttatttaaatttctttaattaaattggtagcgttgtggggcacttgtttttaccagtaacggacggtaaggcagaccctatagataaatgatgttggacaactaatataaaaaaaagtctctattgatattttcatagattagagtcattactttcagtcatgtaaaattccatttaaattttgttgcatggcttggtcagacataggcacttttttattagattttcagcggcatgtgaaacgagttaagccattagcacatgattaaatcgatttctaccttagaatgtatttatttatttattgattagaatggatttatttattgattgattaaacttattgtcagtatcatgagtatgggatgcctaatatattaagcttagcgggacgcaccatataccaagctttatacaaaatttaacctcatatacaaaatggtttcggataagaaaagataaatagagttctagttggacaccacaatgtctactcgaattgtattcatacttgactctctaattctccttaaacaagaggacactcgagggtaaaaatacaagactctctaagaggagatgggccacaacaacataggttaaggcaaactaacacaaatcagcacaagccaagccaagcttatagcgccacagaagccatggcaataaaagacatctccaatctctccaagttcatatttgagtaagtcgaccatcactaaccatcgacgggccaccgctaagccaacaacggagctacaacgggatcacccaaaaccctatcctaacaaccaacacttactacactctatccacatctttgagatttagggagagagagtgagggagaaggatggaaccgctctcctgtaggctccccgacatggccaacttttataagttagggcgccgacacaagatgaccgaaatctagagcgagcttgcaccgcttgtcagggaggtttcaataagggggttgctagacgacatctccagagagaggagcgacgaaagcactgtcgtcgccgtttgtcgaggtctcaaggagatcgagactgggttttcacccggcaaccccactagaggagatgagatcacatccctcaaaagggaaatgacgtttggaaacatcatcgttgccggcccagtcgagactggtctaggttttcacccgctgtttgtatatctgcagctgatgtactattgctccaccacggttagccctcgttggcgcatgggcaaggctgcaccggtgccccccgccggctagcctccgcatgccttcatgcggccaccctcatgtcgaccactggatctagccaaggggtgacctcctgcacgactgggttgaccccaagcctctgcagcagccgcttcaccacgtggataagcagcacccgcgcctctcgagcactagcaccgggctctccacatagccctcagcaccttcgccgcttcctgctgttgctgttgtcgttgcgctgccaccgctgcgaccccaccacctacatccttctctttggcggcgccgcgtgt

SEQ ID NO: 9881 - DNA, 1384 bp, Oryza sativa
ccggtccggctagtcgaggctagctggcaggtcgaggaggagttgacgcacaaagccgccgtccatccccaggccccgaagctcgtcgcgggcatcagagagaagaaccctaaccctaactagggttagggttatggcgatgcagcgaagaattgctcaaggtagcgaggacatgtcccaaggtagttcctttcgtgctcccgggcgccaactctctcgttttcttcttggtcccagtggacttcctcttgtgaagtgcccaagatgtgggaatgcagtagtggagtgcaaatcctggaggcaaggtggtcgagtgtttttcaaatgcgagaagaatgaacaatatgtaagtgaactctcttagtttgatttcagatgagatggttggaatttcagaatgcatagttaattttatttggtattgttgttttcataggttccagatgcttgcacgtttttcaagtggtatgatagttaccaaagaatggtggaaggaatggaattagatttcaatgaagaagttgcaaccccagttgcaatagcagcagcaggtgaggctgacaaggttgatgaagggaagatggataaactaactaagtggatgcaacttcttgtgttgatcaacatagggcaaggcatattagttctgatgggagtgtttgttttgcttatgaaatgatggatgtaataggaacgcagtgaagcaaacttgatgtgtttgttttgattttggtaataggaacgcagtgaagcaaactggaccggtttaatatatgtcaagtctttatggctatttgagaatgtggaaaaaatatgtggggttgcattgttatataatttgtgcagtgttttggctgtgtgttcaaaatatgggttactgcctatatagttaattcagtgtgtggcaaatgtgaatcaaacagcacaatgtcaggcaggcagtattttggcagcacaagcagcacaatcaggcagtatatagccagtggtacattcatgcagtaaatgatgcattgtaacaattccaggcattaaaacaattccaggctgtgtaaatgggcacaatgacataatatctccaacaacatagtcactgcaaatgcataggctgtcacatattgtcagataagtcttaaccaaaagccaagctaagctattacagattgtcattgcaaatgcataggctgctgttacatattagcagtggagacataagcagataagctgctaccaaaaggtaccaaacagtattagtactgaatacatagtgaagctgctaccaaaatacatccaaatgcccacatattacagaccaactaattcagttctttggtgtaagctttttccttggagatcttcttggtggttctggaaccattgtggg

SEQ ID NO: 9882 - DNA, 4791 bp, Oryza sativa
ctgtcacctaaaggctcaattaccctcttatatgcattcctaaacatctgcacagtgtagtacctatcaacaaaatcttcaatgtgcacatctctgctttgctgtgaagtaatcaaggccagtgcatgctggcagggcttccctgtatgctgccactcctcacaagagcaatattgcaggcatgctttcacaatgtacttcccatgtatgctgctgttatcaacaacttcagcagtgaaactatcagctttaacaactgagaggtgacctaatccccttgtcattgctaccagttgcttgttgacagcaggtaaaattttccctgtcatcctctctgctatcctccttctcttattccatagcaccatcactttttctctatacttgtcagctaactcacagacaggcaggtccttataatccttaatccagttattgaagctctctgcaaggttgttggtgacataatcacacttgatttcagggttgaatgcacttctcatccacattaaaggatggtaggtctcaagccactctagcacaccaggacatgatattacatgtttcatgtgttcttgccacactgttttcctataggttctagcagttgggtacatatgggagtggccatcactaccaaatcttttaacaaaatttttcattaggtgccaaaaacactccctctgctcagctttttcaaatacattatgcacagctttctctagccctttacatgcatcagtacaaattgctaagggatcaacatctcctatagctgtcttcaattgttccatgaaccatacccagttatcctcagtctcagcatctatgaaaccaaatgctaaggggtacatctaattgtgtccatctatacctgttgcagcagccatatgaccattccaacttccattgagagcagtggaatctatactaatatatggtctgcaaccctccaagaaaccatctatgcaaggcttaagggcacaaaaaaattctgtggaagtgcacatggccatcaacctccttggtgccaatctctacaacactaccaggacaagtccttaagacctgtgctctccacctatacaacatgtggaagctttcttcccatgacccatacaactctaacaaagccctctgtctacccttgcaaactgtgtcatacttaattgtacacttgtgatcttcttgcaaccttatcatcaagcttttagggcccatacctggattagtctttaagatcttcacagcctttgaagcaacccatttggtagttggtgtagtggtcctccttctgctgctagatgtacaggtatgaaaatctgttaacacagtcacctgccaattaattgaacaaatacattataaaccaaaccataaaagtaatataaataacaaaattcaaattaaccttaattgtcttcaagtcagcctgcctacttccaacaatatgccaaacacaaccatccactttacaacctcctatatatcttgttgggtcagtcttcaccacatccaattcaaattcgttgttaatagcaaactgtctcattgccaatctaaactcctccatgctggggtatgcagttccaagatccatgcaagggttgtcagggtcatatgccatcacattttcaccaggaattgaatcatccactggaagtgcagcatccatgtcatctgggcctcctactccagcaacattgacatcagggtctcctccttcaacattttgagctgcatttggggctgcttctccaccagcagcctgcctattcctatcagcttgctcatcctcagccctcaatcccaacaactcataaaacttgtcatcatccactatttctagcctcccttcttcctcattctgggccaaaacctctaggctatcccaatccacagcaggaggtgcatcaacagctggcccatgaggtggcgctggttcgacaactccatcagatgcgacatagaaaatggtttcaactcctgcatcagcatctaccgctcccgcatcaccaactacaacatctaaactacgttcaggctcctcctcgagcctggtaagatagaaaaaaatacgcaagttaaatgatgcgcaaactacaacgaactcgcccacactcgcaacatcaacaacattcaaatcgccaaaggtttgagaatggattcacttatccggcgacgagttcatgccaagtacactccatattcgccaccctcaccaccccgggatgcagtgcgacggcggcgcctacatgcggtgtgtcgacggtgagctccttccgcgacgagccgtcttcatgaccagatcgatttcttcgccgacgagcagacaggatggagcggcggaggaagagagagacggccaagaacccacctctggatctcaatcccctttctacccgaccgcaggggcaatttcgtcaggtcaactcgcatagaagggaaaatcatttcgaaaatgagcaaaaggaggaaaatggcaaagtggcgagtgcggcgcgcttcatcctggcattttagcgaatcccgttttcgggatggcattctggcgaagcccagttttgaacgtggcttaatgtccattttctcatttacccgccaaacagctcaaagaaacccaaccattcgcgcgctttctgaaacaccccgcgaggccgcgacctttcgtcttcccctttcaccgcgaagagcaatccgccgcgagcacgatccgctgcttccgcggccaccgtcgccaccaccgccggcgttcgtggcaatggcgaggcctactgaatcctctgcctccatcgctagcggcgggctcgccgcaccggctcccccaaccaatcctcgcaacgctatccccgctgcgaacccggcggcgaatcccatctccggcgcggctcactccgctccggcgaacgctcctcacccgcgaccgagtgtcagtcccgccgccgccgcctctccccaggtggtccgaggtcgacgaggagaggatcctcgagatcctctgcgaccacctccgccgccacgacgacctgccgcaaggcgtcgacctcctcatggccgtctacggcctcctcactcgtacggactacagcctcgcggagctcgaggggctcgtcaccgtgctccggcggcgtttcgaggagaacgacgcggtgctctgcagcgggagcggcggccctgctccggggcaccagctccggctctacaccctctccctcgaggtgtggggcgccgctccgacggccgtcgcgccgcccaaacccgccgccgcggccacacccaccacggcgcccgccaagaacgcgccggggacaagctatccggcccggcaggcgggccgcccccgccaagcggcggcgccgccggctaagaaggtgcggtacgaggagatgcgcgtgcagtacccgaggctggcggcgaaggtggacgagatggcgaggaaggcactcgagggcgtcagcgacatgacggcgtggtcgctggagctgaggctgcagaaccagcagctcgccggtggcacgccggaggcgcgcaccgatgaccgggcgaaggagctgacaggcttgatctcaaccctgatttgatttgagactcatcgaatctcttgcttgctactgttagaactccagtttcgtggcgtcaatggtgtcagacatgtgctgctgatgttcatgtgggatttgttcttgattagaacagtactgcctacatcattttgcaatgtcattttcttttgttgtgtttccttgttgtcccgtcctgaactcagtcttttcatcagatatctcttttttctctaatcctctgcctgccaaatattgtcattgttttcacaggcataatttacactacgattgtacgacacaaggttttaggtgtattgtatcatcagatatttttactaaatcagatatttgtcaggttttgttttgtttttttgtttttctgtatataactcttcttttttaatatatataactactgggcaaagccctggtagtaatttgcataaaaaaaattctcttggatttcattctttgttatcatttcactcatttccaagaatgctaacttccactagttccgacaatacctttgtatttcgctttggtagattggcactttgatgtaaccctgtattggtaactgtcgaccagaatggtcagaaaacacgttgagagtttggacatctttttaaatattttgtcacagatgaccccatgtattctggataaatcataacatttctcacggattatagcatttggttagtcttacattaactgatgtaataaataggccgtaaaactgaagttctttatttcttggtgtgaatggcaaagcgttttaattatcaggttaattcacaataatctttttcaggttaattctccacatctagatttgatacggcgtggttattagaaagcttctgtgggttggatgctaaacaaattgaccatttcttggattttgttagggcatgcccaagtcttctttttttttttctcagattcaagttatagcaattgctatggtttggatgataaaaacaactagtcaattgttggatttataaaaacatacccaatttattatttttttgatgggaacatacccaaattattgaaaataaattgtccaagacctagaaaatataggacttagttaaatttttagctgatcctaagcattgcaaaaattttgatcttacataggaccgaaagttcggatatgtcgaaataattttgtctgaaatctctagtacagaaaccgccaaaggtgccagttgga

SEQ ID NO: 9883 - DNA, 948 bp, Oryza sativa
caggcgggagcccgctgcctccccactagctcccctggcgccggatctagcggaggggagctcgccgcctcccctcctgccggatctggcggaggggagggtgtggccgccgccgccgccgccacctcagccagccagccgccggtcatgggaggggagcccaccgcctccccactgcctccccgccgccgccgcctctgccagccagccaccagccatgggaggggtgcccgccgccgccgccgccgccacctctgccagcctgcgcccggccatgggaggggagcgacgcgagagagagggagggagagcgatgcgagagagagagaggggagggagagtcggagagagaaacacgagaagggatgtgatcgatgtgtagataaggaccgtgtggtgtggacgactagataaggacgttcggtgggtgtggaccgtgtggtgctgctgagtcgctgatggctcggctcgtcggctcggcttaagctataggtgccggttaaaaaaccggcacctataatatatatgtgccggttttttcgctagaaccgacacctatagtgtttaaaggtgtcggttctatatttttccatcacagggaggtgggaaattgtctattggtgctggttttaaaccgacatctatgagccgatccctacgagggattttgctaagttaacaaaaagtaggaagatctggagaatagtttcctattggggtgtgggtgtgtgtgtgggtggggtggtgttccgcaattttggacccttctgagaaatagcaaaaatcttgaatgaaatggatgaacgtgatgacaaattgaatttaagtggcctcaaaacgaaaaactgaattgtacatgagaattatattaccattcaaaaactctttacacaagtacctggaaatggaatctcagacttggatacatgaagcttatgtcacttcttt

SEQ ID NO: 9884 - DNA, 695 bp, Oryza sativa
gttgttgggcgtctacgttttcactgaccggcttgccttcgcagctgcagactggtgtttccgcctgcacggctggcctttatgccgccgttgtcgggcgcctacgtcttcaccgaccggcttgcattcgccgccgccgactggtgtttccgcctgcacggctggcatttatgccgccgttgttgggcgtctacgtcttcaccgaccggcttgccttcgccgccgccgactggtgtttccgcctgcacggctggcctttatgccgccgttgttgggcgtctacgtcttcaccgactggcttgccttcgccgctgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacgg

SEQ ID NO: 9885 - DNA, 23681 bp, Oryza sativa
ctttgttattttgtgcacttgcatatttgttgtgtggcttgttgagtatgttatatgctcattcttacaatattcattcatcagaagaggagtatctcagtgaaggtgatgatctggaggattaggcttgttctcggttaagttgcctgtggagtggagtcgccatcgctgttccgtagattgttttagttttatttttccgctgcgtagaatgttatttttctttgagaggaactatctacctctgtaataatttattatttgcgaatattaaatagttattcatttgtactctattatcaatattgtcattgtgtgcctcggttgattcctggacgagggtttaacacacatgtaagcgtttggaattttggatagaaattccgggcgtgacatttatcccggtgcactgtgcacatgcccacgggcttctaggagatatgatccgggcgaccaagggtgaggtgtgcggctagccatggttcgttgtcgccttgccagagcgcctttagtcatggatgccccaactggctggtccctcgtgaacccaagactggacctctcttctttggccatttggccatatggtattctggtccttaggcttgctgctgtagatgcaccagcggaatcctggtgacatctcggcccaggacttaataaaattaatagaatattcatatcaataagttgtaacttttttttcggaaaccgatctctaaggaactctgaagttgcttggcctggagcaatttagggacgggtgaccgatcgggaaattcttctcgactgagcacaaagtgcgcagaaaagatctgtgagggcagtctatgacctatgtaagcgggcctggcctaggagaggcggagacgttacaatcctggagaaaatatgtatcatggaaactaggtatgtattgaaaacttggaaactactgctcaattgaaaaaattttactcacggatttacttataagtaaaaattttactcgcatattttctccattatcagcgtgaaagaaatatgaatccactgcggctgtatagctgtaggccatagcatagctgcaccgaagagcctcaatattattgtttttaataacgactaagcgtcaaattgtgcgttgcacgatattgttatattacattttaaacaatattaaaaaaaatctcttgcttaaattttagttccgacaaatgtttcaatttagtacttttttacaaggaatatttttcttaatttaaatttctttagttgtgaaattataaattactaaatatcgatatcgagttatacttgtatgtttttcactatacaataattttaaaatttggaactatccaatattgagttgggcttttgcagatgatatggagacaaaaataattgtggctttttatatgattaaaaaatacttcctatgtcctataatataagggattttggaggatagtgctagaaagtatcacatctctctaaaatcccttatattatgggacggagggagtagaacttatgaattaatcattaatttttaacgtagagtcttgttttgttattttcttaatgcaataatttcgtaacttggaatcaataaagggagtatctgaaaaacttgtcacaagtttcttgagtcaaaaacattcagatgtaactataatatcatgaaagtgtaattatactgtaactgcattataactacattgaaattacaatataatttatataacggtttggttagctagcactaaaatcttacgtgtgatatgtgtgaaaatttctttctagcaagtttttcctttcatgcagaaatttcgaggcaatccaatggtcacaaatctgaaagttttgggagcaaaaaaattgcaaaagtttttaagcaaatccaatcaataaaacatattaacccgtactccctccgccccaaaaaagaactcaattctagagtttgaattttgttccaaaaacataaacttctaccatcctaactaccttcagcacctaaaacgataagttttatctcttaaatactctttatctaaatatcatcattactactttttttcaataactagaaaggaaatccgcgcagttgcgcgggtaatttatttgttgtttataaaaagaatgctaaaaaaagttatatctcaccatatttactataaggatcgtagattaccttaattatactcataaaaaaagaaaaaaaacactttattctgcttacatatatggtcgcctatggccactacttattttcattgtcggtgtctttttaatagatagaattgcatttgtacctaaaaataaacataatagatcattaataaaatgagaagtccttcttcacttcgtaccaaaataaaatgctcatgtatgacttgtgtccaaatgcatgtataaatatttaaaaatatcatttttaccaattaatagataaaaccattaaaattagatataaatgctcgtctaatagatgaagcatagtataggcgctatggctttctactatgatggcttgaaacgatgtacccatcttccttaggaacagtatgaagcacaattttaacatttaagttcattgttagtacactcataaaggattgcatggtaagaaagccagtcgagcaatattgccaacagagccatctcaactcagcaatactatcatacttattgttcatacattgcaccctttacggaatgattaagagaaaatccaatagcttacgtcctgagaaccacatggaataatatttactcaagctataattcttcataaacatatgagttaatatgggtcttattattgttttcctttattgtagatcttactcatccatgcatgttcaacgtttaatatacgataaaataatctatgctgtcattttttttaattgttaagacaatttcgatgagaatgacatgaaaagagaaagaatatgttccatgtgatatttttttaataaaaatgtagttaacatatttttatttttatttaaaaaaaaatgaacaatcaaggttcgtaaataaatattgctgatcgccaaatctgtgaaaaattgctgatcttaatttgcttcttccaattgtccttttgattgatggattgacctgttggaataaataggctaggcccaatttaattcattaaaatctcaagaggccacaagtaatgttagagagaataatactgtcttgaaaatttagatagaagaacctcaacttaaatagggtgatattggagattccctgttgaccggttgaggtgatggttggactgccacacgcatgcgcgcgcgccgagtcggcctcggccgtgggcgtagcgaggcgaggcggccgaccgagccgagcctgccagctgctcttccgttttgtaacatacgagaataaagtcaccattaacgaatgaaattcattgtgttgtaacctccacaacaaaagagaggtttatttgttgtaaccttcacaacaaatgaaatttattttgtggtaaccttcacaacaaatgagatttatttgtgtggtaatggagatctctctctaaatataacacaagacagaggctctcaaagagtgtgtcttcctacgttccttggcgatactctccttgtgttcctacgttgtctctctgtttccccagttctgttcatctcgcgcgcacgggtgatcggaacgagcaggtgcctccgaaactccgtcggcttgagaacctgcacgggtagacgggcgatcaagtttttgggtagcacttcaagcgcgactgctttgcatcatcttcaccaacatgtcgacaaccggcgacaacaacaacactggagacaaggagaaggagcctctcgtcaacaccaacggaggcaatactgcctcaaactccagcagagggccattctcgggatataacgtttcactattaccgttcgttcttcgtttcctacaactgtcggtcgcagtattattgcgttctcttatctatgttgatgcttattctatattaagcatgctcatgttgtacacatctagcactgtcactagatctactcaaattacaaatgtcatgtttattgtcttaatattttagactaaaatatgccgaattacgaccaaatttccaacaatccaaaaacttgataggtctttttcggtagttggctttgttgcatcactaaaaccacatgctttcgatggttcaaattataaaaggtggaaagcacgtgcacttttgtggttgacggtgatgcaatgtttctttgtttcacggggcaaaccgagtgaaccgccgctctcccctgaggaagaggctaagttcgaggttgcggattgcttgttccgtggagcattgatcagtgtgctcgccgacagtattgtggacgtgtatatgcacatgccttcaaggaaggacatgtgggatgctcttcaggccaagttcagggtttccgatgccgggagcgagctgtatgttatggagcagttctatgactacaacatggtcgacgaccgttctgtagtggaacaggttcatgaaattcagatgctggcaaaggaacttgagaacagcaactgcgagttgctgggttgctggacaagtttgtggcgggtggcattattgccaaattgccaccttcttggtcggactttgctacttctctaaaacacaagaggcaagagttcagtgttactgatctcattggctctttgggtgttgaggagaaggcaagggcaaaggacaaccggggcaaaaaaaagaacgatggaggttctagtgccaatttggtgcagaagaagaaccctcacgcatctcacaacaacaagaagaaagtcaaacctgacgtcaaacctaaggctacaaccaattttaagaagaaaggccagggaaaggcaaaagtagatttctttgtgtgtggcaagcctgggcattgggccaaggattgtcttgatcgcaaagacaagaagtctgccaacatgatcattagcgagggcggaggaacatcggggtatggtaaatttttacctacagttctctgtctgtcactcacctgattggtgggttgatactggtgctaatattcatgtgtgtgccgatatttccctgttttcttcttatcatgtcaggagaggttcctccttgttgatgggaaacggatcgcttgcggctgttcatgatgttggtacagtcgatctgaagtttacttcgggaaaaatcgtgcagctgaagaacatgcagcatgtcctttcaataaagaagaatctagttagcggctctctactgtgtaaaggtggttttagacttgtgtttgaatccaataaatgtgtcgtatctaaatatggaacatttattggaaaaggttatgactgcggaggcttgttccgcttttccatggatgatatgtgtaataaagttgtgaaccatgtaagcgatgatgatgatgagtccaatgtgtggcattcgcgacattgtcacgtgaattttggttgtatgacacgcttagccaacatgagtttaattccaaaattcactttagtcaaaggctctaagtgtcatacttgtgttcaatcgaaacaacctcgcaaacctcacagggcatctgaggtgaggaatttggcaccactagaacttgttcattccgatctgtgcgaaatgaacggcgtgttgactaaagggggaaagaaatatttcatgagagtgatagataattgcactagattctgctatatgtacctattgaaaacaaaggatgaagcattacattactttaagatcgataaggctgaggtagaaaaccatctggaaaggaaaatcaaacggttgaggtctgataggggtggagagtatttttccaatgagtttaattctttttgcgaagagtatgaaattattcatgagaggacgcctccctattcaccccagtcaaacggggtagctgaaagaaagaaccgcactctaactgagatggtaaatgccatgttagacactgcaggattttccaaggaatggtggggtgaggcaatattgactgtgtgtcatgtcctgaatagaattcctactaagcataaggaagtaacaccattcaaggaatgggaaaggaagaaattaaatctctctcacctgcacacatggggttgtttggtcaaggtaaatgtacctatagccaaaaagtgtaaacttggacaaaagaccgtagattgtgtgttccttggttatgctatccacagtgtgggatataggttcttaatagtaaattctagagtacccaacatgcgtgttggtacaattactgagtccagagatgccacattttttgagaatgaatttcctatgaaaaatgcacttagcacttctagtcaagaacctattttatctcctgagcactttgtgccgatagaacacattgatcaaatgcttgaggaaaatcctgaggaggataacattgtagcaactcgaaagagtaagagacaaaggactgcaaagtcttttggagatgactacattgtatatcttgtggatgatactccaagaaccattgaagaggcatattcatctcttgacgctgactattggaaggaagcggtatgcagtgagatggactcaattatgtctaatggtacttgggaagtcgccgagcgtccatatgggtgcaagcctgtaggatgcaaatgggttttcaagaaaaagcttaggtctgatggtacaattgaaaagtataaggcaagacttgtggcaaagggttatacccaaaaagaaggcgatgactttttcgacacttattcaccagttgctcgcttgaccacgattcgagtactacttgctctggcagcctcttatggtctactcgtccatcagatggatgttaaagacagctttcctcaatggagagttggaggacgagatctatatggatcaaccagatgggtatgtactagaaggtcaggagggaatggtgtgcaagctgttgaagtccttgtatggtctcatacaagagcttaagcaatggcatgagaagtttgacaatacacttacatctgctggctttattgtgaacgaagctgacaaatgtgtgtactatcgctacggtgggggagagggagtgatcttatgtttatatgttgatgacatattgatctttgggaccagtctcaatgtgattggggaggtcaaggactttctgtccaaaagctttgaaatgaaggatttggaagtggctgatgttattcttaacattaaactactgagaggagatgagggtaggattacacttgtgcaatctcactatatggataaggtcctgagtcgctttggttatagtgactgcaaggcagctcctactccttatcatcctagtgtgctattaaggaaaaaccaaagaataggaaaggatcaattgagatactcccagatcattggttcattgatgtacttagctagtgcaacgaggcctgacatctcatttgttgtgagcaagttgagccggtttatttcaaatccgggagatgatcattggcatgctcttgaaagagtaatgcgtgctatctaaaagggacaatgagctatggaattcactacgccgggtacccaaaagtactagagggctatagtgattcaaactgggtatgtgttcacacttggagggggcgttgtttcctagaagtcttgcaagcagaccatcttaacgaggtcaacaatggaagcagaactcacagctttagatactaccacagttgaggccgaatggcttcgtgagcgcctgatggacctgccagtggttgaaaaaccagtaccagcaatcctgatgaactatgataatcaaacagtgattattaaagtgaacagttggaaggacaacatgaagtcatccaggcatgttaaaagaagattgaaatctgtcagaaagcagaaaaactccggagtgatagcattggactacgtctagacggctaaaaatctggcagatcagtttaccaagggactaccacgtaatgtgatagactgtccatcgagggagatgggcttgagacccacttagagttgcacaatagtggaaacatgtccattgtgatcggagatcccgtgaatttggatggcaaaacaaactattgtgtagctgagagaagacaccctaaaataagcttatcttcatgatgcaaatctggcagatcagtttaccaaggggctaccacgtaatgtgatagactgtccatcgagggagatgggcttgagacccacttagagttgcacaatagtggaaacatgtccattgtgatcggagatcccgtgaatttggatggcaaaacaaactattatgtagctgagagaagacaccctaaaataagcttatcttcatgatgcacttctcttctaatctgtatggtaggatggtatacaccttaatgtgatccgagtggcttttcataaagcagagatgttggcctacagaacatcttagaaggaacatacatatatgagtccgactgctagtcacagtctatgagatctgggtgatctctagatactcatgaaaaggccaggagtatgacttatatgctccaaacagaggggatgcaaacaacagcccagtaccagttaaggctttagtgaaacctgaatcgcacaagactgacatttcaaggcatagtccattgttcagttgtgatatggtgtagctcttttcctaggtggaagttcaacttaacagtctccatcgaaacactggtataactagacattgttcagttgtgatctggtaatggagatctctctctatatataacacaaggcggaggctgtcaaagagtgtgtcttcctcctaatattgttccttggcgatactctccttctgttcctacactgtctctctgtttccccggttctgttcatctcgcgtgcacgggtgatcggaacaagcaggtgcctccgaaactccgttcgctttagaacctgtacgggtaggcgggcgatcaagtttttgggtagcgcttcaagcgcgactgctctgcattaacttcaccaacatgtcgacaaccggcgacaacaacaacactggagacaaggagaaggagcctctcgtcaacaccaacggaggcaatactgcctcaaactctagcggagggccattctcggggtataacgtttcactattatcgttcgttcttcattttctacatctgtcggtcgcaatattattgcgttctcttatctatgttggtgcttattctatattaagcatgctcatgttgtacacatctagcactgtcactagatctactcaaattacaaatgtcatatttattgtcttaatattttagattaaaatataccgaattatgaccaaatttccaacatgacctagaggactccaaccatggcgaaaaaggtggacactgaaccacgccagcttgctgtgtcgtagaagaagttgggtatggcaaaattagcgtgtgaccgtgtgatcaacggcttaacgcaccctcttttctggagatacgagatatatacggagatataaaaagtttgaaaagttaattcaaagtggacctttgctttaggatacgtgatggaatagatggaatttttttccacgtagagtaggatacggtgtaaaatgtatcggatggttgaaaataaaataaaactgatggttgatatctttttgtcactacatctaatctaatctaatggtataaattatcaggcccaccgatttaaatgaaaactgatggttgatatctttttgtcactacatctaatctaatggtctaaattctcgggcccaccgatttaaatgaaaatcgacggtgagattacgcattgccatgtggcggtctaggagcgtttgtagaagtgtcatgtggcggtgttgacgaccaaatttggtaagttgtgaaccaggttcgacattaggatcgaggcggattcgataaagagatggttttaaaaaacaaagtatgcatcggctgcgaaggcatcggctgagatggatcggatagaggacagctgatacagccgatagaagtgatgcagccaattccgatgaagatggtttcaaggttgtttctagaatcgatcaaagtgcttcacagggattgccacgatgaagataagctctcagataggcaattgtatctgttaattaggatatttcgtgtaaatttcttagagatatgtttgggcaaaagtctaccgcaaagacttatggtatcttagagtttgttagaggtaagctttgtgatctttgtgactcatagtctgatccgctatgctataaacgtttataatctttgtgttaatgtatatttcgatctaagtgatttatactgtctcggcattacgaccgatctatcgcaatcacttggtttaaatatatatcgacagaaggattgtatatcattaatatctacagccgatcaagtagatttagtcttatcttatttttctataactgtcgatcgatctcaatatgacatcggcttaaagataaataatatgtcatcggcggctggccgatcggctatcgtttatggatttaaccaaggttttcttgtctttctttcttcttgattgtaggatcaaatcaactggcacgctcacgaacctaaaggcaagattggacctgcactgaaattaagcagatcttccaggccagtgtgtatttttcgtatcaacgggcggcttaagagcgtttgtagaaagtttaatggacttttagtatataatagatgaggggcattttggtcgcttttactcttcactaatttcaccttgggatgctagagatggtctttttttgttgagacaggagtacttcttcagctagcaggtttgccagaatccaataggtataggtggacctcttattagctgacgcgtgtgcgagggaaccgacgctcgtctggacggccacatggggccgattatagatggccaaatgggcctcccggcacggtacgacccaggtatgagtgggcccgtgctgaggtcaatcgggctgccacgggccaacctacacgcaggaccgggccgtgcttgcccacaagctataccaaaggcccacgtatggcccgataagacacgagccgtgcggccgtgccgagcctggccgaaggacgacaacccatcgagcttctccatagaataagtctatttttcctccctcatctatttgggctatgccttatatggctagaataagtctattttgcataatctatgctctttgggccatgtcttatatgtctaaattaagtctattttagatctctgaactatttttctttgacagtgctgtgccggaccagcccaccgtgccaaggcatcaaccaggcacggcccaactatcaggccgggccagcacgggcccaacaccagtcgtgttgtgtcgtacatgggccaggccaaatggccatgccatgggccagggcgtcgggcctatggccatctatagggccgatagttggggtcccgtccagaagatgtggcttttttcttccggaaagagaagcgagaggggcatagggcagagcattagcagcatgtcctctcctcatctgatattgttggtgatgcttgccaaacaaattccagagatttggaatttcagcaagattcattcatttgtcaaggaggatgtgctccatctgctatgagcttactttttttttttagagaagagtaattttttacccggcctttacatccaaccggatatatacaacattttttcaatcgggaacttagcccatcaaacaggaaacttagccctcaaataacttaatctgaaattcactccaatggagatttgaacttagaaccttggggatgcactcctatggagatttgatacatgccctttcacatgctatgcctttggaacgaaccggagacaaaatgtattgatccgaatgatataaatcaagtgaaagacccaaaaaatgtcctagtaaaagctatcatttcattgaacagagggaggaaattgaaatcaaagaaaaaacacaaaggaaaacaggataaagaaacatacagttcaacaactgattataaaatcaaacccccaaataaccattcagtggtatatatttcaggtagttcccaaaattatttctagcaatttcaagaaaattaatgcggcatgcccctttatcctcttcaagtcaaagcaagcaatcgcccatcttcagcttcatgtagcagcagtcaacaatttaacatgcatttcctcatagtcatagcgtagtggatttaacagctggtgacatgttgttttttgattgattgagcacaggctaaccatccacttcttttacctgtgggaatgattttcacctgttctctttagcttatgtcctaattcctgacttacaaatgcagaggatatgtcatgacatctagagcttgtcctctttacattacaggcattcagtctaaattaaaattcaatccaaaatcaaaattcagtctacaccactattaatctagtgccaacttaagaaattcaaaacgacctgggatgagaatcgcaaacatattgcaggttgattcataaaagtcggatcaccaacatcttccacttcctcatctcgcaacattttgaagtccacaatacatacataaacagcagatgcaagattctactacagacaatgccatagaactcaagaaacatccatgccagttgcttgcttgttcagtgggtgaaggtgtagaagacggtgccgacgtagacggcgagcgcggtggtgacgaggccgacgagccctgcggcggccttggcggcggcgcggttggtggcgcagccgagcgtgccgaggcggatctgcacgaccatgaccatggacaccatgaggaagacgcagccgacgacggagccgacggcggaggcgagcatcccgaggcggaggaggcgcgcgtcgatgtgggcgtgcagcgtgtcgtgcgggtccttggagttgatgaggttgagcgccagcttgagcccctgcgccacgaggctggagaagaggaaggaggagaaggccaccacctccagcaccaggagggaccgcgccaccccctgcccggcgtcgcacgacgcgtcgccggcgaggctccggagctcccccgggtccgccagggagaggcccacgaacacggccaccgtgaacagcgagttcacgttcaccaccccgtccagcgccgtcacgtgcacgctcgtcgtgttcgccgacagcgccgccggcagcttccactcgtacccgcggtgcccgccgccgccgccgccgttgctctgctcgtcagatctggtccgtgataagcatcattggatcagcactgaatcgagttcttggcgcatcttatttcaagaaatggagttcttggtcgaatcgaacaacgcaaagaggggattacttactcatccatggcgttgatgcgaagaggggattgatttgctttgctggttgggaaagaagagatcgatgttttgaggaaaaaaaaagaagggggacagtcgaatcgaaatcctgatgccttgtgccgaccatcaacatgggaacatattagcttttctagatactccctctcgctttgcattttttttttcccttccattctggagtacaagacattggccctgttattttctcctaggaaaactgcataatctttaaacggtacacgcaaaactgcacacgcttttcaaactattaaacggtatgtttcgtgcaaaaattttctatatgaaagttatttaaaatttaagattaatctatttttcaagtttgtaataattaaaacttaatcacacattattataacattattttgcgtgaaacacttaatttttatcttcatcttcattttcaggagattcaaacaccaccattgtaaacttcatttatttaattttaaattttttcattaaatatttatgaattcatagaaatgtaaattcctattttattttatatttttactcacttaaaataatctcctcatagaggaaacactaatggtaatatatggtgctgaaattgtgggtatggtgtatgactctattaaggttcaaatcaccaaaatttgtcacaggacattaaaacaaatatgtaattaggtgtgttaaatgattatagtgtgggtaaaggttgtgtttacaggtaactagctgtgcggcccgcgcaattgcgcggctagcacccaaacaaaattatatattttttaagtatgattttacttaaaatttattaaatagctatcccattgttttcagactttgaaagaccaaacattatcatcctcgtgtttctaattatatagtttttaaaagtcacaccagttgctacctctcatgtcatctctttatttatttgcttgctcgatctaccactatttctattcattctccttggaaatatttaaaaattggattttatagtttttagaatttattgtcacgttggattttgtttttataatttctagatgtcccatcaaatgtagccattatacttctctacggcccgtccattgtctcttctctttattgtcattgagattttaaaaatcaaacataaatactactttctagaaatccggccaaaccgtcagtggctttgccattgtactccactacgcctcgcccactgcctcccttctttattgtcattgagattttaaaatcgaacatgattatcattgttttttttttactttttagaagttccaaacctttaaaaattggaccttgtagtttttagagtttattatcttgttgggtttcattttttataatttttagaagtcccgtcaaacgataccactatactcctttacagcccgtccaccgcctactctttattgtcattgtgattccaaaaatctaacataactatcgttggaattcattttttattttctagaagtcccgtcaaccgtcggcggctctacaactatactcctatacaccccacccgctgcttctcatttttattatcattgagattttaaaaatcgaatatgattatcaattgggtttattttttttactttctagaagtcccggcttccaccttactcatttgcttcacgtcctgcctatcgtccctcttttaatcgtcattaggatttatttagtgttttattaatattttttaatatcgtatcaaccgctaccactctactcattcataggccctattactcaatttatctcgtcatgtgttttagatggctttttctttcaatagtctttatttttatcacaaaatttagttatttataaattgtattcctaactcaaatcttattttcctttttctaattttagatttttttttcaaattttagttaatatcgtattgtgttcttttaatatttttactttttattttcagttttagttgtttcaaaattgtattcctacttgaactctcttttagttttcctaattttggatattttttttatttttttctgaattttaattaatctcgtattgggttcttatatggattcttctttcaatattgcttttttttattccgaatttcagctaattttaaattgtattcctactttaactcttcttttttttgctaatttcagatttcatttttatttttattctgaattttaattaatctcgtattgggttcttctatgaactcttcttttaatttttcttatttttaattccgaatttcagctatttttaaatcgtattcctacttggactatccttttcttttctaattttagattttattttatttttatttcgaattttgattaatctcgtattaggttattatatggaaacttctttcaatattgcttatttttaattccgaatttcagctatttttaaattgacttggactctccttttcttttctaattttggatttattttatttttattttgaattttgattaatctcgtattgggttcttatatagaaactttcaatattgcttatttttaattccgaatttcagctatttttaaattatatttctacttggactctccttttttttctttttctccgattaatgtaggaatttctagccctacagcgaacgtggtgcctcctttcaaaactgttttgataatataatagatggttagtaacttattcctacactaaaaacaagttagctcattattagtggatgattaattattttaaaaattagattactataattttttataacaacttttctatagaatttttttaaaaaaatataccatttagcaatataggaaatgtgagcacagaaaagaaagatcgaagtttcaaggaaaaggaataagagggacagtcaaaagcctgatgccgagcgccgaccatcaacatgggagcaggggcgggcccagtatgtattcaagggtattcagatgtatacccaagatttttggacaaaaaataggtatatatattctatagttcgtatatgtattcaaaaaattaaaaaagagaccttaaactgcttatattgggccttgtttcatcatttcttctcaattgggcctaaatttctcactcccctccccctttcctctcagcccgcactctatttgggccgcatatcagcccatttcgatattttctccaattctcctccccatttaaccctaatcacctaatgcccaaaccctagaccacgggagcagagcggcaggcgcggcgtgcggcgcggtgtgttgcggcaggcgcggcgtgcggcgccggcgcggccgcgcaactcgtggggcggcaggcggctgccggctgccggctgggcgcaccggacctgaccggcgcagggcggcaggccccacgagcaggtccgccatccgcggcgcgtcgcggctcaggccactgccgacgggcagggccgtagcccccagtgcagcaacgcgtcatctcgccatctctttgtcagtagttccaatgccgctaatcattatttgctacggatttaaattgtgttagtgtgacttgatcaatagagctataaggtcaccctggtactgttaggcatttaggccggcttgccattggtcaagaatctagaggcattaatcccattcccatattgttggatttttaggtctaaaatatgaagagaaaaaatggtcttgctcttgaacaattgttcatgaattctaaatcagtaattcatgagtcccttgcctcaaacactgcacaattttcaatcatctatatatttcacatattgccactcttatgtgttgaacaattgtcaaatactcctttttgtcctataatatgagggattttggctatgcatatagccaaaatctcttatattatgggacggtttagtactttctatttgtacaattagtagtttaaatcaagtatataattatatgaaattatacctaattcatgttacataatttgtagtttagtactatgtgatacatgctaaaaaaattactccttcacatttcgaatacccaacctaaaaatcctaggcccgccactgcatgggatgggagcagattagcttttccggatactccctctcggtttgccttggtttttttttcttacttcccattgggtactgcacaatttgtatattggattttacctgtttcagtcagtcaaacatttatacttaaaactatatcaatacaaaagctttttaagtactaaagttattttgagatatcaagtattagcatttgtttatgtttcactcttttaaaacggtccataaataagcaaagcacgggttatttaatggtggccaccagggtttaaaagtcaaatcctactgccaataaaatattatgcacaggccagtgcactttcaacactgttttaatgagggtagataaaataccattaaactttatgccacaaatgaaagtacatcttcataacttatttttgtgattaatgatgacatttttaagaatgctctactgttgcctgagtgcttcaaaggaaaatggggttctgggttatttgatggaagaaaagacatgatcctagacaatggtaattcttgtatgtatttatttcttgagtctagataacgtacagagaatatagtgctcaatatcaagttttctctaagtttgagttgatttatggtcggaatttctgacactagtcggagtatttaacgcatcataatttccttttttcacggtgaactcgaggctctgtttgtgttttgttgaaagtgatcatagtataggctctgtttgtattttgttgaaagtgatcatagcatctgatgtaacattggaaaatccgatcaatcaggctatatgtttttgcaaggaactggatctatgtttaacttcaaacattcgatcaaaaacttcttacgttgaatcagaatgtccaacatcccaggcaatccgatattgcaaagaaattggctctcaggtcgaggcaacattatgaattataatatccaacttagtagtctgaaacttagtagtctgaagatcaaatggtcgaaatattcacttttccttgtaacccaagtctctgtttggatttatttcttcaatctgagtttccaattattaattggaatatctgatcagtattttttttttatggaatgggattatgttttagacattagagacctgatatgttgatcgaatatataaccttcaagtcagaatatccgaggtgtgatgaaagatcctcccaccccataatgggcagatttagggtgatgaaagatcctcccaccccataatgggcagatttagggtttcctatataagtcccaactctcactggctctatactagggtaagtctttcgcttcattcaaaatattcttggcttcaagcatgatgttggagtgcttttagctcttttcaccgcctctctcgaacccttctctgcttttgttatttggatacggatttggagttttgaatctagtgattgttcttctctcatggatcttgaacactaggttttgattccaaacgattatgtaggatatgttattcttggaggtcgaggacacctgtagcatcatctgaacacccattcacgggtagggcaccaaaagaagtttgaaggatccacaaggtaagagatactaccaatgaaagagaagtgtgcttgtgcaatattgaggatagggttaaaaaagactggctctttgtgagtttctcaatagagacattgaatcctctcaatggtttgaactcagggaatacattgttggttttaagacagtggactcaatttacactgctttataagttgaggtgctctatatttggttttgcgatttttaggcatgcaattgaaactcgacacttgtttgagggacccaaactgtacttttatcaaacaagaaaaaggagtagcccaaagaagagaaaagaataaagaggtggaactatggaagtgggctggtgggaaaagaagaggaagaacaagccaaaaataacccgagactttggagaatgattttaatttaaataatttctgaaatgttgtttcattttttaaaaaatactcagcatgctcaaaatgattcatgaatattgcagaaaatattagagaatgcaaagtatttaataagattttatctagctcaatttgaagtttaaattttgatttttattcaagcatttcctttaattattaaatgatttctagaaattgattttccacattaatttttaattaggatatttttagagtgtgacatgttgaacaggtctgatcaccacaaccattgacagtaaccaagaagaggaggcctagggtgattgcaagggctagggatgctgaaccaaaaggttgatggttgcgtatgtacacttgtgaaaggtgtgcaaattgctactacctctgccacagaatataagaagttttacagttggatatggttattaaaaaagtaggtggaattaaattggaagatgctgtgattggttaaaaagtagatgacggtggaaaaagtgaatggtggaaggttgtgactggttggaaagagaatttttttagtgaagttgggaagagaatgttggtagagaagttgtcatgttttaggataaatcctgaatgctaaaagttgttatattattgtgagtaaattgcacccatggtataacaacttggcagattggtgcgatatagtgcaagaacttgagaattaaacgtccgagtgcaataacttgacaagtaggtgcgttttagtacaagaacttaacaatttagtatttttgtgcatcaactaggctaagcatatgctaggtgagttttttttctcgatgtcaatatgccattacataataatcatacggatattatcttataatattgaatttaatctttaaaacttatgtagtacaatttacatctaatttactttaagaacttttttagttttcttcaccttctcaaatatcaaccaaaatataataatttctatatccggattaattgacttttaattattagttattaggataaaaatataaatatacttatacaaatccatgatagtatattgtcaaaataagtacttaaaaatgaatttatataaaaaatgctccaaataattaagttgccgcataacctttttatttgttctatgaaaatcgtacctaacttgcaagttgttgtatttataggatcacttataaaattcttatactaaattgcacatacctattaagttgttgtaaatgattatttctcaagttattgcaccaaattacatctacctgccaagttgatgtaccgtggatgtaatttactctattagatgagtacaaagcttttacatgttacctatcagctttgtgttttgcttcactaaggtgagatatatatatttatagacaaatctagtgaagcatggtagcattcaaaaactgtggatcattgtgctcacaggaggaggtgatcagaatataatgaggtgtctataaacgaatacgtgcgtgcaatgcatgcaaattattcctatacatctagccacgtacgtgtcgcatccacgtatgttatagatcagagcagttgactttagttttatgaaaaacttaatatttagctggttaagtcagtgtgcaagctactgtttaaaatgattaattgtattagtactttctttggtaacgtttagcgtaaggcttcaacaaatgtttgaaagtttggccatcaataagtttgaaagttagttatttaaaaaaatgttttgcatagatttgttaggaaaccgctatcataatatatatatcataaactttttatattttataatctttttctaatataaaatatggtcgcgtcaagtttgaaaagtttaaccgaatatttttttttctaaacatcaaatatatatttatgacaggatggtgtatcctctatcatggtacaaggaactctgacattgttctacaactaacatatttgataaattgatttgagtgtatatacaagggctattgttttgatcttgattaaagacattatgtgttgtaagcatttcaccgattcatcaaactgtattgtatatatgaaatatattattataatttttcaagtagtataataatgtaaaaatatacaatacgttaacactaatttaatttcagccaatcaggaaacatcacagccctaaataatgatcatttgacaatagcaaagtatttcataactatttgtgatatgaaccatatatactgtattacatttccatgatcattctcattatgactgcccgcttagtaaagttccattctgtaaaaaacatattttgaaattgaaccggcaatgaggcagtttcaagaatgaaccaacggttaagccggctcgccagctataaatataaataaaccgtgcctgtctatttatcccatctaaaagtcgctatctcccaaattccccatctctctagctcttacccaccacctacattttgctcgcccactgccgcatcctctctttcccaagtccagccgacatgcccctttttctagcaccgcttccacaccctcctccctatactcacatttgccacctccttttccccatccccgccatcggacccctcatatcccatgtctaagcatagacaccttaacttcctaagtcttggcaccagcccctcctttgtctctctgagcatagacattagcgactatgggccttatatgactagcatgtgctcaatgttgccagatatggctgacacgagcttagggcctctggatctgggtgtgatcgatggcaactatgagatggttgttgtcaatagcaacatcgactgcagcgacaacataaataaaggggggtttggaagggctagtagagttggatgggaatggcaacgacgtctgcgactgacttggcttagggagcctgtagtcttaactcatcgtttcatcccgtgaattgcgtgttgcttcatctcctcggcagtgaagggctgcgagtgtgctgattgatctcctggtaatgttgtgtggcaaatcacgtgttccgaagaccagctgtgacaacaactgactggtatacagatcgacaaatagccatcacgcttaggtccatgcataggcgaatttttccaccccacttttgtcattgtctgtgctcagagaacacacctctatgctgggttcgttctacaaacacctaggaggctgagaaccatctatgaacggagaaaatctaattcaaaacaaggtggaatatttatcagtttacaatattttatctttcctactgtggccaaattttaagctcatgcttatgacctttgtactgccaaatttcctatatctcctgtccttcaattgtgcagtccagaatagggcagcgcatatacatggttttgcgtgaggtggcacaggaatcccaccggtgacggtgatcgatgccgacaagtctcatcgcagttgtgacatgcataatcagcggctcagcctcgtccccatcaattacggtatcgagtatcctccgtcccaaaatgtaagcatttttagctatgtgtccagattcatagtaaaaaattgctatattttgggatggaggtagtagctttctcgacattgtcttgtctaaattgttgatgtggttgttcaacatcgaatcaccaattgcatcccagttgtttttccatatagccacatcatgatagcatgactaggggatgcacattttttttctaattgttagatttttcagtcctttgaacttctaaaaaaacaaaatgagttcggaactaatttacaatttatagtagatctaggatgcacaaaaagaaatccattgaaattttgcaagctcaatcctcttttagcaaacaaaccattggtaccatttatttcattttcatgtgcaaattagtccaactagtgccatatatattttcatgaaatgtgcttcccgaggctaaacaataagcacattagtaatttatctagttgaacaaaaatgcatacacaacatgtacaacacaatacaaagaaacaacccaacagtgcacaaataaggcatgcattctttcaatggaaagggaacatttattcataagcacataaggctttgcgatattacatagcactcactggaaggtaacagcaacaacggagaaaacaaacacattcaggaggtgcatatatatatatacttagagtgggcaagtgaagccaggagggcatgtcctgttgcatgagttaagaatgagagtgaca

SEQ ID NO: 9886 - DNA, 744 bp, Oryza sativa
ttgacagttcatctccatttctcagatgattaatgtggatatccatggcttcaaatggcctcgcacggttcatcacgacacagtcttcacttgcccttcaccaccggtttcggttcgtcggcgccaagccccttgcttgcccttcaccaccgcatggtccatcgcaactgagcgtcacttgcgcttcaccgtcttgccataggtagtcacttcatgcccgcatcttcaatatcttctctttaattctcatccatcgataagtccatttcctagtttcttcatcggactaatcacttgcttatacactccataagtgcattagtcccttaatcgtttgtcatcaataaaccaaaacccactaggggcatagatgctctttcaataacttgaaaataaatttatttgcttttttaagttacttttatatagattttttttttaaaaaaatgcattatttaacagtttgaaaaatgtgctaaaggaaaataagaaagttaaattttggagttgaggaaaaaatagacttgtcagggttatggataccacatacctaatagtagttgaaataaatctcggcaggacccgccacataccatgtcttatacgaaaacaactttgaatatagaaggagttccgcataaggaatgatgaatagagttctacatgaaaacgacaaggactacttgaattgtatccagtattggtttccctaattctacttggacaaggggacatctatgggta

SEQ ID NO: 9887 - DNA, 1053 bp, Oryza sativa
tctggctggcccatggccggatccggtgctcctcgcgacggatcttgccgcagtggcacgaaagcgacgatgtcagtgtttgaagcgggaggccggcgtcggtggctggatggcaatgtcactacagtgggtagcgacgagaaggccgtgggcgatggcggtcactgacggccgccggcggacggcaggctagcagggatagagccagtggtcgccggtggatgggaggctggcacgaaggagctggtggtcgtcggtggacgggaggcccgcgcggtggacacgggcagcaacacgagggtggtgcggttggtgtcagtggtgagcctgccttggtccgagcacggcacgacttggcggtgtggcggtgaggctaacgcggtgggaggacggaggcgacggcgaggtgaccaggcggcccgttgtgaacacgagcaaggtgggtgttgaaggctgcggcaagctcctctccaggcatcaatccttttgcgacgatggcttgccgcaacaagatagccatgttggatggacttgtgcggcggagaggagatccattcttctctctcaccctctccctctccaacccacccacgtagatggatttggagcgctccggaggtcgagatcctgctttgatggctggccagcggcgaggcgtcagcgcggtacctacgcgttgaaggggattagctggtggttattgctgaatctgacatgcactcaatgacgtgggagagtatgaaactacgggtgaaagcctagtgttcgggctggcaacggtgacgcttgcgggcgcctctttcctcctggggcgttgttgcatttttctctattctcccaatggtttcttcaagtgaaaaccacgttcttgttctctaggaagggcggcggcggtgctcttggcgtcatttcctccttggaggcgtcatttagaagaaccattccgggtgttgagtgcatgtttttgtttttcagcagcaggatcagacgtagacacgtggtgtgactgtctttttctttttccgactatagtctgccaggactatagacttg

SEQ ID NO: 9888 - DNA, 3471 bp, Oryza sativa
gcttatttaggtgcttatgatcttttttgttaggcatatatgtagctggtattagacagaatattgaggctttaggtctggactttagcagcaatagagaggtttttgggctgcaattatttatagttgaaagagaaacatatataacatttttttattctaccgaactttcatgtgacagcggtgactatcgagcagattggcaccaacgtgatgtacaagttcaaggattagacaagagttggatggatcccacccctacaccgtccatttttggtgtggatgatctgtgtacaatttttgctgctaaccttgattgccagatggttaaatcccggtctagagtgcctcctcgtgaagagcttcgtagaatcagtgatgagcgggactacaatagtcttcgtattgcattgaaggcatacatcagtcgaagcagtgaaaaggtatataaatgtgcatgaattgttaacttatgctttgatttaaaacgacttctgacatgttgtgtcctatgtatcagactccagaactacgggttgttagtgtacttgagcggaaccttatcgtggagcatggtcaaggatttctgcacttcaatttcttggtgcaaccggttgatttagaatcttcaacactcaagatgttctttgcagaagttcacctggactgcaaaggagacgaagatgtgtatgtttgctgccctttgcatgtccacgacaatggtatatcttttgcttatcttgcttctgtttcgtgcatattgttttgagaatggagttttagtacccagacatagatctttattcacaagtttatagttagatcctttagcatctcctaaactatacttcatccgtcctaaactgtaatacattcttattttaaaaaagtcaacatttacaacttttaactagctagtaattaaatctccaatatgtgtttagtttcaggcatatgacatcattaaatttgtatttgaaagtactcaattattatgggagaaattaattatcaaagttctacattggagaccatataaaaaaactcgcacgccttataatttgggatggagggagtatttaacaatgtgcaatttgctatacagactgaaaatgtaacacattgattggtgtgatttcaggccactgtttcggatgcagtgttcgagctaagtttcttaggcaccccagtagtcatgtttttcttggtggccacaaagatgtagatttcccatttaccgactcatcctcaaatgaccattccaatggaactgaagatagccttcgggatgaagaaagtgagaattcaaagatcgaaacagatgataaagattcaaacagtgatacagaagaggagacagaaagcaaggatgattgatagataaaaggtatgaagattgtagggatgaggataggccctcttttcttggcatagcagtgctacaaaactgtaggttagtttcgcacttgaaggtatgcttaattacacttgggcagtcagttaactgtattacatatcttgttgatttgctttgcattagaaggtatgcttgaccggttgactgtattacatatttgctcagtaattcagtagcatcttaattagcagtctgtctcagcccacgatatcatcttttacatcacatatttgaccagagtgccaaggaaatttaaaaatagtacatatgagtgcagtcactgctacaacccattttgtgaattgtgatgcctgtcttagttacatgatcatggtatctacataaaaactaatgacgcagcccctgctatatatatctattttgtgtatattttgcaacatatggacacagaattacataaaatatggtgagacttttccatatcttctgcagacatctcacatctgcatggtgctcttctcaatataatcaaggcagagctcctgccgttctattcaaaagatctcttctgatggtttttttgacagaatgtgatgcattacaaagagtgtgccactgctgatatattcacttgttgctctagcattgactcccaaggtcaagagttcaaagcgttggtctttgagtttatgccccattggtagttcggatagttggtttcaccagaaaattgccaaaacctgatccaagcaattaccctcggcctagctcagagattgcacattgttgttgatggcgcggacacatcttcaccactactgtcaatcaccaatcatccactgcgatttcaagcagaatgcagaaaacatgagtacacacatggggattttggcgtatcaaagattatttctatctgaacatactagcagaagtgcagtaaatacatccagctccatcagaattagaggttccatcggttactttgctccagctgtcagcctgtcatatacatacgcaagccctgttttcttcacacgttattttgtgttattccctgttttcttcacatgctattttgtgttattcttgcctataaatgaacgcatcatatcatactgaaataatttcccctgctattgcagagaaatggtccggaaagtttgtgcagtctcatctacctgtgacgtttacagttttgacatgctcttatgtacttgcttaatgataaacatctcaattttgtgtactacaaactgtgagtatttgtttggctatcatcttaggagtacatatatgccaacgatttttgtgtttcccatacaatctgattattttctaattgcatactctctaaattcgctcccaaaatcagtctattattaatctttaaatccattgtatatgctttgcaatttagattgcccaattcatagtgttatagttgattgacatcatttgaaggtttttggagtaaatattattgtattcacaaatacatttacataacttattgtgttttcacgttatttaagacccgttgcaacgcacgggcataagactagtttatttataaatcgttactaaggtttttgaaagcgtattcgacgcccaacgcaataacgcgactccaaccataaccacctcaacaaaatttacaaatttaatatcaggatcagggagataaaataacaggacatgaaaatcacacgctttcacgggcccagtccggttttttcggttcaaccggtggcccggtccggtattttcgtccggttttttccactcaccagtcaccaccccatttgtgggccccactgccagtgactcttctgtccactgcacacgccgttttgaaatttcaaatagccccatgttcattgtttgccgcaccacagcgtagtctcgcctcgccttccggaagcttcgagaagcagagccgcctcctcgcctcgcctagcctcccggaagcttcgagaagcccccgcgcggcccgagccatggagaagcagaagccggcaggccacgacgcccgcctcctcctcgcgctgcgctgctccagggcgtcgctgctcctctcctcgctccgccatccc

SEQ ID NO: 9889 - DNA, 7846 bp, Oryza sativa
gccctcctcgagtcgcagggtggtagcgtgctccgggacgccggcctcctccgcgcggagctcgctgcggcgcggcgcgaggccacgatgcacgcggcgaactccggggcggaggttctcctcgtcctctccctggtccccgtcctcctgctcctcctcgggttcctcgcggcagcggcggtggcggcgtagtagggagggggttcggagcgcggcgccggcttgagatcgacggaatcggaagggttcggagccagcttcaccgttcttgtgctccgtgagtttcttcctctgttgcggggcgacgcgttgttgtgcggatgagcaggtctagctcacggcacgattgtgtagtgatatcgtacatatggcatcggattttggtcgtcccgttttagcgtttgctaggtgttcgatggaatgcccatagaaagtgtagcttcgatttcattgcttctcgttgacagagtaaaataatgcagaaccgagaagatgatgctttcatttgtctgacctttgatttttgtgaatttctctagaacatattctaaactgtgaaagctttacttattgctctcgattagacatggatattgcaacgggaaccaataccaatcatagcttcttgtttgtccagtccagtagtgtacatttttgtaagacatgggtgttgtgtcttaaaaaggttctcatatgcctcttacaaagctaaaatgcagtgctgaaaaatgtgttaatgctagaattgaattgttgatgatttggtagtactgaaaaatgactgaatgcttgatcaattgaagatatcttttctcaagttgtcactggtatgcagtctgcaggctatcaccggtaactagagaagttagctgctaatagattacttttactgactgtggctacatacgaattgtggaattgctcgcttgtccatggcaaatcataataaactgaactcatttggttccgagcacggcactggcttgagatcgacagaatctgaagggttcagagttgcttatcttgttctggtgttccgtgattttcttcctctgtttcggtaacgtgttgctgtgcagatttgcaaattacatggcctcagattttggtcgtcttttagcatttgttaagtgttcaatgaaatgcccatatgtgttcagggacctatagaaagtatagtttttgattgcattgcttctcgttgacagatgaaaacaattcacaatggaagagatgagacgcatgttgattatcggatgtagtatttctgattggtgtggcttgaatgctagattcagcctaccttgctttcatttgtctcgttgtctgaactttgatttttgtgaatttctctagaacatattgccacgtttttgtgattttttttttaaaattttacatattgctttcgagtagattgtgggtagcagtgtgaaccaatatcatgcattgcttcttgtttgtccagccagtccagtgaccggtagggtaagcagggttgtgttgtgtgataactagtttctcttatgcctctcacgatggaaagatcgtactgccttttgcaatgctagagatgaattgctgacgatttggcagtgctgaaaaatgtttgaatgcttgatcggttgaacatttgtgtattgactaaaactgtttgatgtctgtataatatctgtttgatgcttgaatattaacttttgtgaagatatgttatgcccaattcagtagcatgccgtctgctggtcttccccggtagtagccaatattgttttcgtctaaagtaataccagtaactagagaagttaactgctggagtaatggattgcattactgtatttgctgagtgcatccatgtaaagagtcctataatcgatcacttgtcattttgtcaaaggcaaattctagatttacttgtgattaatggttaaatttgagtgcacgtgcagcatcttaagaataacttgttgacagaaaaaaaattccttctgatttccctaggaagaattaatagcgattcagacttaattaagcacaacatcaggttgtagctttgctattaatcccagaacgatcacagcagggactctttttaccttcaatacgatcttttgtacgaatacattccatgtatatctggggttggcatacttatggatttctgccgataaaacgtgcctcattttccataaaccaatgcacttcccatgatctatgcgaggtcaggtaccctataaatacctgtgaactacgatactcaacgtagaccaacgatcaagtctgacaatatatcgttccacagacttctctttcatgtacatcttccccaatcttctgctgctaagtttgcggcaaaatgtctgtgctgttctttctgttggagtttaatccacttaattaatttgagtcttagcctaaacatgatcacctctgcttaatgcagaaattgaatttgattcactgaccttgatgtgaagccattgaagtcttttcttcttctattctgttcggctctcctgttcatggaaacaaaacgaacagagaaacctcacgaacccctttcagtgttaaaaatcgattgggtaattgatttagtgtttagggttagagagagggctcgacatgaccgctgcctcttctcctctttatgatatatagcgacactggtaaggcttgggggtttgtctccaattaaaattcgaatctattttgtaccgatcacacaaaacatattttatgtcttatttggttgataagaaaaccggtgggattttactcttatcctaactaaccggcattagtcgataaaatcaactaacattctcctcttgattttgagactaactaacgagtttactaaatataatagcttcccaaggcaatctgtcacaacaacattatgcgttactgagacaataagacttattgttcactatagtacccaaataaactcaagcttaacttagtgggtgttgattgaaaaattaagtccccctcatccaggatcttaataaggctaatttacacatgtactggccagaacatatcttaattaaacttaattttataagcctttaaagtatggatccatgagcaaatgctcagcttagggcctatttggttggagggactaaaactttagtcgcttcactttagtccctagagtcccaaacaggagggactaaaaagacttaaagtgcattagtccattggtccctaagggaggagcttattgggactaaagtagctcctttccacccactgccctcgcgcgtgccaaccctatccatttccttgcctcttctcttcctcgcctcgtctctctcttgctcctctcgaccccgcgtcgtcaccgccgcctccctgtgcaagcccccgcagttgcttcgcgcaagcaaatcctctaccctgcacttgcctcgccggtgtcatgcaagccaccgcgagttgcttagcagcaatggtagaggaagatcctcacgatttcttctcccaatcatacaatgatgctccggcggcccacatgaacggctccgagtacgatttctcgcaggggtcgttaggccatgctggatctagcgtcggcatccattttgggggggggggggggaggggatccaggggcctggatctgaactctcaggccgacgccttccctgatttcgcctcctaccagcagatccttcaaccgggtagccttgggttacctccgatccggccaggcagcagatccaccgtcgcaatgtcgcgccctcctttctgggggggacgcggcagaagttgtggagggagaggaggaggacgaggccgcgctaggtcgttgactattggcgcgggatccggcagggggatgcgtggatttgttcccctggctcagtgtccggcaatggaggtgtccgagctcgtgcgccctccatgtcgcatgacgggccccccttcttcgaatttggagtctttggaggaggtgggcgacttggtgcgtcattgtttcaagggacatcagtggctgaggacgacgccaatgatgaagacgaagaggacatcggtcccgatggtcagcccacggtaaaccccgatggctcaagattgctcttcaattttcttatttgcacttcattgccgtgagctcatcttattgaaactgctcttcaacattcttatttacaatgattgaaatgccattagttgttcatgtggttaatttagggttaaatcatgttttctttactagaatactcttgacaaggcatgctagacagaagaaaaaacttacacgttgtgtgaaatagcatgtgaggaattgagggatggacattgtccaaatggagcatggacaactagagggtaccagaatttgaaggagaaatatttacaaagggctaaactaaagcattcaaccaaacagataaagaatagataaataatttcactagatgcttggtggaaaaagaatcaaggtacgtagttgtgtcaaaaattgccgtagtttacacgcttttggagatttctgtgatgttgattcagtgtcaatacaggagaagggagacgccaggaaatttcgcaatggcaaccctgagtacttagattttcttatagagctgttccaaggtgttgcagttgatggatccacagcatatttccctggttttgatgaagacgaagaggaaggggaagaggaagcaggggaaacaagaagaggggaaacaacaacatgggatggttttgagaacagtcccatgagcaccaacagcaggaagagagggagcagcagctgtgatgtttccacagcttcaagtcctggaaaaaaaaagcaagagcccagtggtgaagctcatgaagggcctgctcaattctttctcctctgagaatgataagtcaactaccctcattactgaacttgttaacaacaagaagttaaaggactagaagaaagaagacatgattgaatcattgacgcattgtcaaaagttggcagttgagtgtggtgtagcagaagatagtgtggaatacttctgtgcaacatagctatttgctctcaaacacaagaaagtgatgtttgagaacattagcactaatgaagcaagattactgtggttgaagagatggtgtcatcagaagaatttgtattagaggaggtctttattagttaatcttagctgtaggtctttcttagctgcatttagttaatcttagctgcattagaggaggtttttttgtcgacccctggttttgtacactggaaacctcatgtgattacaataccattccctggatcagtagatggtatacacatgacaacattgtatatcacaagttgacatcgttatacaggctttacaatacatcaataatataagggttgcccgagtggcacccgaatagaccaagcatggtcatctacaaagaccaaaaatcctaagaagtagatatggtagcggaagcaaagcagcgacggtccatcttattcaacaggcagcgactggtgaacctaggtccctactccaccgtcttcgacatctcttcatcagcatggcacacgtacagatcgctccgacttctccttctaaaagatttaattaagcaagggtgagtaccaaccgtactcagcaagccaccgctacagaatgcatatagtgctcacaggaattcaaggatggcttggttcgtttgcataaagctagatttcacaaatcatttcacaaacctatgacttagcagttttaactgaaaaaaacaacgttattgttgaagttgttgttaattcgcaagggttcatccaccttccccaagcctcgcttggtccggtttaccctcacaaccagttttcccacattctccatcgctacgaccttcccattcatcgggcaaggtcacacctctttccctaatctaagcaaaattaaaaatctatgaggctagtcaagaatagtacaagtcccggtgctcattaaccgcgagcatgtctattcgaatatattagttttactcacactgcagtggatgtacgcttttaatcccgcactccatgacttgcccaacacatgagcctaatcccaacacatgagacttgtcacggcccggtttttcagtcaccctcgcattgcggcacctgctccaaggactatgaatccccattgcactcccgacatagcacaccccctcgagccggcagtgaggggtcctggcgctcccgagattctagggctataccatatctgatcatatacttaggtgtattttaggtttttgccgcggcattcaaacgatcgatccaattgatccatctcaaacgatcgatccaatcgatccatcacacttccgtcacaattgtcaccacttcagaatcatcatgactggggtgccgccccacaaggatttcttagtccgccgggtctatacccattcgagaaatgcggtcgtactcgtttcgtttcctgcatagcttcttgactcggtccttaattgaccggggtcggtgacttgccgtttctagaaccacccatattctattcatgtcaccccagtcgaaatcattttgttttatttggtttttgtaggctttctccgaaggagtattctttgtgggcccacctgtcagtggcttcaggctcttggggcacggtagactgagtctacggagcgcgcgacatggggaggtggtagggagggctcatggtccacgaaagttgcgtgtggggcccgatgatcagtgggatggttcacacgaacagggtgcatgtgaggtgagaggaccgtggtggaggaggtccacgggtccagcccctttggtggactgggtggtggggccaaccgatcagtggctccagggtggtggactgggcgcacggtcgactgggaagagcgggtcccacatgtaagtggttcaagggttaaaaggggattagatagaggtttaacctggtcgggcccacctctcagtgcgattagaagggtttacaaaggggattactatgcggattaggttaacaaaacgtggggcccacttgtcggtgtctcttctctcttcctattcttttcttctcctcggttcttcctcctctcattctctcttctttctctctctctctctctctctcgatacttcctcctctgctttctttctccaagtgcgcctgagggagagagaggggagggccggcgggcggcggtcaggtgaaggcggcgtagcgcggcggtgcggccgaggtgcgacgcggcttggcggcggccgggcgcggcggccaaggcgatgggcacacggcgttcgggccgcacggcgtcgagcacacccaaggtgctcgtccgtgtgtctcggactagcggcgttcgcaagatagcggcgattggaggggcggaagaggaggacgacggaggaggagcgatattcatagccattgcttaagagggaagggcaggacgccgatgcgagatgggcgaagagcggctggtgagcctggactataatggcgatgaaacaatgataaagtttttttatcagactaataatgtgagatcttattgtaaagatttgattacaatgaatataacggtataatcagatcataaattggattgatggttttgaaggaaaatcatttggaagaatcataatatgcatgctatcaacaagtaatcgagcgagcccacattcccatcctctctctcatgactctgttggtgagtaggattgggcctaatcagatttcatgtcgatgggcgtccgattgttcttgcgtctgacatgaagcattatcgaacttgcattgtcctccagttgccgccatataactcctaaagtatttcatggcaatggcggtctcctccagttgtcaaatggtgtagggctcat

SEQ ID NO: 9890 - DNA, 34738 bp, Oryza sativa
atgtatacctaagatttttttttaaaaaataagcatatatactaagtatttggcatatgtattcagaacaacaaaaaagccacaaacagtccaataagcaatcaaactacctttttttgggcatgcttcatcctccctcctccattggcccattggcccaagttactaggcccaaattacccactcctctcatctctctctcactggccactcacccctttctctcccctcccctaaccagctaaccctagcaaagctgcgcgggcggcggccggcgagcggcgagggagtgaggtggcatggccacggcgcggcatgcggcagcagcgggcttctggctgtgggcgcacaacgggttggcgtgtggccgtggggcatggtcacggcttggcgtagccatgcggggcagcggtgcgacgacgtgggggcgggccgccggggcagtggcgacactggcatagggaccagcggcggcgctggtagtggcacaggttagggactaggtggactagggccttgggaagttgggggaaccaggaacctccaaggtgaggtttttatgcagtatttttcagtgcttgattgatcatttagttacattcattgaaaagaaatccgtattgcaagttaaggataaggacatcattactcatttttaaaacatcaagcatcgaaaagttgatatctaaattgtaatacttcttctaactgttataaaacatgccccaaaatcacatcggaaaccaaacgcggaagaaaatgccataggagatccaaacatgatgacgacaccgaggcatgatatttgataacagagttcagccgaggcctacatctccggggcactgattacgggtgctcctccccgatccagcatatacagcatatcagagttacaacgactcacggtcggtcgccgccggcagccgctccctctcgctatgctatgtcgccatgcggttataacaggcacgcccctctatttatgagagaacctaggacagagtccgactcttactctagtcctaatacctattacaactccaagtcctaaactgtaacctactacgtacacatatttgacacaaactctaacaaactccaccttggcaaatatgccacgccaacctgaatctgttacttgctcaaacctccatgtaccaggacttgagttggttccttttcgccgctcacgccaagttgccccgacaagccttcaccagactcaccgtaaacaagagactccgctatccctgtaatttcttcctcctgactccacctgcaacagtgctccaccttctctcctatcaccataatcgtcttgccaagcgaattgaattcttcctagctgtcacatcatagactctccgaagaccatgttcacctctatctaccgtcttaagtttgacttgatctaatccatggccagataaccgatgtcatcaccaaatagacaaaccaaactcaccagacatgaagagaaccctttcttccgtcttatgaaccgagctaataaatccaacatccacgcttctccgtatccgtagactgaattcctgataatctgagaaaattcactgttgccttgaatcatccgaagaaattactaccatagcgctcgctcttcctcttcagtgacgcagattccatatatccccatcatgcaaactccgcagattctggatatatcatgtactgcaaacagcctgttgatgccctcaacgattttcatccgcggttgctcgggaccttctagttttggtccactcgctgccttcgtttgagtcacgtcttgactgaacacgccaccttgccttgccacatgctaaatttttccatacaatagcatgaccacacaacttgaccaagttcctatgcataatcaattttaccgttcggtctccacgtgcaaaccagccaagcaaaaacatttgactgtgcatccaaaaagtccacatgggcccacagccaactagactcggtcaacaacagtcgcagcaactgaccagtcgcgtccagggaccagatcgaaacaaccgatcccctcgcccttctgctcgctcccctcagcctgagtgcgccgccgcccagcgcttgtcgcgcccctgccgcgccggccgctacttcctgcctcaccgtctcctccgcgccgccaccgaagacgctgcttcggttcccgacgccgccgcccgtccagaagatgctgccgcgcagaggagtttttttttgaaagattaacggcaggagctctgccggatatattaaaaagaagtaaaaggagtcagacaaaacgaaaaacatcaagcttaggacaccgccaatgacaacgctgccgatgctgccaccgtaggcttcccgccggtgaggatgctgacgaccacggtaacggcctccccgacacaggagcgtcgctgccgccccttcgccggtacttgccccgacgacaacaccaagccgtgctcctgccactcgacgctcgtcgtcccaaatcaccgccgccaagaggtcccaatccgacttttgcttggtgatttgttcgattgcaaaatctgcaatcccgtggattaattcctgttgctgagtcctgggaatttgatgtccgattttaagtccaaaccgaaacccacttccttttccctttcgtgtgtgtccagtccaactaggcctcctctcctggactacttgccacaaacgccgccgtgaccgaacactgtggctccgtcctgattggagtcctgtgcaaccatgactcctcccgagcctgcttcctcctggcgttgcttctatcaatgccgctagcctggtctcaacgtgcggtgcatgcacaccatcgcgacatggacttccaagccttcacgtatctcacggcttctgcaccttcccttctgcacttccggccaactccgctaatgacgcatgccatcagtttgtaaccaatgcatacgattgtgcaaagcctctcggttgaactgacgtttccacgatacagtcggcccaatttgccgatctggtcgtcctcagcccgatccgcacgtacgccgccctcgaagcaattctgttgcacaccttgttgaagacacatccaaaacagcctataggatccaccgttgcggctccacctcgagcccgcaacccgctctgacctccgattgaccacctgtcaatctagccgcgagccgaagccgacaaatcacatgccgtcttcccagccgctgaacgacccgagtgctacgtctagccatctccctgtcgaacgcaactcatcgaaaggcccgggacacccggcccagagtgttcgattccaccgatcgagaacgccgatcgcctccagcttcaatcaacccgagcgtgcggccgcacgtctccctgtcgagagtagctcactggaaagttcgagccacccgcccgaagtgtccaacccaccgattgattcgccaatcgcttccgccgccatcaacctgagcaccacgtctggtcatctccctgttgaagcagccatcgacggttccggccgccgccagaagtgtttgattccaccgatcaaattccgttgatcgccgccgtgctccaccttgcgtccatgtccgtctctggacaccccgtgtagtcgtcgcggcgtggagcacctccctcgtacctctaccatggatctgccgcacgctctgataccacttgttataaaacaggccccaaaatcacatcggaaaccaaacgcggaagaaaacgccatagaagatccaaacatgatgacgacaccgaggcacgatatttgataacggagttcagccgaggcctacatctccggggcactgattacgggcgctcctccccgatccagcatatcagagttacaacgactcacggccggtcgccgccggcagccgctcgctctcgctatgctatgtcgccatgcggttacaacaggcatgcccctctatttatgagagaacctaggacagagttcgactcttactctagtcctaatacctattacaactccaagtcctaaactgtaacctacaacgtacacatatttatgtatttcatcctccctcctccattggcccattggcccaagttactaggcccaaattacccactcctctcatctctctctcactggccactcacccctttctctcccctcccctaaccggctaaccctagcaaagctgcgcgggcggcggccggcgagcggcgagggagtgaggtggcatggccacggcacggcatgcggcagcagcgggcttctggctgtgggcgcacaacgggttggcgtgtggccgtggggcatggtcacggcttggcgtagccatgcggggcagcggtgcgacgacgtgggggcgggccgccggggcagtggcgacactggcatagggaccagcggcggcgccggtagtggcacaggttagggactaggtggactagggccttgggaagttgggggaaccaggaacctccaaggtgaggtttttatgcagtatttttcagtgcttgattgatcatttagttacattcattgaaaagaaatccgtattgcaagttaaggataaggacatcattactcatttttaaaacatcaagcatcgaaaagttgatatctaaattgtaatacttcttctaactattataaaacatgccccaaaatcacatcggaaaccaaacgcggaagaaaatgccataggagatccaaacatgatgacgacaccgaggcatgatatttgataacagagttcagccgaggcctacatctccggggcactgattacgggcgctcctccccgatccagcatatacagcatatcagagttacaacgactcacggtcggttgccgccggcagccgctccctctcgctatgctatgtcgccatgcggttataacaggcacgcccctctatttatgagagaacctaggacagagtccgactcttactctagtcctaatacctattacaactccaagtcctaaactgtaacctacaacgtacacatatttgacacaaactctaacagtaactttatcattttctatcatttatgtatttcatatgttagcactttgatatgtttactgattagtatttctatatcttagactatttcaagtgacaatcaattctatttgtgtgaacttatgctcaattttttgttatatacgttatatattatataattataagcgtgtgatactatacaagctaattattaggcttttaaatgtatgaataaaatttttctttaccccttcctatttcgaatacacaaatgaaaattctaggcccgccaagatggtgccaccatcactgtagtataaccattcgcaataccaatgagtgtatgatttattatagaaaaaggtacgaattaccccctaaactatcccatttgaccgaattaccactctaaacctgaaaaccagagagagaggggaagaacctgcattctaaaacaaaaaaaataggatatatgagggaaaactatagatttggccttttacagcttgaacttatcataaaaaaagatgcgacaaagaaagctaccataaaagataatacctcatcatctttaattaatgtagggtccctaccaactccataacgtctttggtttccgtcacatatatttcgcaggtaaacaaatccagcctgaaatataaatgttaattacggtctgagagcgaaaattcaattgtttggcacggtaaaaattcatgatgcttcatttactggttcaggtgcagatttatatcaaggcacattaacacaggtttctatatatccttcatttactggtagaaattttacctaatagtagcaccaaggttcattttcaatcacactatcaacactcaacagacacatagtgcagcattttagcaaaacctacaatattcagtaaatcctctacattgcattgcgcgtggaacaaaccatcctaacaaacataaccagaaattaacatcgcgggaaccagaaaagtgaaaataacatcgcaggaaccagaaaagtactccctccgtttcaaaatgtttgacacagttgactttttagcacatgtttgaccgttcgtcttattaaaaaaaatttgtgaaatatgtaaaactatatgtgtacatgaaagtatatttagcaatgaatcaaatgatatgaaaagaataaataattacttaaattttttgaataagacgaatggtcaaacacgtacttaaaaacatcacgtacttaaaacaatagacatccagctctgatgtaaagcgagtcagggtgcttcagcaagccgtgcatctgcttaaccgtgagcttcatggtgaagaacttgtagaggaggcagaagtcgctggaggggccacagcagttgcccggtcatccattgctcgacgtggtcaacctggttgtagatcacgttgatgacctcgtggtacgtcttaagcctgtacagctccttgaagtagtccgaggagaggatgttcactgacaggaccttctccaggagcacttcgggacttcaatgggcctcccagatgactgtatctccatcaccctctcggaaattaacaatcaatccatcaatccgtggaggagtctcctaaacctaattttaatctagagtataatctatggactaatttactattgaacatcttacatctccaagaatcagtatctcacggttcttagaaaagataaaattgtctaatcggaacaggatttcttaggaacaagggagagaaaagtgttcttcctttttagaatcaacatccaaactttcaccgtggaataggaagcttaccacttttttttctcgccaggatgcgaagcggcggccgggcgcacggagggacacggacggggctgccacttccatcgggcctggtgactggtgacaacggtgcttgagaaagaggagctagcgtttgaggtggtctggtccgatgggggccgcggacttcaagcgacagcgatcttggcggcgtcgaatcggacgatgcagcgcgaccgtgagagcgaggcgacggggttgcaagccttgcaggaggtttggcagagattcgcgtcgtgtgaggggatggggaggagactggggcggaggagaggtgcgcctctgctgccgtcggatgtaagtcattggataattttggatcgtttgatgtgtcacatgatggatgatgaatgagtaaaaccattcgttgaactataggatagaggtagatagactactacaactattaaaagcaccaaatttgaatttagaccaataactactttatttaaacccaatgattattcatatcaattaacaggcaattaagctacacgatttgtataggtgcttcaagatctttgcattatacattatagggtaacttctaagggcatgtacaaccaaccaacaaagctcgagtccaagctataaggagattccctgtgaaaacaatgaaaataatgtaataatcttaaatcataaggaaattgaagtgctaatctcaaatagaataaagaatgaaatccatataaaacaagttgtttgagaatccatcgtgtgttgcactgttgttttaacgcaacacaaacatattgaacagatgttgctgcaaacacttgttttgttttcagaagcaaatcaaacccaatggtctgttgcaatgctgctctactcttgttagatgtttttgttttcgatcaagttcatgtcttctgtaaacattcttgcatcctttgctacgtgtgtaattccagatcaatgcaacagtcatgtgttaacttccatttttggcggagagtcatgtgtttgctaccccttcccatatgttgtactcatgcacaagctaaggacgcgtttgatctgttgtggacaaaagagtgtcttacatacacatttttttttgagaattacacagtacaatacagacactcacagcgcacgcgcactcacccctatgaacgcacgcacgcaaaccctacccctatgagtatttttgtagactgggccggcaaatcctcgagaatgacaaagtcaccacaggcgtctcgctgtcgacgggcacgtcgcctaccactgaaagcacaacgccgttaaatcctggaaaattcgctcccatagggagtcgaacccaggacctcaggtgctattgaggcacttgtaacccctaggctacatgccctttcgcttagatacacatattttgaaactgttggactcatgcatttgctcatctatagaatggggatggaccaaatttgaatgaccaaaaataatttctaaggacggaagatactcatcaattgtgactgtaaaattagcaaaagcaactcattctaatgatacgaaattctcattcataatgcatgtttttttattgagaaaattcatagtgcgtgtcacaaatggttgcagaatcttatatataccacaatcaggcagggatgtgaagcataaaaaaacaaactatgctaccaatgtatacatttatcaattataggtcgtatgttttccggctgttaattacatgagataatggagtccaccaaattcaatcgtagtgtttacatcatggaaaggtagtcattgtcgagcacgttctggctactctagggataggcggcatggggcttctgcttgtccttgttgggcctgatagtgtcgccgttctggctgacaatgagttcagtgcgattaacatgggcgtcgatgacagcgaaccagacaatgagttcagtgcgattaacatgggcgtcgatgacagcggtggttcggacatcttcggctttgtacctgcttggcttgatggcatcatcgttcttatcgatgagatagcgtcggcagcggccgcgtaaggggcagcatgcttacactttgatgatgacagctattggtccgcattcgaattgcattcagaagctgcatgaggcggcagcatgacttttggttatgacgacagttagtagtccgcatcgaattgcattcatgagctgcatgaggcggcggcatgacatttggtttcaggaaggtgtcaaatagatttttctcttatgatcatggtcattgtactcagttgtgccagataaatctatattctattatataatgtcttaatcttttgaaaatttgatgccgctactacatcttactatgttctgtaaaaaaaattctgagaaaaaagcgaaacatcaccccttgatttcacttagtacagtagattcagtattttacaccactagatctattttctttatctttacatattataaaaattcaagatgtttttgcctgattttcgtacatcgttccgtgtcgccacctgcgcgtgacgatgggcctcatcggactttacttgggcttggagttacgtacatggattagattaggtttatttacagggacggaatacgggtgcaaattgttacagttgtagtatgatacagattatcgtatggagcaataacatgtttcatatatttcagcagtgggttgtgggagaggctgccggcagcaaggttaattttgaccgccttggtagcgagagagggttgcagctgccgacaaggatttgatagccgatgggctgaaaggagagctcagtccggtggaggaggtgggtgtcgatgctgtgctggggacaccgcccgacgcggggctgtggaggagcagctcacgggcgggagatgggggggcttagcctggcagtagaattaacgaagatggagagaagaaagagtcgatcgcgaggaggaagacaacagggaagtcgtccgatcgacatccgacggctgagattgccaaccgataataatctatctactactacttaaaaaataagaggtgcttccatcgtccgtcaaaaaaaccgggtgaaaaaaaaccgggcagaaaaaaccaagtttgtccgataaaaaaaccggacgaaaaaaaagtccgatccaaaaaaaagtgaaaaaaaaaccgggcgaaaaaaacacccgtccctggcaaaaaaacacccgatcccttaaaaagggaaaaaaaagtccgagagaaaaaccgtttaatgaataaaaaaagcgaaaaaaaaagagtccgattccctggagaaaaaaaatctgatttccctggaagagatccgatctgtatactactacttaaaaaataagaggtgcttccatcgtccgtcaaaaaaaccggatgaaaaaaaaccgggtagaaaaaaccaagtttataaaagaaaaggaaaaagctgaaaagaatctgactccatcgacgcggtaaaaaaaggcgaaaaaaaactttccgataaagaaaaaggaattatatgtgacgcggtaaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaccgtcgacgcggtaaaaaaagggcgaaaaaaatccaaagtaaaaggaattatatgtcacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagttgaaaataaaaatagaaaagatccttcgtggcgtgacggccgggttcgctgcatcgggcacattcggcgccgcagcagcccgcgtgcggcatgcaggaatggatgtaacaacacctatactcgccgtcagggaagcacgcccctgcggccttgcggtggccggtgccaagccgcctacaagctgtttcacaccggcccgcgactcagacgccaagacgaacaaccccatggtgtgtccggttcacgctaaaattgaaagtttggctgaaattggaacgatgtgacggaaaatttagaagaaaaattgaaagtttgtgtgtgtaaaaaagttttgatgtgatggaaaagttggaagtttaaaaaaaaaatttgcaactaaacacggcctcagtaactgaacgaattaactagagtagttcaataaccttaccttgctgatgcgatcgtacatgccttttgtattgtcaggaagcgtggatctccgacttctgagagaagaggagcggcgtgcgggcatggttggctcgatgatgccagaagttttttttttttttgggggtggctatgtttcctttttgtttttttccgtatcattttcaaggggcatggagtttctttatcacggatgaggtattgagatacgagtgggtgcgtagctgacaatacagacgatatccagtggcatgggcacccacatggaagatgattgggtgggttgaacttaacttcagtcttgtgtatttgtgaccgtttggagctagcctcgcgttggtactcatgtttattttattaattaattagaattacatgtttgagatggttattttagttaatataaagggagggcccactttacatcgtgggaaatcaattttagactatctcttgaaaatattagttttctcactttctatattcagtttaggagatctgaaaaaatagttttgggaattgattattataccactaaaatcgccagaaaactgctgtgctgtttatattccatttcatgattggaataaaacgtttgatatgaacagaaatgatagccatcatgatcggaaatttccgtaccttttactaaattgtatcttattcactaataatattgtgttagtaatgtatagtagttaatttaattttttatccattcaccgttgtcgcaacaattctctcatttacaacccgttgcaataaacgggcattttgctagtaactgaaaaaaccgaaaccccatctccccaaaatccactccaactgccctccctcatgggtctcctctcctcctcacgcaccctccctctcgtatcctatctttttgtccttccatccatcttatatagttcatccttatttaggtagtgcttaaatgattaatctatgatccaaattatctttctcctttttttctctaattaagttatatcacatcaattgcttttagcctttatatgattaatctatagggaaaatattcctccttgattgcatctttcttgtcttgtgcaaaacggcggagtcattgtttgatgggtttagcgtcttctttaacatttaaggagtgctcaatcaactctataggaataccaggcatatcagatggtttccactcaaaaatatctttattagcttgaagaaaggtgatgagcgcgctttcctatttacaatctaactcagcgcctattacagcagttttggaaggatcagatggatcgagagtgattttcttggtcttggtgttgatttctccggtctttgatatcttgggcgcaggcacttctccttcggttgcggttgatgcagccagtcggatctcatcccgagcgagtgtaatctcacgcgtctgggccatctcacagctttccttgtcgcaggtgacagcttgcttgatgtcgctccgcaaagatatgactcctcgaggtcctggcatcttcatcatcacgtaggtatagtgtgggactgccatgaatttggctaacgtcgggcgtccgagtatggcgtggtacgccgtctcaaaattagcaactttgaagcaaatattctatgtgcaaaagttctcctgagtgccgaaggtgacgggcagagtgatctgaccgagtggagtagaagacaaccctgggatgactccatgaaagggtgcactactcggcttcagctccgtgcgagggatctgcatatcgtccagttttggcaaaaagaatattgagtgcactaccaccatcaatgagggattgtcggagcttgacgttgcgaatcactgggtctagtactaggggataccgccacgggtggaccactcggtcaagatgatccgagcggtcaaacttgattgttgtctctgaccactgaaggtattgaggcgtgtcgggctggacggcgttgatctcctggtcagttagcttttgcttccgctttgattcgtaggcttggggtcctccgaaaatatggttgagttccttgcgagagtctagaaagccagtcggtccgtcatcttcattatccttcttttttgaagtgctttgctccccgtcagccggcttccatgctttcttggcgtattgctctgtgaactgctggtagatgatgcaatctttgaccgcatggtttgaattcgggtgatgcgagcactgagcattcatgatcttgtcgaaagtattgatgcacggtcgctgtcgagaagaaggtgctgtagtggccacaaggtcctcgggcttacgcttgcgatccttatggttgtacttccactcccctctgctgctggcgcatctttcttgggcttccaattgctacccgactgcttggacacgatgacggcatcatcggctttggcatactcattggctttttgaaacatctgcttgaccgtcctgggatgcttgcgtctgaatttgccgactaagagttcatgacgaacgcccatagtgaaagctgctatgatgatgttgtcggtaatgtcagagatcttattgcgttgttcagaaaaacatcggatataatcccaaagggattcaccgggcttctggatcacattgtagaggtcgaattgggtgccgggacggtcgaaggtgccttggaaattggtgatgaagtgcttgtgaagctctgccgaagatctaattgtaccatggggtaacatgtgaagctaggattgagcagaatctgctagagctaccggcaagtaatttgccatagccgtgctatctcctcctactgcgcaaattgcgagaccatatacggtgagccaagactcaggttttgttttgccgtcatacttctctatcctagtcggcttgaagccggccggccaatctactcgacgcaggtcgcttgtgaaagctgcaactctagcttcatcatcgtcgtagcggtctattgaacggcgtggaaggtagcctctttctgcgtggcgccgattgagtgtctcgtgaagatcgacgggctacctacgacgtggagagctaggctgttcggcacggcgctccctgtgcctgtcagcagacgaatgaacagatcgttcatcatggtccctgctcctgcgattggatcctgacgcggcgacgctaaggcttggttgatgataatcttgagatcggagaggcggaacccggctaccagtcggcgtgcggacgcttgcagagttaactgggacctaggcgacgatcatggtcttcatctggttgatgatgttgtggacatggttgggcgcgtctttatgaagcaaagtatccagaagagtgattgtcgctaacgcgttctgctgtggggtgcgaaagaccactgtgccttcaacgtcttgttgctcgatgagttcgcgtgcttgtcgcccagcctccagggtgtgttgtcgccggtcctcagcctcctttgcggcccgctcgcattcctgctgctgacgctgcaaccggtatcgctcttgtgcttgtcgttcctcttccagtcggtgacgctcagcttcctgtcgcatgcgttgttcttccgcttcacgggcttggcgctgttccgctgtctcattgtcggccatgaaaacgccgaagaagagaggcgtgtaattgtcttcatagcttttgtcgaaatcgtcgaggttgctaaagtcgtagttgtaaccgaagtcatcatagtcgaggatctccgttggtcaagagtcgacactaggagagatgaggtagccatccagctcttcggttgaaaccatccgagaggctgaagtatgatgccgactccctaaagctagattggatcggggccaaagccggatctcctctagacctacgggaagaggacgcccttgtggtgaagactgcagccagatcatcagggagcttcatcagaatcggaggatacgccgcatcatcttgatcaggtcgcgttggagtagatgggatctcatctgtgtggtttgaagccaactcagatgggatgatcttggagtagatctcaggccgagtttgggagaccgaatggtacagagaccgcatctctttccgacttgtttgaatccgagtcgaagagagagatcttgccgaagttgtcggtgacgaagtcaaggctgccgaaccgaaacatctgcccggaagggaagacgaagtcgtcgatgccggaaatgaatcccatcgcactaatcggcgagaagcttgacgcagcccctacctggcgcgccaactgtcgaaacaagatttcggcaatacaaaaagggggtggctatcaagcaggaaaagtggatgggtttggagacaagagatttatacaggttcaggccctctcaacgagaagtaataccctactcctgtccgaggattgatccgccgagtgtattatcgatcgtatgatctgggagaaaagttatgccccaagaggcacccgaacccctccttatatagtgggaggagcccgtattacaacatatagcccatattcttaacggaataggcaagtaaagataaagtacaatcgtaaccgactagtatcctaggtatttccttaatacataagttaggaatttaacctgagtcccctaaagatattctatctatatatggtacccccatacctagtcggatatatatgccgtgtgggtatggggtatccataatctccacactcgagcttatggatatcgtggtagctttcatccgaaagtattttggggtatccaattaacgagggatggaaatgcactttcccctaatcgattgtttggttttgagttttcaaaaatagtgggcatacttagcatctaactacctaaagtgctctaacaaaatgaattagaaaggtgaaggtgaagcttggttttgagttgtgaattagagggcttcacaactccacccctgattcaaatctaaatttaggagttagagctcaaccaaatggatctaaggtaagagatagattcatgaagaaattaacttaggagttagagctctaccaaatggatctaaggtaagagatagattcatgaagaaatggtccctttggtgtggtaactccggaactcactaatttctaggccttaacacttcacttactaattgcttttagtacaacatcaccacctcctaaagggatgaaaactaactgccttcaagtcggtgacaaaactagtccaaccgagctgattacaatggatgtgcagagttgtcatcacgtgccaccccgttgatctagctttccttgttagtaaaatgaaccttcttgtagatgacgcatactcttgcctaaactccagctcggcaacattcttatagagagcatcaacagcagcaggatgattgataatcgtatctattcattcgccaaactatcctccctaagagacaacattgagatgcctcatcatctgcaaataacttcagatcacgagcgcacatgtggcctagctcatactactgcagcaaagaagaggcttcacataaaaaagagagtcattgattaattcttccaaggatggaggacctgagtggccaagcaggaattctacgtcgttttccaacggcgtcttgctagctccacgacggtgttctccctgtgccttaaggcttaaactgatcagcatcgccttcaacgtcgtgcgcccggcgtgcccgccatcgtcgagcatcacctgcactgtccgtcctccagccgcgccgcagccaacaacgatagattttttttaatcagactattataataatgtgagatcatgttgtaaagatttgattacaatgaatataatggtataatcagattataaatggaattgatgatttagaaaaaaatcatttggaagattcataatatgcacgtcatcagcaagtgatcgatcgagctactagcctttacagtttccatcgcctacattcccacatcctctctcatgtctctgctggtgagtaggattgggcctaatcagatttcacgtcgatgggcgtccgatcgttcgtgcgctcgacatgatgcattgtcgaacctgcattgtcctccagttaccgccatataactcctaaagtatttcatggcagtggcggtctggggagaaatgctcgagggaattttgagcttcgcatgccaggtcatgaactccaatatcttacagaacctcagtgtggaggcatcctagtccgacattatcagatggcgtggggcttattcaagggcatgcccaccatgattcaagggtattcagacgtatatcaagaattatataaataaaaaaataagcatatatactatgtattacacgtatctatatatttttaactctactattataaaaattaaagatgtttttgtcaagattttgatacgtcatccatgtttgagtaggttttttaattatatctgtcgtggctcatgtgggaaccaacaagcttttaaacttagtccgactccaattttggtccatatgtccatcgtccgtatgtatcccgctcacgctcctgtccgtcttgccgatttttctttctttcatgtgcgttaaggattcagctttgtggagattatgggtaccccatacccacacggcatggttatccgagtagtgtagggggtaacttatatttatgaaatatgtaacagatcatgacttgggtattacgtttccttgtatattatggaacggactaaagttctggtttgataagattgtaaagtagatttaggaaaccgacaccgtgttggttaaggtttctatcttgtaatcctgccccccatcctatataaggtagcaggaggccctctaaggggcatgaggatataagatcgtcagatctatactatactcggcggattcaaatccccaaacaggagtatggtgttacctctcattgagagggcctgaacctgtctaaatcccatgtctccgcatccatccacttttaggtctcgtgcgctacccccttttattattgccgaattcatgtttcgatagttggcgcgccaggtaggggttgcgtcgagtttttcgtcgagaagtgcaatggaatcaatttgtctggagatgtgatgagatcgatctcaatgagttcgacggtttcaattttccactcgggtttgccgttccaatcaaacttttatcagattagtttttcattactatttgatctcttgatactttctggttctttatatgcaactatgagatcaaggctaagcggtcggtgacctcgcccatccggccgctgatccgaacaccgtcacgtggtccagcagttgtccctgcacgcggagcagtgctgaacatcaagctgtcatcggctacagggggttatacacgctgcatggcgcgtcgtcggctgtcactcatgattcagcctcattgctcgatccgagtttttcgtttcctatccatatatattatatttatttctaattgcagattgatctgttctagcactactttttttttacagtaccgtcgatgccaagtgatagcttatttttgggcagtactcgtgcgtactccacctcggctatggaggctcaacggccacgtcatcaagttgttacaagttgtacatgtatatatgcacaaatatatatatatgcttgggctagcatacgaacacatggatctgcatctggagtacatgtactccctaatggcggttgtttatctaatcgccttcgtcgttatcgactggtgttctcgccttcatggttggttggtcacaccaccattgatgggcgtctacgtcttcaccgatcggccgcctcgtctgctgccgactggtgtctccggctacatggctggtctattataccactgttgttgggcgtctactacttcaccgccggcctgcctccgtcgccaccgactggtgtccttgcctatacggttggttggtcacaccaccgttcatgggcgtcaacgtcttcaccgactagcttgcctttgccgccgtcgactggtgtctccgcctacacagctggcctattatgccgccgttgttgggcgtctacgacttcaccgctagcctacctccgttgccgccgaccggtgtcctcgcctatacggttggttggtcacaccaccgttcatgggcgtctacatcttcaccgactggcctgccttcgtcaccgccgactggtgctttcgcctatacggcatctacacctttactgtcggccgccgtcatcagcgccgattggtttcttcgcctccatggttggtgtactccgccgccgttgctgatggcgaccatgtcttcactaccggctgcagtcatcgccgccgactggtgttttcatcaccattgatagactattttgtttccccatcggtcacctctatcgccaccgagggaaataaaaaaaaagctaagtcatcaataattttctttatatgatattttccttttcctctgcctcactacatcaactggttcgccattgactagtgagtcgggggctacagatgttatatcatatttttttcaacacttttcataatatttatcttgattgctcgcgacataatctgagtacaaaagtgcctatcgaattatggagtttcatcttcctttgctttccgtttggtttgccaatggatagttgcttttgggctgattcctagcacccgggggctcgttggatggactgaataacacaaggtgctaagtattactcggaataaatcaaaagcatagagataagataatttattttctgctcttaacaattgcaagagtacctgagtagtaaacttcgatccgtgaaactttgttccattaatgacgaactcatgtcactcgtatgcatatttgggagatgcttgggggctatgactagtcggacagagtgtttaaacgtacggagtcatctgctcggggaaatcgaaattgacaagaggagaaatacatatttataaacattttaaaatacttgaaatttcctcgagtattatatttacatcagatactactcatcccatatgtttgttctgtaggattcagatccagatatgcataaaagagattcatggctttaaacttatctcttacgctccaggaatggatcagtcagaacatcatcaaccggcttgccttcgccgccgccgactggtgttttcgcctatacggttggttggtcacaccaccattgttgggcgtctacgtcttcgccaccggtttgccttcgccgccgccgactagtgtctctgcctgcacggctggcctattatgccgccgttgttgggtggctacgtcttcaccgactggttgcctcgctgccgccgactggtatcttcgcctatacggttggcctattatgccgtcattgttgggtgtctacgtcttcaccgatcggcttgccttcaccgccgccgactggtgtctccgcctgcacggctggcctattatgccaccgttgttgggtgtctatgtcttcaccgatcggcttgccttcgccgccgctgactggtatctccgcctgcacggctggcctattatgccaccattgttgggtgtctacgtcttcaccgacaggcttgccttcgtcgccgccgactggtgtctccgcctgcacggctggcctattatgccgccgttgttgggcgtctacgtcttcaccactggctcgccttcgccgccatcgactagtgtctccgcctgcatggctggtttattatgccgccgttgtaggacgtctacatcttcaccggccggccgcctcgtatgacgccaactggtgctatcgtcttcacggctggccacgtcgccgccactgtaaataggcgtcatcaccttcaacacaagctgtctacgtctgctgccgactggtttcttcacttccatggctgcatgattctgccagtgttgattggccttatcgtcttcaccaccggtcatctcgtctgctgttgactagtgccctcgcctctacggctggtttatactgctaccactactgatggacgtcatcgttttcattgctggccgccttgtctgacgccgactggcatgttcacctccacggctgcacgtcttcgtcatcattgactgacgtcatcatcatcgccggtttgccttcggcaccacccatggtgtcttcattttcatggctggcctattttgccgctgttaaagaacattttcgttttcatcatcattctacttcttccgtcgccgactggttatgccgccgccaactggtgtttttatcttcacaactacttgtcttcgccaccggtttgcttctgttgccgctgactcgtgctaacgtcattacggctatgcaactttgtcaccatggtggagctatttcatcttcattgtcttcggcaccggcaaattctattgcctctacttttggtgttccagtattcaagatttctactcgggcatctttaatatgtatcttcactcaagtaatgagtactcgacgacaagaggttacagtttttgactctatgttcagttgttttctaactaaccaaagagttagcggctacgcaaatacaaggctcaaaaattcgatcaaccaggagattaatcagcgatcgaatcgatctacaaccaggcttgttctcgtcatttttactctatcagtgagatcaaatgcatcgccgccatgctgccatgtttgttggtccatcggtttcgtcaccaaggcaagatttaaagcaatcagcaagtagttgccgtcgaaatgatgcaaatatcaccgtcggccgagcctgtatatcaccaaggcaattctatttggatacttatggcaagacaagaagtccaggattcaaattaaatatacctggtcaaacttgtggtcaaggaaattaatccatacacaaatcagatattacatacacaaatcggtttccaaactaatccatgcatgtgctagtgtgctaccaagaccccgtgtcagactcggctgaacgtgctccagaatctggccatgtgcatctcctgtttgatcactttggcttgtgccacgtacatagaaaatcagcaattaacacttataatcagaaggttgaccaggactgtgcatgtaaaattgacaatatacggtcatcaaggtcaccgatcatcaccagcatctgtcatcgtcatcagctggtttctacgcctccacaatcggtggatcccgccgccgtcattgatggcgacatcgtcttcatcttcaccaccggccgcctcgtttgccgctgatatcttcatcttcaccaccggccgcctcgtctgccgctgttgccgactagtgttctcgcttatacggttggtgaactccgccgccgttgatggacatttttatcatcaccgctggtctacctgcgtcgctgccgaccggtgtctctgccttcacggtttcaactctgggagtcattatcttcgtcttcgctttagagcttgtgttctacttcagcaactctaattatttcaccggcaattttagcttctccaagtttctcaagtatcaagtccaagattaaatctacatgacctgtcagggagtttggagttatcaaccaattagctcagtttcgatgtgttggacaacagtttctactttccttcagcacctctacttcattggccctgacatctccaccgttgctaagggatgactacgtccttgccgtcggttgcttttgtcatcaccgactttcatcgctgacttgttatttcgtcttcacggttggcctactacgcaactgctgagagaggacctcatcgtaatcatggttctactttctatgcttgaagactggatcaatcattattccccgtaaaagctatcaaccgaatagttgcgccagtcgggattcgattttatatctattttggagtatcccataagggataatcactcagatcagaagctattcatatgagctacacttggtctatatcacccggaagatttattactcgggagcatgttacatgcgtcatcctttaaagggtgccgaaggcatattttttggcctaggcctaatatgtctgcagcccatattttcaggtgtggcctgtcacattcttttagggacttaggcactttttgcttaggccaaagtgcgcgtgatcaagtgcccaataccttaaaatccttttattccgcagttactcaactttttaggagttggtacaatgcattttaaaaggtgcctaatagtgatgtttttcatagctgccccgctgacttttttatatagtcaaggcgttgtttgggtttataaagcaattgattggatacaatatcgttgatttttgctacgtaagtgtgtgtttttgttgaccaatattatggcttaggctgattatatactgtggtcattttccaggtggttggtaaatcctttatgagtttatttactcggattttataccacatatgccatatatttctaggtgtggtgaaaccatgtgtcttttagggacttaagcacatctgttaaagcagtgtgcgcacgatgtgtgcccaatactttggaaatttctttactcacagcatataagcttctttatagctattttgctatgtgaatttcaatgatgtagtcaactttacaaagcaaacggtatatcacttggatcatattattcagggattcacaccacatatgctatatattaatattaagtcactcggttgactacaattattaaaaccactcatttggttagattatttactccttgactatatgtttagtttgttcaactatccacatagtcgggggctacacctaataggtgcatctagtcgatgcacctaagactacattcaattatttttcagccctccacagtcttcagatttggtaaaagtactcgagagatcatggcaaagatgattgaagcacttggctttggagtaatctagttcgagagaagattatctttttgactgtgaaggtctcaggggctactgtggagattatgggcaccccatacccatacggcatggttatccgactggtgtagggggtaacttatatttatgaaatatgtagcagatcatgacttgggtattacgtttccttgtatattatgaaacggactaaagttctggtttgataaaattgtaaagtagatttaggaaaccgacaccgtattggttaaggtttctatcttataatcctaccccccatcctatataaggtgggcaggaggccctctagggggcatgaggacataagatcgtcatatctatactacacccggcggattcaaatccccaaacaggagtaagggtgttatctctcattgagagggcctgaatctgtctaaatcccttgtctccgcatccatcaacttttagatctcgtgcgctacccccttttattattgccgaattcatgtttcgacaagcttcatgtcagtatcccttcatgcatgcgtccccacaaatcaaccagatatggatcaaagactaatatgcgatatgttgatcatcttagcggcacgctcagcttctgttcttatttcctttgtgcttgctgttctaatcctttaaattttggcttaagctttttcaacgtcagtgcatattttgattgattacagcatatcataggtgcgaacgttttgattttgttttcttttccatattcaagtagagatttgagtgggttgggtttgagtgtccttttgagatcgtgtccatgtgcgactaattaaaagtctgtgtcaaggtccggtctcaattattttgcatcacggtgttgtgaaaatagaaatcacgcgacaaacgtttagcaaaatcgatacacaacagaatatatgcaggtttttgtgccgaagtgcttatcaccaatcattttaggatcgcatgaaatggctacaactatcaaaccatcgtctccatgtaacgagagagtaatgctataccacttttcatgctcagtccagtcttttttttatctaaattaaatagctaattatgttgtctagcaaattacaattgtcttcgttttcttttcaatttgactttgccatgtactattcataggtgataaggatggctagatctcatcccagtggactaccacattgcttgttaaatagatttttctattatgaccgcggtcatcgtgctctcactggtgcgaattaaatcaatattctatcctgtaatgctttgccttttttcaattatgttgtccatcctgaactcagtatgggaggaggtattttggatatactctcgttgttttgcgtgtcacagcaaaatttatcaaagtaagatggatcaaaatgcgaaatatcacttcacaaacatgcatgtaaggcgcggtttgacacggctctagctcccaactctaacttacctagagctggagttgtgctaaatggtacagattctctattttttttagcagaattgatagagctgctccataaatttatactatggggtagagctattttctgcagctccactccactccaaaagacccactaccatttcatttttaatatatttacacaaaaaatgccactgaacaaccccttcacacctcctctcctattctctctctcagtcctcccaatcgacctagggcggcgaccggcagcccgactgcagcggcggcccgtaggttggctgcggtgaccggcgatgcgtagcctggcggccgtgacacgcggcctggtggtgacgcacgggctggctgcgacaaccggcgatgcgcagcctgggcggccgcgcgggggctggcagcggtgactggaggtgcgcgggttggctgcgacgcgcggactgggcggcatcccgcgcgggctgggcggcattgacagcggtggatacaggcggcgggcgaaagtggcgcgggctaggtggtggcggcgcaggtaggcggcgcatggggtgaccagcaacgttggcgcgacaaggaacacggtggtgtggagctaacaagtcagccaaacactttcaaactcacctcggctcctattggggctagctctcactggagttggagtttagagttcagagttggagtttggagctctaccaaacggggcctaagtataaatataatatacacaagtcaaaataaaaataagaaatatgattgtgcatagtgtgcattattgacaaaaacaatgggacattccctcaaggggaaaagactttcacataattctcctattgggattcaatgtatcatcgtcgatttgacgcagtctaggatgaccaaactattgggataggaacgatacggcaccgagttggacggttcgggtttctatcacattcatgttttttataaatgacatttcatcctctgctacatatgcaattccaaatcaatgcaatagtcatgtgtcaacttctttcttttgatctggtggagagtcgtgcgttttctaaccctttccgcatgttgtactcatgcacaatgaagcatttgatctgtttttgaccagagagggtcttggatacatattttaaaaccgttgaactcatgcaatggctcatttacagaaggtcaattgaccagtgtttgaatcatcaaaaattatttatataagtgcagaagatacttatcaattgtgactgtaaagttagcaaaaggcaactcataccaatgatatgaaattttcattcataatgcatttttttcttcaaaaaattcatagtgcatgttagaaatggtaatagtatcttatatataccacaattagccagggatgtgaagcatcaaaaaagaaactatgctatcaatgtatacatttgtcagttatgggtcatatgttttctgccaagttaattacctgaggtattggagtctaccaaattcaatcgtagtgttttcaacacggacatgttgtcattatagagcttgttctgcgtactttagggatcggtgacatggtgcttttccttgtccttgttgggcctgatcgtgtcgtcgttctgactgacaatgagctcagtacggttcacatgtgggctgatgacagcggtggttcggacctcttcggctttggacctgcttggcctaatggcatcatcgttcttatagatgagatagcgctagcagcagccgcgtaacgggtggaatgcttacacctcgatgatgacatccagttgtccacattcgaattgcatttggcagctgcattaggcattggcaatctacatgtcctttagtttggggaaagtgtcaaatattttttccgatatgatcacgtcattgtactcagtagtgccaaataaatcaaatattctatcacataatgacttactcttttggagctttgatgccgctaccatatcttactatgttttgtaatgtaattgatcatacttggtctattcgggtctaattcacgtaatccttgtagtattaagtattataagatcgttaaacaagacatcttcattattagctattatgtatgcacaaaaccactaatgcatggtatgatgccgggaacacaaatgatttccaatgtcttaatccaggctggcaaattttcaccataaactacgaaattggttgtttgtcaaccccctcaactctcaagaacagagacaaataacactataagacatatttttactagttgtttcagatgaagctggttttctgagtctgtacatacctttatcatgaattttgctaatgtagaagcctccacaacaatgaaacttacctaattaaagttcatgtcaacataaaaacaccacatgtgatatgttgattcaaaaccatcaataaactttgagaagtttatggctttgacatggatagtagaaaaaaaaagaagtacatcattgagaaccataggatcattctcatccaaaaaagaatatcgcaagttactactactactactattattattaaaggcaccaaatttgaatttaaaccaataactacataatttaaacccaatgattactcatatcaattaacaggcaattaagctgcacaatttgtataggtggttcaaaatccttgcattatacattatagggcaattaagctacacaatttgtataggtgcttcaatttaagggcatgtacaaccagccaacaaagcttccatcctctcaaacactcgttttgtttttagaagcaaatcaaaccccatggttctgatttctatcacattcatgtcttctgtaaacattcttcttcctttgcaacgggttgaatttcatatcaatgcagcagtcatgtgttaacttccatttttgctggagagtcatgcgtttgctaacccttcccatatgctgtactcatgcacaagctaaggaagtgtttgatatgttgttgacaaaagagtgtcttggatacacatttaaaactgttggactcatgcttttgctcattacagaatggggattgaccactatttgaatgataaaaacaatttctaagggcagaatatactcatcaactgtgacagtaaaactggcaagggaattcataccaatgatatgaaaatcccgttcaaaatgcatgttggaaagggtagtagaatttttcacatggaaattagtcatggatgtgaagcattaaaaaaaaaagaaactttgagcatgcaaagggtagtagaatttttcacatggaaattggccaactaaatttgcatgtgactattattcttcatagtggacaatcaagaatttttcaagaaatcttcaacgcacagaacgcaaagcaacttagtggaacttcgatttggttgattaattctgctctgtttcgctactgattttacagagtatgaaaccacaagtacttcctgtcaagtttttcagccaatggcatccctctctcagcaacattaatattttctgtccaagcgtaaacagttctacattggaaataatgaaattgacgcacatataaatctaaataaaaaaaccgtaatatcaaataaatagaaggggtgaggctttaaacccaggccgacaagcccaccaccttatagagctagccgaaacatccctagtcatttctcgcatataagtctaaataaatatccaatgaaattatactaatcatgaacaccaacaaagaatgctgcaacgtgcagcaggacgatcaacgcgttccccaattatcttcgacacttcttgtgtgataattggggaacgcgccgatcgtcatgctgtacgatgcactccgtcaagtttgtcacagccggaaggaacggcatcgccgcccgttcggacacatctgtccagaggcggcggcgcacggatcacggctggcgtcgccgccgccgcgatccccacgcggcggctggttcttcaccgtagcgagttttgtccgcgcggcgccttgcaagctccacggctgcgttctccctctgccttagactgacaagcatcgccgccaacgtcgtgcggccggcgcgccccccaccgccgtcgtcgagcgccacctgcactgtcctccagccgccgccgtagagctcctcgaggatctcatggcagtcgctgctcgggaagagatccttgagggcgccatgcgggtgtggctctctcctctccagctcctcagaaaaacctcatggtggtcaccagcttcgagtaccacgcgatgaactccagggtcttcctaaacgtccgcgcggcgtcgtgcgggttgtcggtggtggtgacttgccagcacgcgtcgctctcctcgccgtcgtcgagggggtgtcgtgtcatgctgttgatgtctgcggccaggggcttcttggccgcacggctcggcaacacggcgccgtcgtcatcgtcgtcgtcgtcgccgccgccgtcgagcgcgctcttgctggtctgggggtcggcagcgcggggcttcttcttgggcctgacggcgtcgctgttcttgttcacatggaggtcgacgtggttgatttggaggtcgaagatggcggcggtgaggagctgcgtggctctggccttgctcggcctggtggcgtcgccgttctgattgatgtcgacggcggcggcgcacttcgacgacgacgacgacggccggtgtcccacatccggctcgccgtcggctgcggcatgtggcggcggctggtgcttcggtcgagggaagaattcatcgatgccatggagcaggtaggggtgttccgcggcgaggacttcctccaaccgggcgtagacctgatgcgcgtccagccctttgtccttgttcacgtcgtggattacgtgttcgaccctgtcgtgaagctcgacgccgcctacgatcttcaggctcgccaagaactgctcggccttggacaccttcgctcgtcgctcggcggcggcggagctctccgccacggcggcatcgtccgggcggcgccgctgtgcgtcgctcctccgacgcgtccttgccgccgccgctgctgctgcatgatcgccatcgtcgtcgtcggcggcgggtacgagctcgaccctgttgcggggataaataaccgcgttgatctcggcgacgagatcagggtggccacggaggagctccgccgtgcggcggagcaccggcgcggcgggggcggcggggtctctgccgtacgccgtgagcacatcgcagagctcgacttacacggccggcctccgccggaaccgggccttaacattgccgaggaatgccaccgcaccggcggcgcgggattggacgtcctggaactccggtggctgcgccatggcggacagtctgagagagagttgagacggtggtggtagtcaagacgttgttgacgctggcgatggttagtctgtcgaggtattgtaagggaagatgcggtatagaaatgaatccgagtcggagttgattctccgttctttcgtgttggtgtgcgtcccaatttcctcttcctggatttatttctacctctctttttgctggcccaaagcgaacagcacattgctcttccacatgcaaactgagaaaatagacatttggacaggtttgaaaagcgattttgctagaacaccatcccaaaaacgcgtttttgttaaaaatgccaatacggagagcgcgccgtcactttgccattttagggtgtgtttagttctttaggtgtaaaaactttgaagtatacagatacacatttgaagtattaaacgtagactaataacaaaacaaattatagattccgcttgtaaattgcgagataaatttattaagcctaattaatccgtcattaggaaatgtttactgtagcatcacattgtccaatcatggcataattagactcaaaagattcctctcacaatttacatacaaactgtgtaattgattttttttattttcttacatttaatgctccatacatatgtccaaatatttgatgtgacctttttggccaaaaatttttggatctaaataaggccttagccttttgtatattttcaaaataattttcgttagaataccgggtgatgagacggaattgcctctgctcgccgggtgaaaggagatcgatgcgaggccatctataggcccgaggggcgcggctgggttaggacggcgcgacaatcctcagcgacagcaaggacaagatggtcagcgaggatggcgacgcagcttcctactgatcaggatcaagtgcagtgcccacgctgtccacatcctcccgggcatacacgcgcccaagcggagccccatcgccttcaccgtcggcgacggcctctacgtcatggaggcggcgtcaccagagccactgccgatgtgctgggcggagcactgcttcgaagcactcatccactgcctcccgcccgcgccgccgccatcgaggactggaaccggcgctccctcccagcggtgcacaaccccagagacgacaggcccgccgcatcgccgcgcacgcggtggtcggtgactcccaaatttgggtgtccacggagcggcatagcatgttctccttcgacacggcgagcgatgcatggcccaacttcggtgactgggtgctcccgttccgcggccgcattgagcacgtcccggtggacaacctctcgttcggcttctcaccccacgacgacggccacctccgcgcctccgacctcactgccacgcccccattgctgccaccgcacaaggtttgtccagccccggtggcgtcctacctcatcccgctcggtagcagcatgcctcgaagacgacgacctagcactggcgattcaaggccgccgcggaggaagatgaggaggagacggaggtgagggagcggttcgcggtggtgaccggcatggaggtggaggcgttggggagcatgagcatcaaggctgtacgcatggcgagcatgcgcaattccgtctcatcacctggcattccagcgaaaatgatttcaaaaatacacaaaacggtcaaaatggcaaaatagcagttggtgcacgcttcatattagcattttaatgaaatgcattttcggaatagcatttcagtaaaaccgttttttttatcgtggccaaattaccattttctcgtgctttctggcgcgcatcacatcgcacgccatatccgatctttgtttctcttttgtcttccctagcgcctcagttgaagaatactgaaaacttaagactgtctagcctttaaattcctatgtccacaaaccaaaccatacttaaaacatggaaatgctaagcggtcttaagcctcagtccaagatttcttaaaactcctacgtctataaatccatatatatatatatagatctatgattacatagataacatttcgataaatcatttattttatattttctatataaaatttaaaattttaatccactataatttaatatacaaacttcgaatccaccatatatctgagacctgtacctatgtcaaataggccattattctctcaacaatattgtagtaggagtggagtccataacaactagtgttctcaatctcacccgaacgaccatccgcaagaaaaaatacaatataacaaagcaaaactcaccagataatgctttgggtcaggaacctgatcccaatcataaaatcgggtggtctccttcttactgctttgtttcatgcttgtatgttacgtaacttcttacttgcacgtgctattagaattataagtacatattttttttcttatctaattgttctctcttttaaccccatgcatgcaataaccttattattttttctaaattattttttcttctaaattatttatctgatctacaattcgattgtaccaataatttcttacagttaaatctttacaacaaaaccgcacatgattatatattccgacaaaaaaaagttaggtttttaatggatttgtttaaatatcgcaagtgcttcatttaattgtttcggttagtattttacgttgtttccttagttgatttgcaaatgtaccacattgtgttcttcgaaagtaatgttggttgcatgatataaaatgtttaagcagcatcaagtagttgcaaaaatattttttatttcatatgatgtttttcgatgtttcactcattggattcaatatttcatatattggttgttgatgttgtagtcagtattttttagtgttgcgtttctctgaaatattttataaagtgagtcgatacaattttctacaagtagtgaaacaatgtttaagttttcgtcaaaatataataaagtgtgataacaaaccaatacgccgccatatatcgacgtcagagataagcctagacataccccattcggtgcctgcgaaggccggcaagagggatctagtgccatctctgatctcgacgagtccgtattcgaggaggaagactaccttgtcgtcgactgcgagttggttatctagccgccaagtcgatgatagctagataggttatctcatatattgtatttgtgtgatccagatgaataaagagcaacaccggcttcggccaacaagatgtagggctattacctgtcagataaggggcccgaacctatataaaaatttatgtctccatctcttttacctcaatctcgcatataccctggtaccaacgatcctcatactatccaaataccatagtcgcgatctcaaacgtcgacacacatcatatcttcaatcatcggttgtaatggcaacaatttcaacttcaatatcttgtaccatcggcttgtaccctaacgccccctgagccaaatcattagcttcaacattctgctcccgagagacatgcctcaaagttaccaaccaaaaactattcatta

SEQ ID NO: 9891 - DNA, 4246 bp, Oryza sativa
agaactgcttcatactcagcctgattattagttgcatagggtttaatagtataagcaaactcaaaacttgctcccctaggtgatattataaccaagccgatgccacaaccatgagtgcaaactgatccatcaaaaaatgatgtccaaggcactaactcaaccgagccgattgaatcatctcgatgttcaacaataaaatcggctatggcctgccccttgactgctttaggtgattcatatctaagatcaaattctgtcaaagcatatatccacttcccaactatccctttcaaaactggagccgataacatatatttgactacatcggctgcacactatagtgcactcgttggataacaaataatgccttaactttgtgcaagaaaaatataaacataaacacaacttctccaccggagaataccttgtttctgcatccaagagcctgtgactaaaatagaaaatagctctctccttgccttccaactcctagagtaaaccgagccgattgacttctcatcggctgataaatacaacctgaaaggcactcctttctgtggaggattaaaactggaggggaacttaaatattccttaatattatccaaagccctctgttgttctgccccccaagtgaattcttgatcggctttcaatctgagtaaaggtgtaaaaggctctaaccttccagacaaattagatataaaccttctaacaaaattaaccttgccaatcaacgactgtagctgtttcttgtcctctggaggtatattagaaacaggctgctggttgtcggtcaccaaattcctatattagggaaacacaccttcaggaagaaacaccgagcccttagcttgatgctcagcaatcgtaccatcaaccacagacttgatcatatttgtcaaagtattgacaagcactcctgattggttgatcaaagcatgatagacagcatagtcaatcttctccctctgatttgtcatctttgggctcatcatctttatctttatcacctttagccttgccatctttagatgtgcctgtctctgaaccatcattgggaacttttagcttatacctctagataactgtgcatgaacgagtttgtttgaatgaatgcaggtactgagtctttaaactgttcatcatctgttcgtattctaacatctgttctggtgtcagcttatccagtgttattgggatgatgttttcgggggcaggatcagacggtggtttagaagtctgcttaccgtccaccatgacgaaaaatcgttacaactcgtgtcccactaggcgtgccaaaagcgtgttgatgcgaaaaaacacacactggcctgggagatctgcttaactccagtgcaggtcctaaatcttgctcttgggttcaaaggcatgccagttgatttgatcctgcaatcaacaagaaagaaagacaaggaaaccgaggttaaatccataaacaatagccgatcggctagaagccgatgacatatcgtcaatcattaagccgatgttattggcattagatcggcaatgaagaataaagtaatataaagctaaatctactccgataccactctatattaagatatcaaaacagacagaatatatcaaacagaaggcccaatatatttttgatgcaataagatcttaatataaagggcggacttagcatggcaagcaagcatacaagatataaaatagctaaatcaggtaagattggctgaaaccctgatactatctctatcaataatcataaaacaggctagatattgcagttatgaatattacttaatagatcaaagtcaaccgatgcagcattaagcataagaataaatacaagatctaaactagatgatgaaaacctcaaagagatggtagatatgctatataatctagattaacaatgatatctaactctatcgactactttctactgatagatactagccgattgcaggttagattgtgaaactaataaagattatgaagcatatatgataactcgacgatttacataaacaagattagagtatcataacgatggaagcactaatcccgataacgcaagccgccatgacaagtttacctcttgatgaagattgaaatcgatgcagctcaacccgaaagaaagaactcgtcgaaacaatgaaagtagaaaaagggtggcgatgcgccgaaagtgttattgaactgtcgttgttaaattacataggatcgggttatatttatacccgagatacatgacgggtccttgtcggacacgactcttatctctaacaaacttctaagatacgaacgagtttttacagcaaactcttgtcgagacatatctctaaagaaactatttaaaatatcctaattaatagatacaattgcctatctgagagcttatctccatcgtggcaattctcatgtagcacgttgatcgatcccagaaacggttctataaccatctcaacaaaatcggctacatcggctatatcggctatcttctgtccgatccatctcagccgatgccctcgcagccggtgtgtactctgttatttgaatacaattttcaccgaatccactttgattccgatgttgaatctggttcatggtttaccaaaattggtcgttaatagagcctcaggggagtaataattcattgataagggaagtttgggggactatcgtaatactcagagggtaattcggactataacgttagtattaatactggatcaaatatagtaaaatccctgaaaagccccaaggaccaattaggcaagggcaaggccgtgccattggataaaaaaaattataggcggtgctgtactgcacggattgaaaagagcactgagtaaccaaaattttgacaagaactagttttcaacccatgcacgggctatatttgaatgcaaaaagagaaaaaaagtacaaatgctataacattgtactccgggctatattggtgtactaatttggatagaacaaaagtctatctttgagtaccagcacgtcctccgtgcattacactatactccgggttatactggagtaattatgaaggtaaccttttaaaaaaaataaagcgggtaaagtatatacaagtttaaaaaaattatgattttggatttcagatttgtgtaaaaaaatcaaaacttatatttttatttcttctatatcatccatgtaatactcaaaccttaattttatacgattactatgtgtatacattgctatagatcatataccctactttacagcttactagagaatcggcgcacgcccaataatttataacctgttaatcttgtttaattggtttttaaatatatatttgaaatgttgatgaacaaaagaaacagtggactggggggattatttcaggttttatattgaaattttttagtaaggtgatgaagtcgttggtatatgactctgtccaccatggttaaaatcctactagatacttaaatatgaattatcactaatactagaaaagagcacttcatatcaatgggatgaaaatctcatttagaatgcatgtttgaaatggtagtgttgcactgaaaaggatagcactatatatatgcactaattagggacggatgtgaagcatctacaagaaactatataggctactaaaagatcattatttatagatcttgtctttttcagccaagttaattatctgagatattgaagtccaccaaattagatcttagtgtttttatcatatctgacattgtagaaggttaacatagacagctgggcagctagccacggttataaactacttcaccatactatttgaacatttttcttcctcccaacaacgcggtatcaccatactatttgagcatttctcttcctcctagcaacgggatcatactatttgagcatttctcttcctcctagcaacgggatcagatgaattagtaccatactggttccacaatgttaggatacaatttgaaaacattaagcatggatctcacaatgttatggtacaacttgaaaaattaagcatggatacatgcgcgtacttataggtagcgattctgcgctaaaagcatctgcaatgtaggaatgtaggaattaagaggtgtactaagagaatctttccactatagcaaaggttttatacataaccatacaactgcacggtttgttaaagtgaaaccggcgaaaaccttacacagaagacacaaaaagcctgaggcaaaacaactacgaattgcagatgatggagggaagag

SEQ ID NO: 9892 - DNA, 8609 bp, Oryza sativa
  unsure (1)..(8609): unsure at all n locations
aagacaggacaccaagacatcggtgtcaaccatgtttccggcgtggaactctgggcttcgcaggaccaatcccaaagcaaactatggcgaccacctgcaacttcaccaccagcacaaagagaggagcgctgggaggagggggagaagggacggtctccccaacagcttgtgccgagaggcagcatagataggaagagaaagaagaggaggtagagagaaaggaagggaggaagggtggtcagaggggtcaggggtgcttgaggggggcagcgagccgatgcacacccctagcaggtcgatgcaccgccgacccagagccggttaccgccgcccgccatctcacgagcggcctcgcgccatgacatgccgccaacccgtcgcactggcgcctcgcgagcgccggccgaaccgcctccgcaacgcacttcccgacactgccgttgtagatccggcagcggaggggccggatctgctgctgcccaacctgaaggcctcgccacagccggcgaaccgcgcatcccctgcactgagaagcggcgccgccgcaagaaggccccttctgtcatgtttttgaaggagttctgttatgcatctgtattacatagtctgaaacaaagcacacttgtaaagttgttaggctaatgccgttccacgctcagcaacaagattcttgtctaaaccataattagatcgccctggaaacaatgaaatctatgtactaaactaccaatctcaaaaaaatagaatgatattcatgtactaaaatcgatcaggacaaagaatgaaatcaatgtacaacaagttgttggggaaatccgtcgtgtgttgcactgtatagctaattcttttaaagcaaaacagccattcaatagatgctgttgtaaacactcattttgatttgaaaagcacagtaaatgaaaaaaaatggatggtcgactgttgcaatgttgcaacgctcttgttatgtcttctataaattaacttcattgcatcctatatattctctgtgtgcaataccagatcaatgcaatagtcatgtgttaactttcttttcatctcttcttttttcttttgcggagagtcatgcattagctaactgtttggatgtactctactcatgcacaaggaagcgtttgttccgttgttgaacagagagagagtccgggatacacattgtgaagtcactgggctcatgcacttgcacgcttaaaaaaggtggatagaacactatttggatcaccaaaaaaaattataaggcgcaaacctacaagatacttatgcattgtgatagtaataccagcaaaaaagtaattcatatcaatgagatgaaaatctcattcaaaatgcatgttggaaatggtagcgttaccgttatggcactgcaacacagggcagcattatatatacaccccaattagggaaggatgtgacgcatctacaacaaactgtatatagctgctaatgtgaacattcattatttatggatcatatttggtaatatgatccatgtgaaaacaccatgagatattatttatggaacatataaaaacgctacattggagttcaccaaattagatcatagtgtttttatcatatccgagatatcgatatgatatacttagtaagaacgatgttggacagacacaagcatatatcacgacattccttgatcatgttaagtggttgtgtaattctcgaaaatgagatcatgctgattgcagaggagctccgtcaacggaataattaactatttgccactcttacaagtggttctaaaggatttactattgaacccacatatcatagacatgagaacccacacatcatagacaacaagtgacaaattctaaattaccatatcttaaaagtggtatataaggtggtatatagtttaaatgtccctccatcaagagacgcacaccacaatagtgaaatatgtgaccgggtctttaccgaagtctttgtggacatcacttagcttgtttgaggacgtcacatagatcatcatagacggccagcctttactggaagcggacctcactttccgcatgacacagcagcgccgacaaggcctttgcatactcttaaaaaagaaaagactttaatatgttttactttctaaatttatttcttgtttcttttattccttaattgtgaggaatggagtctaaataggttgtaatgtttgcctgtgcatatccatgtatggatatagaaaccggatttttatctattataaaaaaatactccatccctagctttcgtatttatttctggtaacttttttttctattttctgctcttacttcctttctttcctcctcccttgcatgtgtcttcattcgtcatcttttattgctgtgttttgtttgtctcaactcaaaccaaatacaccctccgtttcaaaatatgtgacgccgttgattttttaaaatatgtttgaccattcatcttattcaaaaaatttaagtaattactaattatttttatatcatttgattcattgttaaatgtacctatatttatacatataattttacatatttcacaaaagtttttgaataggcaaaatttgctacaagacattcaaaaaacgtgtaattcgctagaggacatcgaaagaatgtgtatttgctgtagggcatcataaaaaactggtaattagctcctggacacccactgcattactttattatttctagaggaataggagagagaaacgatcattaaagacaaatttgcccttagctcaaatgaatccacgtgggcccacatgtaagcccctctctctcccggcacagcgccgcgtcggccagccagaacatgccggcggtggcaggctcttcgccgtgcaatcatgtctcgcgtcgcgtcgtcgtgcagcgaggcgtcgacggccgaggggaactccatgccgtacgaccaccagtccatgcctgcgccgtgcccaccgccgcgcgccacctccggcgccacatactcgtgtgtgccgacgaacgagctcgaccgtgcgtgcactggttctgcccgcgatgcccatcatgtgcagatactcgagcgcgaggagcacctcagtggcgtagaacctggcgaacgggattgggaatcgacgaccgggcatgctttggcgttgtgagtgagggagtagatctggccggcgtcgaagtcgtcgaacatggcgagcatgaaagggtggtcgagccaacgcaggatgcgcttctccgcggcggcgtggcccagcttgcccttcttggagagcgcgcggcagtccaccaccttcatggcgtactcgcacgaggacgatgagccgacgcattctccttcagacgatgtccctggcgccgacgtggtggatgagggtgaagtcccgcgggcgtagcggcgacgaggatgggcgcccaagcgaggtcggccgcgtggtgcgggcgtggtagggaagaggtgggtgtggccatgtcaagtgagaacatggaggagctgaaagcgacacccactgacccaccgtgctactgctgccgctggcctgctgctacttatgcttgagctgggcatggaggcagcgtgtatgtgcatgtcgtggtaggcctgcgcgcgacagcgcagtgccgcaccaggcccgcgcctcgccgcaccgtagctgatgctctccctctccctcgggcttgcttggagaaaagagcagagagagagagaatgagagagaaaagaacaaggaagaaggagcagggaaggatagagaaaaacaaaaagaaaaaaattcgaagggtagaaccgtacttacacagtttttctctctccaatttctccggatataataaaataatcccgtgggtgtccagcagctaattaccaatattttgtgatgccctatagcatattcgcgttcttgcagtgtctcccagctaattatacgttttttggatgtcctgtagcaaattttgccttttgaataagacgaacagtcaaacatttgctaaaaagtcaacggtgtcaaatatttagaaatagagggagttttacgtagtacacaccaaccgatcgtgccctagccacactcgtactcattgaaatcatactgaaagcacatcaacgtgtgcataatatttatgagcactatgattgagtcatgcacacatgattttaccatcacactgcgtttctctaagttgaaatgaaagttcaagttgaaaaaagaatgggcttagagaagagttttgaaggctaaaaatgaaagagttttgccattggctaggctaaaaaaaaataggttcaaaccacaacgaagctcaccagaaggttagaagagaaggtgtgctagtatgacaggagcatcgcttcagtatccatgtaataaaagataaaaattcagttattgacagcaagagatgataatattacgtatgatcagagaagtgtggattgacgtggtctgaactcatcttccgggtgcacgaacacgtactattcgaagcatctctagaattagaaagcagaaattgcaggtgtatttatcatcactggcaaacaaaaacctacagtacatagtagaaaactcaaatcaacgtatcggatggatgatggatggtcttgttgcatttttcctgtgtccacacttcgcagttcacacaaataatttcggtcgcgtgcaaagcaatagtagtaaccaataatgaaccaactaagggacaatttgaaccatgccacacaaattttgcaaaatttgtgatatgccacctgacccacatgtcattgactcatgtgggtcctacatgtcattgagatacgggtggcatatctcaaattttgtaaatatagggtggcatggttctaacaaacccactaactaattcatagttttgatcgtttggccaacgggtgatagcctgtaaaatggcttattagaaacaaattatttatgaataaactttttatattttatctttaacgatttaaaagtatgctgaaaaataaactacgaaaaaaaaatctcgaaatcaactacaaagttcaaattttggctatggctcatgagccaaaattcaaaaggctaacgttggcaacttttacatcgagatgtcgacaggatcgatatgaatatcttttcttgaggcttaaaatccaagctacggagtcgccgtgaacttgcgggtgaaaggacgtacaggtgccgacttgatgatccatgtccggcaccatcatttaaggagagcactgtccaatagaagctgtccatatataccatcagacattcagagtttcagacggcacaagttttcattccatatcatcaggagaacttcaggtacaaactgcactttctttgtttccgttcatattttgccaggccggttactgttcatgttcctcagaaagtaacatcatgcatgatctagggcataatgatctcctgttgaacctggtaggctatgcttctatttttgatataagctaccaagtcattatattataatagacaaaaaaaatggcaaaaccaaccagaggttaatcgactggagattctgagttcctgacctgatttttcttatacctgtacaaacagattgaaaatttaattcacgtcttgtttttcctgctttgcttttagaaattcaatttcaacgaagaaaggttcaaggtgtgaccaaattgccacatatatgagaacacgtgaatggcatatttaatgaaacactcattcgttttggacaataccagagcatgtttacttattttaaagagagcggagatcatttttatgattagaaaaataaaatgtaaggatttagctgaataactcttaactagccatggagattatcgacaaaaatagatgcaacctatcatgcataataacaacctattcggcgaacaaccaccgctgttgtacttcttctccaaaccatcataccagttaaaaaatatatttaaacaaatgcatcaccatgtcattgtcctcagtcataatgcacacatgacaagaactgtttacaaaactacaacagggattatttgcacatgtcctcatattttggagggtggaattctcgatttcatgttccaggaggttaagtaggccaaaccactgtatcatgcaggcggttaagtttccaacctttaaactttcaaaagtttagattgatacatgtagatttgcttgagtactttcatagcattataacactaatgagctttataaatagtattttatataaagatcagatatcaaagttttatttgggagaccatgtcaatgtccaaaatggcgtatttctgagttgtgaccgatgggagttttttctggcacacttattattccaagtgaaacttacctgggcatggaattgaagactaattcttttttgtttttagctgccagaaaagtgcttcaaaatgtttactgccctaaaattgcttctcttgccatatctgctcctactggcatcagcttcatgtactcaaggattgcctttcagcaataacactgatctggatgccttgctaggattcaaggcaggtctaagccatcagtcagatgcactggcttcatggaacacaacaacaagctactgtcagtggtctggtgtcatctgcagtcataggcataagcaaagggtattagcactgaatctcacctcgactgggctccatggctacatatccgcttccattgggaatctcacatatttgagaagtctagatcttagttgcaatcaactttatggtgaaatccctttgacgattggttggctgtcgaagttgtcatatctcgacttgtcaaacaattcattccaaggtgaaattcctaggacaattggccagctaccacagttatcctacctgtacctgtcaaacaattcacttcaaggcgagatcactgatgaactaaggaactgcactaaccttgctagcatcaaacttgacttaaacagcctgaacggaaaaatccctgattggtttggaggttttctgaagctcaattccatttcagtagggaagaacatcttcaccgggatcatcccgcaatcacttggcaacctctcggcgctgtcggaacttttcctcaatgagaatcacctcactggaccaatccctgaggcccttggcaagatcagcagtcttgagaggttggcactgcaagtaaatcatctgtcaggcaccatcccaagaacactcctcaacctttcctcgctgatccacattggcctgcaggagaatgagttgcatggaagattgccttctgatttgggcaatggcctaccaaaaatccaatacttcatcgttgccttgaaccatttcacaggaagcatcccaccttcaatagcaaatgcaaccaacatgcgctccatagacctctcttctaacaacttcactggaatcatacctccggagattggaatgctctgcctgaaatacctgatgctgcaaagaaaccagctgaaggcaaccagtgtcaaggactggaggttcatcacgttcttgacaaattgcacaagacttcgtgctgtgacaatacaaaacaacaggcttggtggagcactgccaaactctatcaccaacctatcagcacagctcgaactcctggatatcggatttaacaaaatttcaggtaaaataccagatggtattaacaacttcctcaaactaattaagttgggtctctctaacaatcgtttcagtggtccgatacctgacagcataggaaggcttgaaacactgcagtacttgacactagaaaataacctattgtctgggatcataccatcctcactcggaaacttaacgcaactgcagcaactctctctagataacaatagcttggaggggccattgccagcaagcattgggaacctgcaacaacttatcatcgcaaccttttcaaacaataaacttagagatcaattacctggagatatttttaatcttccatccttgtcgtacattctggatctgtcaaggaatcattttagcggttctcttccatcagcagtaggtggtctcacaaaacttacatacttatacatgtacagtaacaacttttctgggttgctaccaaatagtctcagcaactgtcagagcttgatggaacttcatttggacgataacttctttaatggtaccattcctgtatcagtgagcaaaatgcgaggattagtactgctaaatttgaccaaaaatagccttcttggtgcaattcctcaggacttaagactcatggatggactgaaagagctatatctttcacacaataatctatctgcacaaatcccagagaacatggaaaacatgacatcattatattggcttgacatatcctttaataaccttgatggccaagtcccagcacatggagtgtttgccaatttgacaggatttaagacaggatttaagtttgatgggaatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9893 - DNA, 1885 bp, Oryza sativa
ctgatgagcttatttatatgtctcaactgactttagagaagtgtttaaaggatgagaactgattgagatttgagaaatgaattcaccatttttgttgagttgcataattttttgtatcgctatttaccagaatcataaaccattgaaaagctcatagttgtccctggaggtggcaagtggcaacagaaactgcggaagagttctgctttccatgcccattgggagatgcagacagcattaagaaggaaacaattagacatgtggaaattgttactgttattgttcttttcctgggaatgtggttgggaaaagcttgggataatccaaatgcactctcagttggctggttgaaatcttgccggactagtttctcagcttgattaggttgcatttctgttttacaaacgagccccaatatagcatcatgctcattcttgattgtcagaattgtttcttgcatagttggaatatgtcctttgttctctgttttttttttaactgtgatgttctttgttctctttaactccctagataaatggatatttaaaatttaaaatttcctattctatcaggtgtcttaataattatttggagttgatgattgaggaaccacggtttagttcaattgcctatgttcgtctggattcacaagtcaagaaactcgataaggagaacacgtctgcgatggatttatcatccagtttgcaccagatgcttcagaagttaaatttaagagtacaagatgaagaagtctgggtgtcacagttaggctcaaatttgcaggcttcattcagaaaaatcatggatacctcctcagaaataggaaaattagaagatgaagttttgcagctgaaggtcgatatagctgagtttgctccaggtgaagtaaccagttgtgcagtatatgaaatgatcaagacacttcaaattgttgaactgttcatgaataattccaccagacatttgaaacttatcgatggaattaattctgaaatgagagagtttggaagtatctttaatggcaaagtgagatgccttgttcgctttgctagatatcaacaaactattatggagaagtctacacaggtttgctctaacttactttttaagtgttatgacaagttctggatcacttactcatttgacagataaatttgttccagataatcaatttccttggtgacatccgtgctaaagttgacaaaatgactcaaatgtatggtctatctgaagttgtgcccattgtctcaaaccagtttatagaggtgtgttgcaaactgaccagccttcatttaatcacttttggaactgtatctttgttatgcattctattgttgattccaatcaaatctgacatggtgtactgcatgtatttctaggggagcttcaatgccgatgcatatggttagtctagtgatattgatagcatttgttaattcacatcttgtttcagttttgatcaatctcctttcttatgcacagcttttgagagtttgaaagagcacagcactgatctctgttttagttggagaacaaggaagtttcataacagattaattctccctccagtgaggcaacaaacttctggtatgaaataaatgacttcttgatgaaaactttatgtatgtcataagaataaaatatgtcgttatgatgccatgaaaataattgaacgatcagcaaaaattgcaccttttcctgtcgcaatcagttttacctaataatttacttcctagactgatattttacatacatgttgatattttactctgctggctcaccctttttatgtcctgcttctgatggcctcaagtacttcccctcacacctctttctagtcatttgatcatggttgatttgtctactagggcccacctcgacacag

SEQ ID NO: 9894 - DNA, 3498 bp, Oryza sativa
tgcgatgagggaacgtgataaggaagaagtaagcattgttgacaagaagtgtataggaaagaagaaaaaaaggaggttcagaaaaaagatgagaatgaaggagcacatatttctgacgaagataaagaaagttattgagagccatataatggatggaaaggtgctcattgctagtttccgggtaacaactggttacttcaggttgctacctcatcaaatctacaaaattccagaagaagatccccaatatgaattgaataaaaaaggtaatccctgttctcattgtgtcgttgttgttggttttgggattcgggacggtgaatgttatctgatctatctaaattcatatgggacttcctggggacatgacggattcggtagaatataccttgatagtgtcaggaagctttttttagctcaggtctaaactttgcgtgtaaaacagtgaaattgtaaactgaaatgttattgaataatatttcttgatttggttatctatatttctttcctatgcattgattaatgtgagatatttgagcttttttttgtgaaaaagttacttttattgcaaggataaatctgtcctaatgtcaaacatgaggtatctgtccttctgaccgatgcacgtactactgctctgttgtctgtggcgccttccgagcttcaactgcattgtgagggatttgcgtgctgttgtggtcaaggagcgcatgcaagtgcttgtgcttgtgcttgatggcgtttgaatctcatttgcctgttactgtctaaatcaagtttttctgagttttgattttctcaataaacatggtaatcctctatccaatattctaaaatagcccaaattgtaaaagtacgtgttactcctatataaattttattcaacgtggctaaataacattaggttgaatatacctggcagtatctaatccatatccttatgaaacattcacagcatgtagaaaggaatactgataacaaggtatgtattatgaaacattcacagcatgtagatcaaaatgctcacggggtgcttgactcaacgactctgtggtcgtatctcagaaaagtcttgcgctgtcatcggcaacaactgactagtctttttttatccaatgcggaattgaataaacgctaaataaactccaactaatatatgctcataaatgcatggaattcaattagtgtacatatcttgattttatattatttgagtataaagatcttgatctttgttagtgagcatatccaaacgggaaaaaaaagagatcagaaaagcagcaaggcagtgagaaagatgtcaatcaaagcttgatggcgtccacatcagagaataccaaccatatactccgtcaaaaaatggatggagggagtatgtttctaatatggcatggtacaggaggattactattcatacatcttcagttccctagtccccaagctctgttcgcaagaacaggttcccagcccaaatagtacgcatgaaaacggagcggtccattagcacgtgattaattaattatttattatttttttcaaaaatggaccaatataatttttttaagcaactttcgtatagaaactttttaaaaaaacacaccgtttagcagtttgaaaagcgtaagcgtggaaaaacgagtatagggagttggtaaccagctcttgcaaacagagcagccaggccaccgaagttcaggcatgtttggtttgtttcccaacctaaccatttcgctacgccgaaaaatcatcgcccatttagttcgtaaaaagaatggcattgcaaaacaagtaaaaggctaatcaaattttgtcagcattacaaaaattatcactcatttggtttggaaaaagaatggcattgcaaaacgagttaaaaggctaatcaatcttgtgaaaaattacaaaatgttgatatggctagcattggcatagaaccaaacagaataagagtaactgagcaagtgaaacaaagaatatattttgattcatgagtctcactcccacagttcaaataaatcaaaatttcagaaatcactgatgggaaaagctagcttcgtgaagtccaatgcccagttcacactggaccaactttgaagtttgaacgagtgaatagagatatttgctacagctatatatataacttctccagtgtatttgggctgtgtacacctttctaaggtgtagaggccgggttaatataatatattatctaaaaataatttccccagtgtatattcttgattgaagttattaaagacattgactacataatggtataatttaaaatctagtgcgtacaaatttctcaagcaaacattcttcttgtattacatattatcaatagataaatcctactgataacactggcagcttttcaagattacaagaatacatttactaatatggccatcagtggtcagcacagcagcaatgtaagctttcatccccgaacaagaacttgtcggtgcttgggtgtacaaggtaaatctcataactcatgcatcgcacacaacaccctgtaaaaaaaataaatataaaggatcagtttatctccttcagagaatatcactactagaaggaatgaaaaatcattacaagatttgttggaaaactattattggaaatatttggacagaatagatagtagtgcagtagcgtagacttggtatcagaaacaatttgcaaacaatcggcagtcaaatatgctagtagcacatattcactcactagttttcctaaaacagaacagttgcttgtaatatataaaatcaggtaaaactgtggtcttctggagagtgctacacaagtaaataaaaaaatgcagcaatgaattaaaaataataagcaatcccatacaccgttaagttgtgaagtcctcttatgtttttgctcgattattgtgtatccaaaaggataggcaaagtgatttaaccaaatgctaattttacagtaataatcaccccactgacatcatgtgaaatgaaattgtgtcccatgtcaaatgagataagaaaatggtcattactttataaatgtctaagcgaaatgccacaaaagtaaacagaataaatcattgccatacctatttcgcctgtttcgattgaacaccacgagtgaacttggtcctcacatttaacatcgtcgctcgtctcggcgaagaagaacccaaatccactgcttggggagtacgcagtgaagttgtagtggcaataggatagttccatctcaacgatcgtgctctttgcagagatctcccagagctcgtagtttctgcccggatgcttcctgttgatgatgttcaaggccatttgcacattcttggtgtgcctcttctcagccagaacttgccagtcaaacatatcatccatagcctccttctgcagctgctctttacgcggtgccttcccggcggcatatttctcccgccagcgtgttcgtacttgctctatgcgctgctggcgttgcagcgcctcgttcttgcgctgcttcgcctctcgg

SEQ ID NO: 9895 - DNA, 4069 bp, Oryza sativa
tcccaatacatataagcataacaacaagtaatataatgcccctaaaaagtggcatataggattcggtgatgaggtggaggagataaatgataagctacccctaaattaagaaacaacctccacacaaacactaagaagagtctgagagtgttaaaggtattgatatttgtgtattagggatgacatattatatatgttgactcttaatttataagtgaacggcatggataaattgaaggtagcagtcacatctattatagcacttgctctaatgcatccaaaccgggattcgatggcagcccgacagcccgacacctctaattttccatctaatcaaatacttaactcccataggcgcataggcatcagagcaggagcttccaaaattgcggagattatcctccatggagagtagtcctatttttgagtctcttcggtagataggccagtatatatttttcagtaaagtttttacttcttctctatgaatataatgtggcaaagctttcgcctttcttaaaaaaaaacaaaacaaaacaaaaggcgcataggcagaattaggcatacatcagagattgagattcagagtatggcattcatagcttattaggtcatgtatccatctggccaagaatttggtactgaccaattgagccaaaaattttaaaaatttaatgcgctccacctccgctgcttagcttgcaaatctactactacttaaaaaataagaggtgcttccatcgtccgtaaaaaaaaccgggtgaaaaaaaaccgggcgaaaaaaaccagtttgtccgatcaaaaaaaaaccggtaaaaaaaccgggtgaaaaaaaaccgggcgaaaaaaaccagtttgtccgatcaaaaaaaaaccggtaaaaaaaccgggtgaaaaaaaaccgggcgaaaaaaaccagtttgtccgatccaaaaaaaaccggtaaagaaatttccgtttttaattataaaaaaattacccacaaaaatagtttctgtccgattccaaataaaaaaaattccgagcgacaaaagagtttccatcttcctacaaaaggaaagaatagtgcgaaaaaaaaagtttctatccgaagggaaacacgcgtgaataaatacctaattaaaaataaatatctatctctaaaaaaccttctgtcgtaaaaaaaggaaaaaaaggaccgactcccgtagagaaaaaaaaagtccgactcgtgaaaaagaggttttctcgtccgtaataaaaaaaaagaaaaaaaacatctaactcaaactccgtaaaaagaaaaggaggaaaaaacgacccgaccaaacttaaagtcgccccttgttatccgtatatatctctttaactctaatctaatctatcaatctaatctaactttttagaaagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaaaatggtttcaaaaaaccacacaagaaaaaaaaaactgtttataaaaaaaagccgctctaaaaaaactaaccgatgaaacactgtttataaaataacagatccaaaaaaaacaaacggactcaacacgcgaaaaaaaccgatgtttcaaaataaggttcgagaaaaccgtccgacttaatgcgagaaaaaaaccatcatttcgaaaaaaaaatagaggaaaccatccaactcaatgcgagaaaaaaaccgccgtttataaaaagaaccgctccgagaaaccatccgactcaaagcgagataaaattgatggacgcttgggtcggataagatccatcgatattttttcatctcctacacatcatttcctacacatcatttgtttcctcatctaatccctgcactttttgtatgcaattatcattatcagactttttttaataacatattatatgaaaatagtattaaaaataaacatatttttaattgttatttagagaagagtgcacggtgactattttgtgtagacttgatcctgagtgtaggatttgattaacctattattggttgcaagaataatattgaaagaatatttttttattatatgtatattgttatatgaataatccaattattttagttaaagcaagcattggtaaaaagattgccatcatcgagtttgggtcattacataaagatgctctaattttctaattgtgttagctacaacgatccatagaaacattatcattgatatgggtacgcttgaaaaatgtctattgtcattggattattttttttacccgttgcaacgcacgggtatttttgctagtaataaataaataaaaggagaaagcaaacgagggcgggggggcttaccgtggattgggcgcggcggacggcgacgccatcgctcggcgtgtgcttttcgcggagctgcgtgcgtgcgtggtccggactccggcggcggcgcgcgagggttttaatgggtggccgaccgacggcgagccggagccggagttggagtcggagaagggttcggggcggagtacgaaacggactagaatgctgcctgcacaatcggtgcggcctatatagcccatcacatcttatcatctatttctagccggcccataaattttttttttattgaaccgtgtgttgtgcctaaaattgcattcattaatcttagatgatcgcccacttctaaaattcagttttctttaggacaaatagatatagtttctaaatatttgtggaaacaaacgagggacttgcctattgaacagttgacagatttttgtagattgaaatcttgcagattttgcagtcactggatgtagcatccacgttgtttgttaacgggcccgcaacacactaatgttgataagtcgacccgttaagacgaatttggggctacaaatcactttagcctagcccattagctgctaagcaacccgtttggatcaaataacaaagcaaaaagtccactttgactcccttaaaaaagtaggccgaatctaattcgtatccctcaacccaaaaaccggatatgacgactccctgaactattgatgccagtgcaatttgactcctccaacgattttggagggcggttttgctaatgtggcactgttgacccggtcttcatctcacgtggcgtttatgtggcattagaattaaaaaaatatatgtgagacccatttgtcattcacacacaaaaatatattgtggggcccacatgtcatcctttctccttcccttcttcctcctccctctctctcacttctctctcttttctctcccccttttctcttccccttccgacgcacgtaaggagtgggagctggactggcgacggcgacgtgcgggcaagggctggagcggagacgggcgggcagggccagagcgatagcggcgacaggcactggagccgcttcgacgtctgggcatgccacgccacctctcgtctccaagccggcccgccactgcaccccctctaggccgggccggcgctcgcttcgccgccgctctgcttgaggccgggcctgcaacggccgacgacgaaagaggagaggaaggggaagagaaagaaagagagaaggaatggagcaggcggtaagggcaaggagaaggactagggaggtggaggcaggtgcagggccaaggagcgggagcggcggcaacggtgggtagggggaggcgcagcggcagtgctcactcgacgctcctagaatcgattgggttgtcactatttgggctaagccacgccgctctccccgcacttgaggccgttgtcgctccggccctcgcccgctcgcctccgccgccactccagcacctgttgtcttgcctgccgccgccatggctgagggggaaatgaaaagagagagagagagagataagggagagaggaaggaggaagaagagttagcgtgagaggatgacatgtgggccttataatatactccctccgttcgaaatgtttgacgccgttgactttttagcatatgtttgaccgctcgtct

SEQ ID NO: 9896 - DNA, 1812 bp, Oryza sativa
aaagtcaacggtgtcaaacattttgaaatggagggagtatattttttgtgtaaatgatggatgggtcccaaatatttttaattttaatgccacctaagcgccacgtgggatgaagacccggtcaacaccgccacgtcaggccacatcaacaaaaccgccatccaaaaccactggaggagacaaattgcaccggtttcaatagttcggggagtcgttcgggaccacctatacatttgtcgataaattttctcgtaaaaatttgacagatgtaattatagtacaatcatagtgtagttacactgtaacttatatgttattacactgtaacttacatgatactacagtgtaacttatatataactacagtgtaacttgtatgtaaatctcacataattttgaatcgttagatctattccaagattagttttggtgacgaagaaaaaaatcacagcacacacatgtgatagaatttgttcccacgacctccattttaccgaaataacatattacggagagatttttgaaagttatatataagttatattatagttacagtgtaattacatgcaagttacagtataattatactatgattgtactgtaattacatctgttaaatttttgggagaaaatttgtcgataaatatatagcaaaattgaaggagaagattccacgtgcgacatatcgtacgagtacgacacacccatctttatcacacagcatactttcagattaatttcatcccacaacacacatcttaattacctctggaacgcagtttgcttccagatcaacgaattttcgatgagaatttctcatgtatcacagcactctatcctgatccaaaatatagtgaaatatgtatacctcacaaatctgaacccatttcttagtgactgtcagccaccgaatacgaaatctctcaaacacaaattaacaacaaaaaaccaacatgtcaaaaacaacacaaaaccaccactaacatgtttctgctaatatcgccgcatgccaaaataacaaatgcagcattgagtataaatcgtagacttcatctgcgtgtaaacgttatcttctgataatgcacaaaaaaaatgtagcaccgaataaaaacctgcaggtattcactattcagcggtttcagtcagaaataaccaaaattacagtttcgaatttcgatcacacaagaatggatcgccgcttaataaccactacatctggtgcagtattcacagctcacacgcacaccaaagcattacatcaagacagtaaaaacagatatctataagaaacatacgtgcaaactgtccttccagttcagacaaaaaaataacagagagaagatgatacgagaaattacagaatgcagactcctacaatcctacagctctatcaggctcagagcagctctactataactagtaagatttgccagtaagtttctggtcactagaggatcaagaacacagttgaggagcgatctgatccgttgatgtggcaaaactgacggtgaggatggactaaggggaccgactgaactgatcagtgggaatggtcgaagctgaactccttgtgcacaccgcacttgcaggtcacgcgcaccaccagctcgccgccggtgcaggccgccgccgccgccggcgagctcggcctgggtgcctctctctccgcgctcgacacctcaacctctcgctcctgaaaggtacaaaatgttcaggtttcagaatgacagattgccgaatgacaatgacatgaaaagaagatgaatacaacagcaatcgccagtaacagaggagtccaggcaattgcagaga

SEQ ID NO: 9897 - DNA, 15904 bp, Oryza sativa
  unsure (1)..(15904): unsure at all n locations
nnnnnnnnnnnnnnnnnnnnnnnnnnnnnnnnnnnnnnnnnnnnnnnnnnnnnnnnnnnnnnnnnnnnnnnnagctagcagttataatcccgatcgggaggccggccgagacgatcgatcgaccttggcgacgagatgaacggatcaggggatggatggatggatggaacgaggcggctggccgggagggaggtgtccgagttatatatgggcgtgcgtggtggtggcgcggcgggatcggagttgggatccgaatcggaatcggaatcggaagccaggaaggaattaattcttctctccgattcggtcgccgtcgggctcgaacgtacgtacgcgcgtcgggcgcgccgcatcctcacgagatcgcacgcacacgcacgcagctcgggagccgatggccggcctcgacaccgacacgtccacgtccaccacgtcgaatatccatggctccatggcccatgcaagcagacgcgcgcggcggtggcgctgtacatgccgcaggagtgcaaactgcaaaggcaagagcaagttcgtcctggagcaccaggccatgtgggagaaggaagggaggaacaaaggctacgacaccaccgtgcaccgctggcgctttgccaccgtgcctgaaggcaaaatccttgccggctgggagaaatcggacattctgccactgtcaaagagggtttcactcaaatgtcacttcgcggattgaatttgttaaaaagccactctcaaccgatgccaaacggctgctttgccatattcactgttacctccgtcacatattactcggccgaggatttcctagtggccgacgacgcgccaagcctgcagcacctcggctgcgacggacggggtcttgccgtcttggtatgcctcacggacgacgagctgaaagtccaagacaaggtgtactatgatgggttgttggagagcaggtgggcagaggacactggctcatcctatgctccaaggacggcggcggtggcgagctccgtcactggacgacggcatgaccaacgtggacagaggcacgatggcggtgatgaggagcacagcggcggtaaggtgccacagggccaggacagtggcgaagctaggatttgaggttaggggggtgtgggggagaaagtcataaaaccgattaaccaatatgaatagtaaatgagccaaatagtcactaccgataataatcaatgtgtatataaatatagcttcgttgtagctagattataaaaccatcatatgttatgtttttttcaaaaaagcggttcaaatgttcaatataacaagacatcatatgttttgcctaaaaaacttgaattcagttctttcataatatcattgaaagtttggaaccagtccttgttgctaaattctttcaatgtaaactaccaaatagtctcataaaaagcattttctgttttactttgaaaagatgaaaatcataagactaagtactgagagtctgcctataatctaacgtgctaatgccctaacagtggatgctgcctaattgcctaaccctgtaatatactactagcagccagggggttcgggataggggggtgctggccccctccggcacccccggtagcttcgccactgggccaggagcttccacgggctgtggctgacggtggccgcgggcggggagatgcctgcggcggccttggtggttagggcagatgacttggcggaaatggcagtaccatttttgcactttggactagctagggttcataatttgggtattcatccttcagccatgcatcgtgcaagtttttcttgtgaaactgagcatcatgagagcagaaagatcggtagggcagcaaccaaaaacacaaaagtacaaagatttgttcttgcaattgggtgtttcacaaaagtgtgagttaaaaaaagaatatatagtttgattttcggtattaagtgacaagggctttggttgtggtggaatccctcaaatcaattcatatgacttatgtcgagtgtttgaaatatcgagctaagacatttagcgattggccttctcaaatagtagtagctatagcggactaaatggatctatagcggcgaaattctacatgagattaaatagctagatccttctcaaacagctagccggagatagcggcaactatatatgatattaagtgaaaagatagacttgtctctaattcattgtaaaactttggttaataaaggtggatccgatgtgaaatttactcttgttacaagcaactagccacatttaggaaatgagcactactacatgcccgtaaaaaatacttatgaaagtcttacaaataattatcttaaccatttaacttaaagagatacaagctataggaaatctaaatatactagcaggatggcaacatcagtgttggtaagagtatcagtgttagtatgagtgaaataagaaaaaaaattagtagtgaataggcaaattttgctacaggacatcgtaattgtgtggttttagctcagggacaccgtgaaagtgaagttttgggggaagacatcccataatcgtggatatttactgatggacaccgcgccgtctgccgtgctgacgtggcggacgggaggcccttttttgatgcgatcggacgtaaatacccctgcgcaagagataataaggttatgtggggcccacttgacagtgtcccccctcctcttctttttcctctctcggtttcttctcctctcgatctctcctcatctctctccctctcgtttccctttctcctcacgcgcgtgcgcgcctgagcggtatgcggcaggcgtgcgatggcgcggcaagcgaccggccgcagcggcgcgggctgaggcaatggcggcggcctgaaggcggcccgacggcgtcgggtggatggggaggcagcgtggcggacggcgacagcgtcgggcgacgccggcggcgaacgagctgccgagcaaggccatgggcgacgccgccgtgatgaaggtggacacgggcggcacgtcgcggagtgcgcgccagacggcgctgttgcacttgaagcctgagccgaagccgatctgccagacacggtggccgcggcggacgcgccccttggcctcggcgtaagcaagctcgtaccagagcgagccgttactggtgttaattgcacattaggctcgacatcccgtggttaataggcacattaggctctctctttgatttcctgcatcaatcaagctaagcttggttaattaatcaactagcagattattgtatatcactcatcattgtttgtactagatcaatcacttttgtgcgtgtggttacctcgatgccgggagcaagagcaatggcaggcggcggcggcggcggtgcgagccagatgcagccgtcgtcttcgctccaccactcggctaccgcccgaggcagcagctccacttccgccggcaggcgtcgtgcgggccggcttggccgcgcgtgggggcggcgctcgcagcgtggtggtggccccgagcaagacgaagacggcggcggtcgcggtggcgattcgtccgggcggagatggaggttggaggtgctaacagtcatggtggcgaagcggcagtggcgcgcgggtggtgctcgcgcgggagatgtggccgcgcgcggcggcagcggccgagcgtggcaacggctttggcgcggcggcagagaggtgaaagaggtagctggcggcggtggggagtggcctgacgggaggcccttttttttttctgacgtggcataggggtatttacgtccgaccgcgttaaaaaatggactttcgtccgccacatcagcacggcaagtaccctttagatggcgtggtgtctatcggtaaatatccacgattatgggatgtcttctcccaaaactaaaaccacacaattgcgatgtcctgtagcaaaaattgcgtagtgaatataggctagattatttcagttgtggccccaatgtgctccatattgacccgggattgcatcgggtcggagaataagttcgttgggagtttgttacctgatgcaagcgatgcggcgatcaggggatggagatcgcgtcagtagcgtgggcgtgagtttagcgtaggtgcgcgagtaaatgaattcaaagatttgtggatcgtggggtggtggcacgatttagcctcagattctttctttgtgttgagtataagtaggagattagctcaacttctaatttgtatgttttccaattcatttgaatgaaatccccagtaaatcgctccacaaatttcttcaaaatcttcagttttttctgaaacttctctcgttcctacgttcgtcagtttcgtcagtcgaaactgttttcgtctgttgccatacaagacaggagcaatgtgcgcacaaggtattcgacaagcgttcttctccaacatgcccaacgtacaccgtggcggatttaggatttaagatatgggtggtccaacctaaattttctttttaaaacacagtaaatgtaatgatgctaatatatgcaatgcaaatatagatagtaaaatagacaaaatcaccaaaagtgtaccatgatatactagtaatatacccgtgctaacgctacgtctatgtttagtaatagaaataacagcacatggttcggtatccaagtatctaataagataaatttaatatttaggaaaaaaactacggagagagttattatattgttgctaattatatagcctccaaaatataaaatcacaacttttgtatcttaggaatacaaacaaaacttattacctacaaataatacaaaccaaacttcatattacaaggagaagcgttttgattattttatactatattaatcaccggagacaaatctgacctaaatggaaggatataattatacagaaaagacctaccaaagtttcaggagtcattgtctagctcaagtatgatcataagtaacaagaaccctatctggaccagtcctcatgccttcgcaaagcatgttaaacagtgcaaaagcattttttgtcattctgcataataaattgaaatttgtcatttatgaattagtttatagaacatgctgtaaatttgaaccgcaaatgtatagaatatataaggatataccaactatcctgaattctttcaagtgcatgcaatcctataataaaccagatattaagagagtatttcatcaagtattcgctactataattatctttaaaaataaattgttataaaatggcagcaaaccaccagcagtactacttcatgctttgtaaaattagaatatacttgaataaattcagatgcatcaatggctgatgaatttttcatgcaaaattctacttactttcggttatgaagaatatagatagcacttaccatcaccaactggcttgccatcccatttgacaatgggcagaaaaggatctgaatgctgcatcccagcacacttccttgcagttggtgatatagtcaaaccttctccccatgctcattagttttgcaccttccactgttctccaccaatattattggcaagggaaaatcctaaaagagtaaaatattattaaatttaacattcaaagaggaaaatggcaagagattttacaagcacgactgtttgtgaacacctaaaaaaagggtacagtttatgaacaaatcaacagtccaaatgaaatatattggctatgaaatcaacagagtctgtagtatatagagaatggttaattacagaaatcatttgctatgaaagagcatgtcaaaaagcaaaacattgggtctaaatgaaatatattggcataacttaagatgactgacgcactacacacatttggctatggatgagaaaaatgtggagttcaagtccatctacataattgcatcttgtcatatttacaacatgcagctgtcgggtctttccatggacctacagtgcatatgaacatggagatataaaaaaaatacaacaaaaatacaagaccaagaagttaccattagagtaatgtggttatagtgcacatgaaaacagtttaatagaaatataggatcaagactcgttgcatgacagcctaaattccatgtgtaagatttagattccaattgatttaagacaagtatcaccataactcaagatgaatacctatttatgacattgacagcctgctcattaattatccacttacaatgaggcggggaagacaggatcacaggaaggagtactgcatccgagcaacaactgtaatggtggaggaatttcctaatgcccaatgatactacacatgaattcttttttccaatttcaataattaattggctaataccatgaacctgcagccatatgaatggagggaaaaataataggagaaattcaagcattaggcaagccccaaaaatatttcaggaaaccaatttttttggaaacttgggtattgcaagaactgaaaaaacagagacactaagaaatgtgttcccttgccttttagtcataacaacaaacatgcatagtggcactatgactggactaaaaaagagagaaagtacattatgtgttttttcaaccctgtattccaacagaatagaagatgagcctattatgtgcagtcatgtatctctacaaattatccttatgaaagccaaatcaattctagtaccataatctaaggaaaagcaagaaagatactgtaatgtgagatcaaatcatacaccctaaagctctgttcatcttttatgtgcttactaaagcaagctaatatatcacccaaaattggatatttgggcacatggtataatatatcacatgataatagaaatattctcttaaatagttagtataatgtatagctttgtattaactgaaaatggaaaacaaacctttccattgtttgtgtatttaaaaaaatcactatatacccctataggaaataaagcagcatataccctctccaaggaaacatgcagtatatacgatttttgcactgcactgaatatcactaaagcaaaatattgttaaaaaggaagcttaacataaacttgtacttacatacataccaacaaaaataagggagaaccagatgtgcattcagtgatggtggcagtgtaggagtctagttctaactgtataagttgcctataggaataatagtaaacatgaacatcacaagaaaaattacctgcttggtggtcaatacaatcaccatcaccaagtccgttttgatctttgtactgtatgaataaactctacataaactatcatgacacactgaatgagaacatgaaaaggaagagaggaaattcgttgtaccttgtagggggtggaacagagaggatgggggccagcttaccccaaccgccaaagaagatgcaacccaactgccaatgctgcatatgtctatgcaattaacccttttctccctaggatctatgaggtttagttaaaattcagtgacaaccagtgatttttaagtctcctgtatacttgcatcagctatcctactattcctaaaaagcttatatacatgtgttaggttataaaagcaagtcggaaattcttaactatgcatcactaaaagtcttctattgttcaagaatcaagataagagaggcataactggatccaaactgaccttggccaaagatcttggtcacaaattttcttaaccaaaacaggggactgagttaagcggaattctcacggttagcaacatcgtgttttcctacaatacaaacatgctaggaaaacacaaaagcaatctctgtggtaaacaatttggcagatctgcaatatgtatatagtgaaatcacaatctgagaatgtactgaagatagaaatctgcaccatgtaaattgctaaaatatattagccaaacaaatgaagcacaaaaaacttaattttgaaagaaatataacataacataacctttacccccagaacctcagtagtgtacctgctcaatcacacttaaggatggagctttatccctgcagcttgattccggttctttgcacatattctgttgccggcgtttgcggccatagaaacggacaaagtgttgatctccccaactttggtccatatcacctgcatagtttatggtcagtataacatttttcgcttttagcgtaagcccacgagaaaaggtctaaaaaatcatctcataataaactttttgaaaattactacaatattaaatgattggcattctaacatctatgattgggctaaaaacggcataactgtagaaggaagcaacaactgacaaacaaatggtcaatatctgaattggcaaatgtgtttagtcagcatatcagtgctgcattgcaggaatgaaaatgttacttccaaaaagcaaataatttcactgtcaaatatgcacatggtaccatgatcttattagagaacacttgccattgcaggcccagcaccatctgccactgcttccgagttccgacctggtcgcctctggctgggatcgattcgtaaccgccagggagagatcggagaggcgatgcggcgtgcgacggcggtggaggtggtctaacttctaagggggagagagcggagcggagatgcggagggaggcgtctgcctgctgccaaggtctcctcctcccgccgccacccggagtcgtgcgacggccagcggaggggagagcggagcagatcacgggcgcgcatggtggatggcgcgacggggctgcacaggagagggagacgaagggagacggcggcggcgggggaggggtcacgggctaagagagaggagaggagagggggaggagatggcgtcggtaggccgcgtcggcggcagaaattacgggcggagcgtttcggtcttttgggagggagaggagaggtgaggtgggagcgatttgggacgtaggatctgagagagataatctggaccgttgagtgatgaatgaaagaatgagtgaaactatttgtttaactataggctagatagactagatagaattatttaataaagcatattgaaacatataaaattagttattatgtaaaaatttagcttcaaaaacttatacggttatagaagtttaaagaagactaccatactactttttctttttatcaggtctacgccttctaatggccagaaaagtattcattatatcttcttcacccactttaaagaaaacatatttgttgtatacttttgaagaagagatgcaatatcttcatctttcttcgtgattcaacaatctataatatagtactacaatttaatattacaatgtacaagagttcaaaaattttaaatctagaaattaaaaaaggtacacaagtggaaaacctaaaattgttggtgcaggcggccagacgtcggcggcagcgcactgcacacaagaaggcagatttccgtgagtatgtgactctatttttcagttttactcggctcgacgacggctcctcgcggcgggggcacacacagcagcagtgcggcgcagtggcagccaaggcggcagactcgcgtgcggtgcagtgtgggcgtgggaggcgcgtcgtgcgtgggccggcgacggcgcggcgtggcgctcgctctaatcgcgtgatcaaatgagattgcattgacgcgtcgtgttacgaggctagggcgaggaggagagagtcgcgcgacacttctgttctgatcaatacacgcgcgtgtgggcggcgggcgccatgaatcaggaagaaataaggatcgctattttccttttttaaaaaaatagtcactattttctttctttttttttaatagtggggtcgatcgtcgtttgtttgccccggaccacctatggtccgccattgaggattcaatctatagtcaatcgaagtaaagagtcttcctggtgataaattacttacttaactcaatggtgctttcatacgcaggagtcattgattcaaatccaatagtaggtaggttggtagaaaaattactagatagcattggccctacttcgcttcgctatctaataactttttctacccctcttctctttttctttgtatcaactaaactgttgggttgtttttaattagatggggaatccaattaatagcctcgactcgtatcctagctcgtctgagagctagcttcgcttcaaccaattttttcgtaccctcagctctactcacgttagcttcggctattccaggaatacgtaacctattttactgctgattatgtgtaaactgcttctggcgacggacggtactatctattctgtcaaaaaagttcaatagtagttttttaagcaaatcatgcaatggtttttcatttcatccattgacgtgttgatcacttaaaagttagttctcggaaggagatggactaatcaccttatctcttctttctataaagttaatgcccactaaacacctaaaatttatcatacaaacatactctctccgtctccgttttttaatagatgacgccgttgacttttaaacatatgtttgaccattcgtcttatttaaaaaaatttatgtaaatgtatatatataaatcatgcttaaaatactttaagtgataaaacaacttacaataaaataaattataattacgtaaattttttggataagacgaatggtcaaacgtgtgataaaaagtcaacagtgtcatctattaaaaaacagaggtagtagtatttattagtactcctaaggctgtgttcgggagacaaggttcctaatcttgccttccaacacgaaaaacaaagcccacgcgagattaattaagtattagctaaaaaaacttaaaaaatagattaatatgattttctaaagcaactttcatataaaaaactttttaaaaaaagcatgttcatgtaagcatagagtaaaacaagggaagtgaattaggaaagagggaaaatgaacacagcctaaagtctacatgcaagcatgccacatcaatccatttagcacacaaagctcaacatgtaagcatagagtaattatacctacaatttatttcattataaaactcaacataacatgctaaatcatcattctcaaatcattttcataatatttcaatacaaatcatttcatcatttctccaatatttaatatatatcccatagcaaagtacaaggtatcatctaatattttattatttgtgtggtatttgtgcgaactttacgagtctcggggtctgccttgtgcacccaagcagcgacaagtacatcctctaattagagagcaggtacaatagaagactataagctagctacaaacatatatcgataagataaaataggagagagaagcagcggactatagatctatagccagctacagcacgggcttcaagatataatgtgtgtataacatatgagaccatgtattaataatatagtatatgtttataggtaactattgtatgaattggctattaaattggatatagatgatttgaagccattagttggctatactattaaacttgctcttaactaatgcaaaattttcatgtaatcttcataagctgctaggttttgttgataggattatttgtagtatcttctgatattgtgtaggtaatgccgattgaaaaaaaaaaaagatgaagttgtatccatagctaatatctatatgttcctttagtggcatgttgggatcgtgggaaaattgcatgagaaaatgcatagtacggcaatcactgctactccctctggtttaaaattttttacgttttaaacaatgttaatattttctaacgtttcaaacaaaggcactagtctccaaaggatatatttagctacaattttctattataacctatacaataaataaaaaatatttatttttattgtagtacttttcaaaactaattaatctatatatgttgttctagtgcctttaactaaattaaataaatagttttatatagttttatagtaattgatagtcaaagttcaaaatattcgatctcaagctttttcagagcgtccagagaatattgataacgtaagtagtacatgccacttggatctcagcatagaatgaagcgtgtctgtcaggttggcttcaccgccaccactacatactttttaagtagtaaagataaagatgctaagatttgtgcactgtgaaagttttgtatgtagttttgggtttttttgattgtttgccgagataaaaatattgtttctttccttgtaaccgaaaatcccttttataaatgtaatctatttccatatatttcacccatgtacggctcggtccccaccaccgtaaaaagctaggtcgtgtagtcgtcgtcgtcctctcgtcgaaaggttggtgggcatggacctctcctcgtcgttggcggcggcggcgtcggcgtcggcggcgtcaccgtcgttggccaaggcggtggacacctacagaaaggcggtcggcacggcggccacgctgacggcctacaccgtgctggcgcgtggcatggcgagggagctcgtgccgcacgacctgcgcgcggcggtggcatgggcggcgtcgctcgtccgcgcccgcttcgagccccgccccgcggagcgccgcaccgtcatcatccggcgacggcgacccgtacggccgcggccacgagaaccgcgtcttcgctgacgcccactcgtacctcgccaccaagatcgacccccggtccatgacccggttctgcctcagcggcggcgcctcaggcggcgagcgacgcgcgcggagcagcgtcgtgatctccatggttcccggcgactcgatgaccgacgtgttcgagggcgtggagttcacgtggacctccgttcccggcgagggcgggggcggcggcgggagatcgaacggcggcggcacggcggcggagtcggactcgagggagctcagcttcgacgcggagcacacggacacggcgctcgacaggtacgtgcccttcatcagggacgaggtggagcgggcgcggcggcgcgaccgcgagctggagatcagcatgaacgagggctcgtcgtggaacggcatcgtgcaccaccacccggccacgttcgacacggtcgccatggatccggccctcaagaagcagttcgattttaataaaagtcaaaacatcttgttaaccttaaacgaggaagtaccttataaatgacatgtgaaaacgaaaggatatccacttgagggatgaatagtgtttcccatgccaatgaggcaacgacgtttgttgtttgtgagtccaggagaaggagaagctgacgctgtccgggctgctcaacttcatcgacgggctgtggtcgacgagcggcgaggagagggtcatcgtcttcaccaccaactacagggagcgcctcgacccggcgctgctccggccggggcggatggacaagcacgtctacatgggccactgcggctgggacgccttcacgacgctcgcccgcaactacttcctcgtcgacgaccacccgctgttcccggagatccggcggctcatctcccaggccgaggtgacgccggcggaggtgtccgagatgctgctgcgcagcgaggacgccggcgccgcgctcgccggcctcgcggagttcctcgaggtgaagaagaagaagatgaatcaggccgccgtgtgaatgtgaaggcgagtagcgtcgtcgttgcatcaagaacagtcggatgattcagttcttttgctcctaatttcatgtgaaccgtcactgctttctgaatctctgattgttctggttctctcctagctagttaggaactaatttgggatgattgatttttgtttcaaacaaatttcggttagttgattggtttcacaatttttttgggtgattattgtattcgtgattggataatctgtcctccacttgggttatgtagagtgcacaaactgattcagatttaagtatgttatccattatgcagaggaacaagttagctaagaacaccaattggtcctagcttgtttcctcttctgttctttcacttgagagcatcatgtttcaattatgatcatttttagtggtgatattcttcagggacaagtattataatctcgtagttcgtattcgttgtatcttaggttcagggtaggtaagtgtagatgttaggtgggtagatgaattggggtgctcgatgggagagtgaggcctgccgccccgctttcttgattaccttcaaatgactgtcccaatgctagtaacaaccctacgtaatactccttccgtctcaaaatataacaacttctagcgtttaaaatttgtcctagaatataataacttcttcacatatattctcttctcaaccaatcacaatcttccacctttcaaattctccatcaactttttttttcccaaccaatcacaactttcttccatttcattctacttactttcttaaatattaatacccgtgtataaacctaaaactctagttggcgcgtgcgtggctccggcgcacgttttctgggactaaaagttagttaactaatcaattagttttagataattacagtatgacataatgacattagtaattaggatttttcttttttccacgagatttttttacctaacaaattgaaaagaaatcaatatctgaagtctaattttcaaattttaaatccagatttgaaaattttaactcaaaatttgaattttttaagtcaaattttgaaaactttcaactttccatctcaaatttgaaaaactttcaactcaactttgaaaactttgaacccagatttgaaaactttcaactcgagatttgaacactttcaacttagatttaaaaacttttcaactcgagatttgaaaatgttcaaatcgagatttgaaaactttcaaatcagatttgaaaatttttaagtcaagatttaaaatctttcaactcaggatttgaaactttcagctcgaatttgaaaactttcatatcaaaattcaaaacatttctcttacatttaaaaaacattcaaactaaaaatttaaaacttctaactacaattttaaaaacttttgactccaaatttgagttgaatcacgtgcctagattacaaaagttcaccaaaaaatcaccaaaaagatgttgggaaaagagaaaatcatgcgcatatggaaaaaatcgtaaaaaaaaaaaagcctaaaagtcgcaagtgggcaacgcgcgcgagatagccaactaacgcgtctgcgcgaattagttttttcggcttggagtaatggagttggatgcatatgctgcagatgcactacagtgggaatgcaaaaccgcaagcaaaaaaaaatgaacgccgttgccggggatcgaacccgggtcacccgcgtgacaggcgggaatactcaccactatactacaacgacttgcgtgtcccctcgttatacagtactttacttctccgcagtccacacgaagacgattgttcgattgttgtagccattccaggcaatcctaacatggttgctgctaaaacgtttcagcaaaataacctccattttttttttgtcatcacaaatggcgacaaacatatgctctccacttttttttcgcaggtagaactacaattgatcttcaatggacatcttaaacacttgttgatcattttataaataaattgattaactaggccattaattgagggttttcgttagttggccacggacatagcaaaagcattttctatttttttaaacaaacaaaactcaaattactatatgtatatttacaattaaatttattatttttgttacaacttatagaagttgaatttgaactggcatgtttatagagtgatatattacatattaatctatcttgtcattttttaaaaaaaaattcgtaatcatctagttgatatgcaataagcgaatgaacgttcactcgagctattagaatccatctccggattttaaaggatgtttgcacgacttgaactaaatcttgtgaacacgctataaaatacttgtataatagcctaataaaaaatcatacatatata

SEQ ID NO: 9898 - DNA, 1049 bp, Oryza sativa
tccctgtaactaactaaccaaccgcctctgggacccaccaccaccaccacccagctcaacccaagaatccaagaactcgtgcgctgcacgcgcgcgccacgccacggccatggcgacggaggcggcgccgctcccccacctgctcccctccttcggctcgccggcgacgacgcctacgacgccgcgccaccacctcgccgagctccgcatcgagcgcgcgcactccgcggtcgccttctccgcgccctgcgacgccggcaagaagcggcggtgcctcctcccgccctcgtccccgcgcaagaaggtgctgctcgagctccaccccttcggctccccgaccccgacgccctccccggccaccgctccgcctctgctttcctcgcgcgcggggacgcggggttcttgccccgacagcgacttctccttcccgttggcggtgggcgggacagggggcggcggcggcggcggcgggggtgggaacatgttcgcgttcttggaggacgcgccgagggcgccgacgacgccgacggggtccagcggcagcagcgccttgtcgttcttggtgtctccggccgcgccggagacgcccacgggctccaccgcgagcggcgggttcgcgttcgtggcctcgccgaaggagcccacggcgccccccggggccttctcgttcttcgcctcgccgaagcaagcggcggcgaccacaggccccacggccaatggcggtttcacgatcttgggtgcaccggagcaaccgctgacgccgacaggctccaatgccagcggaggctgcggttccttgtcgccgaaggagttgcacggcggcagcgccatcgcgcccttgccttccccgacgccggcgagcacggactccaccggcagcggcggcttctccttcttcccttcgcctgggccggcgttcggaaccgcggcttctccggggctcgcggcggccaatcagtcgtctcccacaggcggcacctccccctcgccgccgttcgtcttcacggcctggccagcgcacaagtccggcggccgaagcagcagcaaca

SEQ ID NO: 9899 - DNA, 661 bp, Oryza sativa
ctgagaactgaaaaaaagtttagcagaaagctttatgccagttacttcctgactcctctatagggcagaacattgtagatttgtagtttcctcacatgttagcgtgcaggagaatttcgaacaaagggacatactgaagtagtattttgtccaaaataatgtcggccaaaggagatttttcacctttttgcaaatgtcagggtctaactttggtgttggagtgaaaaatagctgcagattatgtttagtttactttttagaactcgtgtgtataataatatcatgttttttcctctttgcaggaccatctattcgacaatcagttgaaactgctgaacataataactgtgctttgaggtattgacacaaatatttatttcatactgaataatgtgaatgtagtatttcttagttattgaatctattagccatccactaggcgatgcacatagccatctatctctttaggacacctgggttgaacataaattgtggtcaccttggtcacctttaattctggccaaaataacataatggattaaggccatattcataacactcgatgattttttcatcatttcacaattttacaaaccaaagtagcaattcaatcttaaaacattcacattggggtaggtgataggaactgttggcgaatatg

SEQ ID NO: 9900 - DNA, 859 bp, Oryza sativa
tgtctgtattctgcaagcatcaacgcacttccaatatccattctttgcctttctgaaaacattgttctcgtcatcatagcatagctggttatcaggccaattcaagaaccaaagggttcctgcagatgagtactgcataagcaaactacttgtcccatttagcaaagattataagcctcaagtcattataaccgactaaaagcatgattacgtacatctcacacaaaacttgcagtcatatccttaaactgcatgttaacaaattgaccaccagtgctaattagtaaataaatatatgcaagatattttattcatctgaggtccacataattgtatagtgagaatggctaacataataataccaatactctataatgtggatatagcacaaaaacttaggtgcaaattttaacgcagtaaataaattcaagtgctctatcttatccatgatctggttaaattgaactacagtttaggaggtcgtttccaactaatggaagaaattaaacagataagtaccactgtctagtgattctattagtactagaaagtagtgttaaggatgtggtatatatatatgtagtagtcaagggttagagtattatggttttttcccatgttaggatggaacgcctgatccatagagttaggcccataaattgagtaaaagaggtattcctaacatgggaaaagaccatgataccttaacccttgactagtagtacatatatacacattgacgcattattatatccttaacatttgcatgcatgaagataaatccaaagataaatgcaatatatacacattgatgcattattatatccttaacccttgactagtacatatatacacattg

SEQ ID NO: 9901 - DNA, 2761 bp, Oryza sativa
gcagcaagtttgaggcaactaagagcctagtcttccacaagcatgatctaagttaatggcaccccaagatctaaaaatagaagtgaattgatttctccttaatctgattgttggtactatctggtagaaaaatccaatactgaccaaaatattctgatcaattgacaaaattgggcgacacaaaacttgtagataccataagagctcttccacagaaaaccattttatgcaagtaatcattagaaatcatcagttctgtgcaccagtgacctgttctgaatagaactatcgacccattacttgtgtgttgttatttttgtactgccaaacaataagttaattaaactaaaataacagctcaaaggacaattagacccagctccagatcaataagtgaattataaaaataaatcataaaaatatcataatcagaatgcgagaatgactacaacaacaggaacaaaaatgtgattacactaaccaggggagtcccgtggatcaatcatagtaaggtcaacccccaccagtatgttctgtggaagaggatcccatgtttttctctcagccaagaacatgatgatttcagtatcagaccaagagtcccccatagcaatgccaagtggtggtagtaccctagaaaataactccattttcagcaatgcactgcgataagatgcaatggtgtttctggtccaagaaaaactacatacatgctatgttcctcaaaaaaatatctctgattgaacacacttctccacttaaagattcaagaacttgcaatcccaccaagtagaataaacatatagctaaacaaataataagcagggttctcttgtcagactaatggaagatcaagaaagtacacatacataaacatgaagaaagaaaaaaggcacttgaagttttgtaatgacaagggccatgcagcagattcacagttggacagtaaggtgatgacatcaattccagccagagttaggcagaactgggggcaatggaggcagcattgacattctcgtgttggaggatggaacaaatagctagctgaggtaatcgtttgccaatatcatctaaatccaaaaaaaaaaaaagaagaagctaatggctagatggagaacagcaaaccctgtgaacaaaacactcatggcatgaatagacaagattaaaacccagcctaactaacaacaaaacgaggaccacctaattaacagtgatcaaacttcaccataataactaagtgaacaagaagctggctaacaattcactatgaactgaccagctgacagggatgacaaacacaaatatctcaataaaaaatcaggattcaaaccaacagtctctgcctaaaaacaataccagatggataatcaacacaatctccagtttctccacacatgtcaccacaatgcaggagcacaaatacacaatctacataagtaaaggactactactaacatgtcacaattatcacaattcacaggttacactcaccaactcacgtccacacagatatgagatattagtagattaacaagtagtaaacaacaatatccatgagcatgaaaggtaaaaggagtgagtgcgaagggcatgggggtgaaccggagaggcataatctgcgaagaagccgaggctcgatgtcgacgacgaaactgacgaacaccctggggtcgccgtcggagcagaggaaggaggtgcagtagggtaaccaagcacagaaatccacgtactctacggcggcggtgatccttcgccctagggaggccagaaatggaggagcggcgcggtgccggcggcggtgcccggatgcagaggatcgagtggattgggaaggtcgcgggtcgccggtggcctccggcgaggggagcccggcctcgccggcgccgacgatgacttcccgcggcctcctcgccgcgccttggcggagaagggagaggaggggacacaaactttgggctcaatttggcgcttgcggcgcgatgggtatttctagggcttagcggtcgtcgtatattttcattttactccctttatctcttcaaaaatacgaatacggccttccaaattagatttcttcgcccgcagctctgagaatccgacctgatcagaatacaagattaaaatcgagccccaatagcggtcgatttatcagattaaaatcgtgcattaaaatcgagctctgagttgcgcctaggaatgcaacgaggcagaaatatcaggtggagtgcgcatgctcttcattttgtatgcgtatcgaaaaaaaacacttttctatctactttctttattttaaaatgtataacgtcatttactttttcgcataacatttaaccatttattttattagaaatatatatatatatatatataatttattttttgacttgttttatcattaaataaaatataatcctaacttatacttttacatatttatactaaacttttttttgaataagatgaatggtcaaatgttgtaaaaatattaacaatttcatatattttgaaaaggatggagtattttgcaaaaagaaaaaaatagtagaaaagaatggatggaaagctagaggaataagttcaccggaggtccctcaacttaacagtgagattttttaaggtcccttaaccacaaaaccagaaatatgtacccctaaactcacacaaaccgtgcattcaaggtcctagggcaatatatatgggtggtttcgttgatgtggcatcctagtcagcaaaaaaaaaaaaaaaaaagtacgtggggcac

SEQ ID NO: 9902 - DNA, 1183 bp, Oryza sativa
tccacccaccgccgcctatcatcgctccgcccgcagcccggcgccgcttcacgcactgcgctcgctcgccgttgcccatcgccgctccgcctactgccgcgctcggccaccgctgcccatcaccgctccaccctccgccgctctgctgccacgcgggcctgccgcctgcccattgccgttccgcccgccggccgccggcctccctcactgaagaggaagagaagagagaaaagagaagagaaggagaagaaaagaggagagggtggctgacatgtgggcccacacacttttttttatttttttttactgactaggatgccacgtcagcgaaaccacccatatatactgcataggaccttgagtacttggtttgtgtgagtttatgagcacatttctggttttgtggttaagggatcttaaaaaaatctcgctgttaagtcttaaacctccgatgaacttattccaaagctagaggagaggagcaggcggcccaaaaagagacacgaacttggcaaatctcaaaagtccggcccaagcgtactggcatatcacaccgaccaccggcgcggcacggcgcggcgggggcggaagggcgggaaaaagcgcgcctcgccgctcacctcaccggaaaaggcggcggcggtccgagggcccccgaccccagggcaggggccactgcgctgctcgcacgcttcaaggtgcggccccgagcaaccgccgacggcgaatcggcttctccgggagcttgcctgccttgccggcctccccgtctccccgacgacctcgctagctacgaccgcagcttcggcgacctcctccgccgcccttcccgacgtcctccggccggcgccctcccgcgcaacaccactggatcgacgtcgtcctccggccgtcgccctcgccggcatcccctgacccctgcaggctgcagtagagatcggtggtgtgtactagacgtcattcactcgctgtcctcgttcagatcgactgcgaggtggagaagccctggtgccgtcatcctcaagaacggagaaccaccacagtacaccggtcatcgtccccagccgtcgccaccggcccaccgccgccgccaactccagtaattctttgtgtccactgtctactactccctacttttatatttcatattatataagtcgtttaacttttttactagtcaagt

SEQ ID NO: 9903 - DNA, 2726 bp, Oryza sativa
  unsure (1)..(2726): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagagataatcacactaaacttacaaagttgggataacaccaagttgcatcatataaaatcaaatcgatggatggcaaagtgcagcaggtaggggatttaacgagagctttttgggcatatgaccgaatggaacagccaaggcaggccatgtgggtccaaggacaaaagcatgtgaactcacattctcgcatcacagcacaggaagtgccgactcaatgagcttttgctttcagaatgtaatgcagaccagggaagcctcccctagatcatcactattgcgttaatggtggaattcgcactccaacctcttcttcttcttgcctcaaaccaatgcaaaaagatccaaacctttttggtcagttcagagtttggcagggaggagaggataggtccaaatcgaaaagaatagatgataacggatcaccaattctttttgaaagatggactcctaccacttcttatgtctcgagaaaaatgtgatcttactcatgccgaaccttatgtaaacttgtgaaagcgaaagaattgtttacattctaatgcagtgactggtccaaaagtggactcctatttatttttacagagaacagttcttgattaattatagctgcaaagatctcatatttgcttgctgaaagggcaagaacaaggagctagtaacagcacaaaacccaagagatcgtattcccatttttggcttctctactatacacattggtgtgcaagaaacttctgaagaaatcaaagaagcagcagaagacagaaaagcattcccctagttctgcacccaacccatgtctgcatctcaaatgccaaacgagctactactaatcttttaggacgacgaccagaagaggacttgaagaatcgacaaaatatgactctgatgcaacggagaacattaatacagccgtgccggccacacaagtttgagctgtttctttctttctacaatcaaataaagaaaagatggaaagaatcaagcaagtaccaagaacacatggccatctcctcgagcatcccgcgatgtgccatcgatgatccgttccacgccacatggatatgaataaaagcgaagcgaatcgtatccggcactcccaggcttggtaatattttttttagaggagattgtatgctaaattttttttatatattaaaaaaaccattgcagatatacgtaggttacaaaataccatcatactatatgaaaataaccgaatgacatctgagttctagacccacatgccaatgacacgtatcatggtatctttcaactctttgaattttgtacggatatataaacattaacatttgtaatatactgtgaatatacacaagagtaattttcataaaattataaatatttgatcaaattatcacaaaactacagattttatcagaaaactacatatttaagactaagtatcacaaaactacatatttaacaataaaattatcacataattacatatttcggggtttaaatccttagcactaatattatatttgaattataaacatccgagttttgtctaaattgatgctaaatttgtatttttatgataattttgttagtaaatttatagttttacaacactcaaccttaaatctgtagttctataataaagttagtattaaatctgtagttttatgatatattatcttaaaattgtagttatgtgataatttaacaaaagtatttgtagttttatgaaacttaatataaatataatggtatattaacacttttacatgataggatactataagactgagtttggactggccaattagaaacacctctataccatgaaaacgtacgactcattaatacatgattaattaattaattattagcttaaaaaaattttaaaaaaatgattaatatatagaattattttaaagtaatctttatatagaatttattttttataaaatcatattgtttagtagaaaacaaggtgtaaaatttgagaaaaagggtagcatcagtttcattcaaaggacaaggactatccgatccactggtccaatttagttagcagaattaagatgagggatgctgttgggtagtcctccagaaaccagagcgttaacatcagttgcatcgccgcgccgtatcggaccaatcctttccatttccattgtttctatcaacgtggagtgcctacctgctcgtctcaaagagatcgagaggcagcacatggctccgtctgcatgttgccgttgccgccggctgcatcgcaacgcgtgcctccaacgataacgacaatgtaaataacgtttctctcaagactgaaacgaatcctacagcttttggtccccgaaaactcgccaggttttcctgtgcctctcgtccctcgtcgacggtaaggaccggattggcaaaatcgcaatcccggacatgaatgaagcagtactagcttcattgatgacaacacaccttgtcgtatattttcctctctgctcttcatctcacatggctgca

SEQ ID NO: 9904 - DNA, 3391 bp, Oryza sativa
aagctttggaaacttgccctgatcctagaggacaagtgatgctcacgtgtcgttgctaacctgcgtactagtggaatatcatttttgtgtttcttctgtacagtgtacagttgggaatcgaccagattaggggtcaaatccgttcaccagcttggctatactttgctgtgtttctgcacgggtgaaattggtagcgtttgttcgtgttaccacctccatgttcagctaccgttgggtcgtctactgcacttaacgaagatgtaatctcgttcaagacatttgatggatcctttaatttccaacttgtcactcacacactcatcacgcatgattatgttcactcaatcattaggcagcctccatatatgacactagtttctacgtctctagtacgatccattgacgtgattgtactagaaatgctcgagtccaagatgaaaaaatgtcttctcgaagatgccaatctgaataaattgtaaggtacgtactaacctccatttgtctacgtctctacgatccatcgacgtccatcaacatattgcactagaaatgctcgagtccactatgaacgcatggctttctaaagatgccaatctgaacgactgtacagtactagctagtattccttccattttatattataagattttttatcattacccatatttatatatatgttaatagattcattaacatatatatatatatatatatgaatgtgggcaatgctagaaagtcttatgatatgaaatagaggaagtagcttttttttttcttttctgaagatgcacgcaacctgccaccggttgctctgcaccaaacctacaaatactactacctccttcccaaattagttgacgttctagattttttggtactacatgctaagatttggagtaaaatattataatgcctttatcaaatttttcatgaacgcacaaaaagttcacgcgtcaatatactagaagaaagcagagttttggttacacaacataaacggctagaaagccattgccaggggacgaggaagaaaaaaccggaaaagaattgtttaaggactagttaaagaggataaaaactcctagagcaagagagggcggagccccactaaactcccagcaagtccccaaaagcagcaatgccagcagatgatcacaaacggtcttccggaaagatggacttcagctccactgaaaccgaagagaacgagtgatcgaaaactataatacaaataatgcatggttgagcatataagcataattgagggtagaataagaataaatttaaataagatatgattgacttaaaaatgataactattatgagataaaatttaaatggtaaaaagacaactaatttagaacgaaaacgaaaggagtacttctgaagcctgcatgtgattctcaggctggcttatcatttgcgatagctgtggcatattaggctgcaacggtacaacggtacaacctagccgccgctctgctgctgctcaaaagccaccataggtcaaggaaaaaaagactgtcctaatttttttttaaatgttcattgtgattcttagaaagaattgacagatagtctaacttatgagaatatgaataaactagaaaattcagtttttgactaatagtttatttttctaaattctataactatattgtcttaaaatctagataaaaaagttagactatttcataaagtctttgattatgagaaaagttgtaatcggtagaaactctctcggacaggtccagtatagcggctgctgctgcaactctaagataaaagctttcttaatttggtcacatatggcttaatcagtgatagttacttcgttagattggttaggtcgatgtcagttgacaagtacaaatcaaacatgtggtcactggtcactacgtatgtgtacaattcgcggtgatttggttatgtaactgtagattgtataaggcccaaacaaaggcccagttaataattgggctctctagttcaagggccacgcgaaggcagacacctgctgaagtctgattccaaggtccaatcaaagcttaagaggatactaggcacagaaaaaaaagttctactcccgttttttaatagatgacaccgttgactttttatcacatgtttaaccattcgtcttattcaaaaaatttacgtaattataatttattttgttatgggttgttttatcactcatagtactttaagtgtgatttatatcttatacatttacataaattttttaaataagacgaatggtcaaacatgtgagaaaaaatcaatggcgtcatttattaaaaaacggaggtagtatcatttttatttctttacctgaaagacgcactgtacactcacatatcaattacgtatctaggatttttaatatgggtggttcaacttatataatatttttaaataccctaaatataacaaggttagagatataaattgatcaaatgtgcatcataacatattaataagggattttttttctttttccaaaagtttcttctcacatatttatatacgtgtattgggcagttgggctagggtttttttcccggaaccaccagtaccactcctgatccgcctatgatacacatacgtgagtgcgagtgcatttcttaacatatgcttaaaggaatagaggccttgacctcatttaaatcctatagaaaagcataatattcatgtgtattaggattttaacaatagtgataacagctgtacacccatgaatctactactcgcatgctttcgtaagaagtttttttcccccttaaatgtgctgagacagaattttgaattaaaaaggtcaaaggtaaaggtacaaaatcccctcgaactggaagttgaaaggtgccatatccttcaccgaaagtgtaatttgacaaggtgatgaaggattttatgatggtgatggacgattttgacgtaggataggcattccacggattgacaaaacacagaaacagcttaaacgaccacaaaaatatccacacccgggtccacctgtcagttggaaagaaaccccagttctgtccgtggatgtcagagagacaaatcctcggagtcggatgacacgtcggtgtcgcggccggagaagaggtccatgcagagctcgccgtagaagcggccgacgagctggacgaacaccggcgacctgagcttctcccagcagcacaggagctcctcgacgtccatgaggtccctcaccttcctctcctccaccagcatctccatcagatgcttctcgaagcttctgcacgcctcctccacgccgtcgtcgccaccgctgctcggcttcgtcgacgccggcgcggcctcgccgagctgggcctgcagcgccagcacccgagcggccgtcgtcgacgcgggcgtgtcgagc

SEQ ID NO: 9905 - DNA, 25240 bp, Oryza sativa
  unsure (1)..(25240): unsure at all n locations
ggacatgagtggccagaacaccgcgcggacggagctgaagctgccctccgcgcggcggcgccggcgccggctgctgttcatcttgcccacggcgcggcggagcagcgcccgcgggcgcctcttgaagagcgcgagcatcccaccgcatggattgcactgcaagcaacacgacggcgacggcatcgatcgatcgatcaaccgcagcgcatgcgacgcaatgatacgacgccactaacgacacagctcgatcgtgagctttacgccatatctcttcttcttcttcttgttcttgggcgttgcatgcagtagattatcaaggactagtgggctagccaccaattgtgcattcgcaatgtgcgtttgttggttgctggttttgagatcgatttggttgttgatttgattgaatcggttgagttttatgatgaggcgaatgcatagtggatttgcgggtggaggtggagttcacgtagaggcagagcaggcgagcgacagagtgggaggacacgatgaaatgagttcatagctagcacagacggccaaagcaaagcaaattaaaatgcaaaattagacagatcgagtacgtgcatatgcagtatataccaatttaaaacatttaaccagcaggagccatgctgtatatgtgacaaatctaaatgcaaaattttgcgttgaatgttatttgtcgttaggggagtttaaaacgacctgatgatcgatcaataattgatcaacttacatatctatgttagctagcaagctgaacggattgaacggattgtaagaggcttccatgtagcgtgaaagctgtctcgtttatatttgcctattttttttctctagctagctaactacagcttgagaatttgtatatctgtactttgttcgaagcatcatagtttttgcagactatttaaaaaactattagctcgttattaccatcctaaacgtcctctcttctgtgtactctaaaagttaaaaaaaatgccaaagtgaaccccacatttaaatgtgtggcagacagttttcggcatttgaaatgttccgtcataggaaatgttcaccgtaggcccaatggcccataagtgcggctcgtcattcggaactgatgaattggactggtctgaataaagcagacctggtccagggctaagtaggccttggagatgtcttatgcaggaaaaagtctactgtggctccctcaaattaggtaggatttgactggtatacctccataaaaaaaaaccgagtgtatcgctcatctcaactattaaaatcaatataaaataattggggcctagctatccatcgcgccacagatttttgggtccaaatcacacagattttagatagttggattaggctcatttgatcacttgattagaagagtttatatatgtatcaacatatattaattatatatattgcatatattttatttattagatctttacttcgcaaaaaaaatatcaccaactcatctactaaaagttactgtgtaattacactatagttacagtgtaactacactatagttacactgtaactatagtatacttacagtgtaactatactgtaactatagtgtagttacagtgtaaatatagtgtaattacagtgcacttacatatcatatcaactgaacttacaaatgtaattttagttatataggactgtaattttatattttagtttcaaatgtgaatacagtataattatatgtaattacattgtaatttgcacgtaactgtacgcttctcgtgctcagtggaggtcacgggatttctctcatccgtatctaagtagagttaacatttaatcgcttttgttgtatagtaaaaacataaaaagatacgtgcaagacattactgggtcacatacatgcactgcttccccgtacgtatgtatgtatcacttacatgcatgtcacgaaccgctgccaccaacgaggatatcacgtacgaacggcgcgctgcaccgttagaaaaatcgacaaatattaagaaaaaaatttgacgacaaatttctagcaaaaccaaataattgttatctattttaacagtggtttttactaacgtgactcgttaacctactctaatagccttaaaaaaaatagggacaagctcacacggcccaggttccatggaacataagaaaaggtgggtcaatttgttgcggaggcggcgtgaaaagttgaccttgcgggcggcggatggacagcacacagcggcgcgtaataatactgtccttggcagcatcacttagcatgggtcgccaacgaacgacgtgattgtttcggccatagggtcgagcatgatcgcgtcgtactatacgaaccggtggtaaaacagccgtagtacgtacacatactagcgcatcatcggtggccggatgcaagtcggcactagctacttattgctctcgaactcccccaaatcctctctcgaccgccttcattcctccaatcctccgtgcttttgttctctagactcgaatgatcgagatccatatgtgatgtgtgccgttgcgcccactgcatgcagcagaagccccatcatggcacggccggccgatcgatcaagtcatcaaacgccgtagagccggcccgtagagtagaaatcactgtgcactaggtgacactgaatatatatacatgcccagtgcgcgcgttggccaacctcctttctatggcagtgaccagatcggtgcatgcgtcgacgtcgttgcctgcccactgcccaagtctcgcccaaggacaccggaaaaagcccacatctccggccactcgcgagtcgcgatcgagcatcacatgcccacgacaccggagaatatatattatttcctcgcggacgacgcagacggctcgtacgtgcggagtaaacgaggccgatcgangtcgatcgtctccgcgcgcggacgcctgaagcggcgggcggtttgcatggcgtgcgcgcggttgcaatgcacacacggcttcgatcgatcggcggatcggcgcatgcatgcatgcggaaagcggcagattttaaagccgagaacgcggtcgggcacccaactgtccgcctaaaactcgctccatcgatccatccatcgcccggtccccgtcgtctcggaatcatgcatgcatgcatgcttgaatgaataatttgatatacgcatgcgtacgcacgatatttcctgaccagccaattaaccagcacacgtatatcactcgacacgacacgtatagatacgttcctacacacatacactcgtatacgcgtgtactgtgtgtacacatgtacacagaagattgatatatgtatgtagtcacatgtgcatggctggacagacagtgttcttcttcggccgaccgtcgttggacagggaattcaatgtcgacattaactcatggccctgcacatgtactattgcatcgtctgtccacaaatttactcctaactccatcgatcagcacatcatcaccactgtacaagtaccatgtagtacgagaaatgcaccacacgccgccgcaaaggtagactctgttttcctttttaagtcgccttcaggaacccaggtcttgcattgttacacatccaatcgatcaatccagcagaaatcgattgaattactactgcttattaagattcaagtagtaacagtgctagctggatttctgctacgtattactaatcgatcaaaccagcagaaagctagcactacgtagtgctatagctggtggtgtgtgtcagcaagataatatatgcatgtaggagagtataagattatccgctgcatgattaccaccaatgatagataaaccccggccatgactgaaagtcttaaactttactttggcatataaacttgtcatccatccggccgctgggtacacacactatagttatatacactagaaaggataatgatgatggcgttcgagtaagatttgcaaagctacaatcatggcacgggtctttcaactatacctactccaacaattatttatctcttcctacctaacgggccgcgcccgaacactatcaatccatctcaattattcattatctacttgcatacctccaaactctgcatctgtactctgtcgctccgatagaggaatttagggtgctgtttttgtttctactagttccccatgctactactatgagttttgatctcatcgatcatagatagctaggtatcgaagctaactcgctagggcggtggttgcttgctcccggcaacttgtaatcgacaattttggcatggaatggtggcaccgcacgaattgaactaaactttggtacgagcagcactgatccgcgcttgtccagtctcttgaaataagctcgccgtgtccccgcaaccactggcagaatgatccccccgtgaggtgagcctcgtcgtcgtcgccccggcaaaacgcgcagcgaaatcatcagcgcgatcatatgccttcctgctcatcctgctcaggatgcgatcgagaaattaagaacggacgattcctctatctgctaatcttggctctcgcaaaactatcatctcttcaggcttcagcagaagaatttagaagacacatgtatacagattatatattcgagaatcgtgaattttatagtacgtgaactgttcgctgcataggagctcctatagtactgtagctgttttactgatccattgcagacaagcgtgggtgagcagtagttctagttcgtcactggagctagctagctgctagtctgcagtaaaaaaaatgtctaccggttgctgtgcgtgcacacatgtctgaacatctgatgagcagttcaatactggtgcattgtagacatcgagaacaacagcctctgtaggttttgtgtaaaaaaaatgcaggttcgaaataatctgttactgttgcagtacatgttctggaatcactacagtgatgaaaaaaaagatgcatttgtctcttccaccgcatgatcaacctcagtatagctgattgtttatgtggatttttcggggatcaccccgtgccaaggtataaaaaacagacggaaatcactcggttttcgtatagaaattgaggtttcgggccagctcaagatcacaaactgttcagtaaaccgatcaagttccaaaataaattagagttttttaagtcggtagtcgatgggtttcaaacgattttcgtaaaacccataaaaatcctcctagctagggcatttttttacgacagtttggttttgtgaacctttcccgtactaatttagagtaccaatttataattgtacagccgtacaggtgacatatccgttcaggggtgggggcaggcctagggcaaggcatacatccaaaaacttgcttaaattttattgattcactatgtaattttttttcagaaaactaatactccattagtcgagctttatcttagctctagtcttatgtaatttttggcttcgcccctgtacccgttggatagcgagacattcacgatgtcttcattaattttaagatatgacggtatattttttttggaggtgtttataaagatagagtgtatgtgtatacgtctatagagttaagcatacacgtgttgtgagcgctttgtgtttgtattatattttttttaaaagaaagggtggtatactgtttttgagagttcaaatacgttctgaaaaaccgaatgatagtacatttgtagttggatttttctcctgcgtacatgcatgttgtcttctgtaagatggaagcaagctacaaatcaaatgcaactgtagagtccatttgggctgcacctgcactacgtggtctctaatacaaccgtaagccaattgcattaattaagttgcccccacatgaggatcaaagcaaatcacttttgatttcaatacagtgattcgtggtagaccaaattttgaccttttgaaatgttcatgtccccttccaaaccctccatggaccatatcatagctctacctagcagctgcctctggaaatgacttggttcacactccataagcaccagcatgcagttgggctctcctgctgcagctcatgtgccaaatcgtcctggactcgaggtttagctgcagcgatggccattagagacaatgagaaacgcctgttacggcaggcttgtctcacaatgccactagcgaaaagctgaatcaccatcttggtctgcaactctgcatcctttcccttgccgtcagagagtcccccacagcttttacgcacacttcctccatttcaaacattttgactttgtgccatgcgtgttgcatgcaatctactaataaggatgaatctctgtcaaagtaaaattggtgtttcatcggtggacaaagcgtcgacaaacacttgaatttctacatttcttattttgctctggagagcagtctgaactctgaactctctgtatcatgcaccaacatatctttttcgttccaacaatttacaagcgtattgattatgattcagaagcacaaatataagagagaatttgtatagtatgtcagattcttgcaagatgccgctgccgcttttccaccgcaacatctctttgctgccactcgcggcaaacttttccgtaataaaaagtggggtgcaacctcgctgcacgcactgcagctcagctcacccccacagtccacgaccacactgcctcactgcagcagcagcagctacgatgccattgctgagctcgtggctgttccacaagctgcggcggaggagaagcgcggcgagaggagaacccgacgtcgtcgaagcggcgagcaagaagcagcaacctcccatggcggcggaggcggcagcggcgccgtgctcgccgtcgtcgaacagggcgttttactacttcgcgagcagagaacgctgtctccctccggctcgggccgccacggacaaccacaagctccgggacacccggttcccgcggagcccgcagccgaacgacaacatcgtgttcgacgtcgtcgccgtctcggcgtcgccggcgcgcggccagttcgacgggatgaaggcgatgccggagctcaggctgggcccatcctcaccaagcgcgccaccgccaagaacgacggcgacgaaggtgacgcgctggacagcggcacgagcgcggccgcgtcgccgacgtcaagggtgcggcggttcgtccaccacgcgaagccgagcagcgggaggcggaaggggcgggtggcggcgctgccggccgacgctaccagccggaggcggcggcggcggcggcggggccggtggctgtacgagagcctggtggtggtgaaggagtcggccgacccggaggaggacttcctggagagcatggcggagatgatcgccgcgaacgacgtgcgctcgccgcgggacctcgaggagcttctcgcttgctacctcgccctcaacgccgccgagcaccaccgcgccatcgtcggcgcgttccgccgcgcgtggctgcacgccgcgccgccacggcggcgccgccatcacctagcccgatcaagtgatcgagattattactacgtacgtaccagcaaaacgcaagattaattgctacgtgccctgtacagagtgaccatgcatgtgatgatcgaattcggtatgattaagatgatagtcgttgcacaaatcgatcgcaagatggtttgataaaaaatgtttgattcgtttgctcgatcgatcgtgctatgcttcgccgtgatttcgctgcggatgcaaaggtgaaggatggatgagcgcacgcgcgtgtgtcacgggggcatccatcgcgctttatttttcagaagggaatcgacgcatgctgtctttacagattggagtaggcctattcgcgtcagagtttttctctcctctcctctggaaaggctcatcatttatttttttttaagtatgagtattattttttgtttactcgtactaaatgactaccgtacgcataggatcatggcacaaatttctgtgtacttaccgatagtcacgtctactctcgctatctcacgggccattttctgcttaagtcaaaaattcttgcacgtaggagtaggagtagacttttttattattattattttggctgttaaacatctgagaggtgaaccaaacagtaatccaccaagaatccaacaggacaaacatcgttgtcaaccttagcgtcagtccttcagtaatcgtgcttcactacacacctcacctcacttcactgccactagaatgcagagcagcagcagaggccagaggcgcactgtgacataccactgttcaatttcagttttcaccattgctacactccattccacaagggtgcaacgattctgggcagggggccagggtatgcagaaataggctgaagaaacagacgcccagaaaaacctccctgccatgtaaaagattgatctgtcagttttccagggcacaggcctaactgcatggatgatggatgtacctacccgtgggctcctcggagctgaggtgagcccagttgcagaaaggagaaaagatggatcctcctgccaatgggaccctgcctttcttgtgcccagtggatgcaatcaccaagaatgtgttcttgttgtttctttgggacatccacttgtcaaaattcaatagatattgagagcttttctttctttttcgctgaaaggcaatcgaatgtactcaatggattcttgggagaaatttatgagccaaaagtgtctgtaacctaaagtttcaagattaaattcttctgctagtgcggtgcatagtacaaacgtgctataataagttgttcagttgaaagttgcaatcaatcggcatctcagacgatcgacgccgaggcaatgctgcattgcttacgtgggtggagaaagagaaaggcaggcagggcaatgtgtgtttcagtaatcagtatggtcatggatgcgagaactgcagttgggaagagaccaacagcaacgaacaaaggtttcgccatctgatttttcagagccccgtcagattcctcgcagtcctgcgcagccactcgtgatgatcgtgaagacgtgaaaccaacataggcatgggcgaactgnggatgaacaaaggtcaagtactctgcaactctttcgtcagaaattcagaatacacaagcgtttgagatgttccattgaggtgctgttcacctttaagaaatgtattattaaaatttccattgaatgagttagaccgtgaactatgcagaacaaaacactgatataattatatatgtcccttttaaatatttattttaaaaatctgagtagatttttgtatcaggagaggcaagtaggtaagtggtaacgaggtagagtgggctgtacagcgaatcgttcatgtcgtaaacaatatgggcctttgtttcgttctcatataataaggctgcgttcgtttgtatgatataggatgagaaaacacctcgttttccgcgcgcacacttcccaaactactaaacggtgtgttttttgcaaaaaaattctataggaaagttgctttaaaaagtcatattaatctatttttgaaatttaaaatagttaatactcaattaatcatgcgcaaatggctcacctcgttttgcgtatctttctaatctccccaatctactcctcaaacacaccctaagtccactttgagagcgtttggcagggccagctgcagctacggttgcacatagttagtgtcagagcgtggcattaaagcaactgccgaatatgccctttgactctcttaaaatatagatccaatttaattcgtatccttcaatcgtaatactagatatttaaatccccccactatcaaaattaaagagagttattttgcaccgatttaatagttagggagttaagatatttggtattacggttgagggatacgaatcatattataccaataatgagggagtcaagtggacttatttattttctcacaaagtctccatgagtttgcaaggcccataacttaacccaacggtggcccatactcattttaccccaaaaccatgtttgctctcacttcgcttagggggtgtttggatccaatggtaaatttttttggcgtgttacatcggatatacgtatacgtatttaaagtattaaacacaatctaataacaaaacaaattacaaaatccgcctacaaaccgcgagacaaatttattaagcctaattaatcagtcattaacaaatgtttactgtagcatcacattatcaaatcatggagcaattaggcttaaaagattaatctcgtaatttacacgcaatctgtgaaattagttattttttagactatattaatacttcatgcaagtgttcaaacgttcgatgtgatagggtgaaaaattttgaggtgggatctaaacagggtgttaagtgcaatgcaaacctcaaggtcttttatctactaagcaaaaaaatgaaaatccaaaccaaatgcagcccaactggggacttttatctaaactacaccctcgtaggtgcattaggcccattagcaaagttcagtcccaaccttagtacccgaaaacaaagaagagtttttaacgtacagggcataaacttaagaatattccccgaaatatggtcgatgcacaaaggtagactactgtgcacccacgagtgtagttggttggttcatggttgggctgcctggcacgtcacgccccaatgcgtccccggatgctgcgactgcgatgcccgtcgctttcagttcgcgtgcccgcttcacgtatccttccgtaatcgtaatccgcccacctgatcgctgatagcgcgattagcaatagattttacgattgcaactgcgactgatctctgacctgaaacgctacggtcgcgcaagtcacgcgacgtgtgtgttgcttacacatcgaccaaacaaataaaatcagtgcttagattgcattcgacagcggtagatttctcttttttttttctctcgtacgtaagtttctcgaaatgctatgcgctttctaaaagtttttgttacagaacaattacttaaaaagtaaatattaaactattttaaagtttaattaatcaatgcgctaattacttatcttgttatagctgacgacgacattctgatgtgtcgtgttggcaacatccatgtcgacaccaataggagggttctctggactctgctgccacgtgtacttataaaattgtcccctcgagaaactattatttttcgtcgtcaaaacacataatcttgtgactggataaagcagcattatggtacggtcaatggcaggtgggtcccagaagagtgcagagaacactgacatgtgggccccacaatttcgccgcatataaacggcagccgtaacgagctcggaaatcgcctgcacagctgtttcaacgacggctgctcggaattcggagggagggaggaaggaatcggagtgttcggtaagcttcgcgaagcgggatggaggcgccgcgcctccgcctcccgttcctcctactggtggccctcgtcgtctcgccgccggcggtcgccgcggcggcgagccgaatgcggatcgagcccctccccaccgccgcgctgcgccgcctctacgacacctccaactacggcaagctgcagctcaacaacggcctcgccctcaccccgcagatggggtaagttcaatcaatcggcccaatgcttcgcctcttcgcttcgttccccttccgctgctgctttgtccagcgcctgttgcgtgcgcgtgtaattcatcgtcgttcactgcgttgagtgcgtgatttattagtgcctgtggttctgtggcgcagatggaacagctggaatttcttcgcctgcaacatcaacgagacggtcatccgcgacacaggttcagccgcgggatccccttaattttcatggttaaatctgcaattctgcaccgcagttttttttttcctcccctgatatggtggaagtccttgtctgaactggaaattggaggatacatatttccttaattagtgttgtatcttccacacttccactgctcagagtgcaatgatagaatagaacactgttgaggttggatattggaatggaattgttactacccactgttcaagtgacatgttctcatgtcgtgtttggttataacaattgacaagttcctaatgcgttttcggttgttcagacttaagagtagagtttggttagccatgtacttctaatgaaagttttcttctatctgatgaaacagctgacgcactagtctcgacggggctggctgatttgggctacaactatgtaaatatcggtacattacttggctcaagagttatatattactggctgaagcaagtatgttgttatcctctaatttacttgctgttcattgccttttcagatgattgttggtccaatgtaaaaagaggaaaaaaggtaatgcatttcatttgctaatttaggctgtgatttctccaattactttgttcctaaatatgtcaatgctttggtcttttgataattttaacgagcttggacaggacgtcactcagaacagtcttctttggttgtactgatacaaatacaaatgcattactgaccatataaatacatgcattacaagtttacctctttagtttttaatacattgtttcctgtgcatgtaggatcaattgctacctgacccaaaaactttcccttctggcatcaaagatcttgcggactatgtgcatgggaaaggtctaaagcttggtatctactctgatgctgggtgagtaagcagccctctatagatggtttttgttgttaatacaccatgaagaataatattccaaataactaaaaattataacaagctaaagctttcaggatttttacatgtcaagttcgacctggatcgctccatcatgaaaaggacgatgctgcaatatttgcttcatgggtatgagctagaagcaataaattattgatttgaaatactacacagtatgaacatgttaagatttaagagcatattctatggaaattgatttctccagggtgttgattacctgaagtatgacaactgctacaatttgggaataaagcccaaggacaggtaaactaaatgtcttctcattgtgtaagcctctttcatgagtacagttatgtgaactgaatataacgcattaaaattcgtttcatggtgtcatattcttaggtatcctccaatgcgtgatgctttaaattcaactggacgccaaatattctactctctatgtgaatggtatgcacctttatcatacgagagaagctaggggttgtatatcatgttggtttagatgtatatgatgtgctattatactattttttctcttaggggccaggatgatccagccttatgggctggcaaagttggtaacagttggcgcacaacagatgacatacaggatacatggaaaaggtgattcatgtatttcgggttaagtgtttggggttgggtgaaacctatctatacattgatgtgaagctgacttgtgatcttctgtttgaaaacaagcatgactgatattgctgataagaataacaagtgggcatcatatgctggacccggtggatggaatggtaactgtgtagcaaagagcacaagttttccaccagttttcatactgcaagagaacactcgtactatcattcaactgacttttttttatcagacccggatatgctggaagtcgggaatggtggcatgacctttgcagagtatcgtgcacattttagcatctgggcacttatgaaggcaagtactcattgggtgcattctgtaatcactaggatggcacctatattccagtatgttgcatttggtcttcatgactccaacttatttgtgctgttactggatcaagtagtgaaaagggtttctgaaaagaaaaaaaggagttagtttcttttcaagtgtttttccttgtccttatattttatgctacttgacgttaggggaatttcagtaccgttctgtggatagaagtgtagcgcaaatgatgtgatttaaaattatttggctcctgcattattatatttcaggcccctctcttaattggttgcgatgtcagaaacatgactaaagaaacaatggaaatattgagcaacaaagaagtaattcaagtaaatcaaggtattacactgaatcttttttgtttgcgctctctattatgttgacatgtgtaaacttcaagatagttttctattaaaccattctattatttctacaatgtcattgttctcaaagatcatgaatggcattaaaactttgaaagcgaatttgatttcagcagcaaaactttcatcatgcactaagacaattagcatcatagttgctctttggaattcagttttctgcatatcatgtatattttttgaacaagatgcttgaaccaatggacctgagagctcgcaagtttcccttgctttgttccacctgaggacaggaaaaaactgtacagaactaattacgctacatattgtaaatatctgttttagagtagattattttattcgaacaaatttttttttctccttgtatatgctgttgtaataattaattaacacgttaaactgcactcattcgttttctgcagatcctcttggagttcaaggaagaagaattttaggtcaagggaaaaatggatgccaagaggtgatatacatgtccattagtaattatagtatgcaaatataattattactgtgtggtctgccctgatggtttacttccacagtcctttttttcttttccaaaattgcaagacactaactataacagttttgtgcatgagcaatttacacacacaatagtatagcaactgttttaatttgatattgaacagagcatgtttttgtaacatatttgatatttccccaacttgcctaactctagagtccatcgaaatttcatagggacggtagcagccaccccactagctggtgatgggttttcctatgacatccctttgagaatcctgttcagacagggccttgtatgctagttagaagctacttggggtagataatagacttgtagtgttcgggcattgttcagttggaactgcagttctgccatcttaatcatatactcatttgggccgtcggagcatgaataacgcatgcaaccacactaacagcttgagcttttagaatagattagctgctgtgtggaattaaactattacaaatgcatgtttgtgaagttcttcacatcagggcattccttttcactgatatatcatgtttgcaggtgtgggctggccccctctctggtaaccgtctggctgttgttttatggaaccgctgtgaggagtctgccaatattatagtaaaattgccatctgtaggccttgatggttcatctccctattctgttagagatctgtggaaggtaagttaaataatttccggtttaagtggttcaatttacctctgtttcccgttgaaacaagagaggagtggagaaaacaaaggggttaaaatggtgttgcttatcatattaaactatttgggggagagagaggagaaaaatggtcaccacatatatccttttcatccaaccaccaaaacgtgtagcaaattaacatcatagaataagcatgagcatagtgtagtatctactgacgcaacaaagacagatcaaagtttatcaagattccattgtcaaaaccttatcttgtcagcattttgtttattatatgttaactgcattctgaatctgcatttttgcagcatgaaactctatcagagaacgttgttggaacttttggggcgcaagttgacgtgcatgactgcaaaatgtatattttcactcccgccgtcaccgttgcatcaagttgatcatgaagagcatcatgcctgatgctttcctggaagcacccagtatctactcaaattagacctgatgaatcgtccaccattttggtcgaggcaacaggtctactgaaatttgctttgtggagaatgcagttttcccgtttctatggggaagttcgtgcaagcaaaccacgtaaggtttttcttgcaagcttgtggtgtaaatttattggtggcttgacgccgtttgctgtacaggatgcaaataaataatttattctgtccatccagcggctgtgaaaatgagatggtacataaactaaaaaaaaatgttttttaaacttagtttcaataaataaacaaataacatatcttgttcacctcactcgtagtggctatgaaaatagatagtgtagaaaatgtacggaagctaaggccctgtttagtttccatgcaaaaaaaaaaaaacttttcacattgtcatatcaaatgtttaaacacatgcatgaagtattaaatatagacaaaaaaaacactaattacacagattgtgtgtaaattgcgagacaaatattttaagcctaattacgtcatgattggataatgtagtgctacagtaaacatttgctaatgacgaattaattaggcttaataaattcgtctcgcagtttacaaacgaaatctataatttgtttttgtcattagactacaattaatactttaaatatgtgtccgtatatctgatgtgacatatcaaaacttttcatccctgaaaaagaggacctaaatgtgtccggctgattttgttttatcttaagggaattgtattctgctggcttttttttttaataatgcattaaaccggcctctgcagaacttcgccattctgtgcactgcttctttttctctgtttttcttctctgatttgggaaatgaagaagcaggcttttgttgtgttcaaagctggactgttaggtgacaaacttcagcatctgagagactccactggaaagaaatctcaagacgcattgaagaattcactgcaggatgtaatgcaagatggataatttacttccaccacattctgcctcttgtctagggatcagcctcatgcggatggagtagaagtgaggcacttataatcgctgtgccatattgacttgtatacaactatcggttcactagtcagtacactgtacaaagtaaaaggtatcagagaaaattatactccctcctcttttcttttttctttttatttttttttactttggtaagttcaaacatcaaacatttggtgaaggaggtagtacttcaacaaataccatgcaaagggtaaatatatcacgatgaagcacaaagaaacaataggtgcacctaaacactgtactccatcatttttcttctcttaatcttaaaaagttaaaacgacggatctacaaaggtggtagttctttttttgtgagcattttcgtattattttattttttaaacatttttttcgggttataaaagctaaaaagatgagctagttcttttacaattaaggctcctaccaggagttaacacttaaagacctaatgattgtatcactaaggattattggagtttcagacagctgaaagcatgctattacgattggaatagcatccaagctttgtacgatatcagacttctcctgaagcaagctagtaaagcatccttcatcttccaactctatgattaaatccattgcgagcaccagccttgagaggagggaagtcagcttcatctctcagttggtagagcccttctggcctacagatttattcacgacatgatgcaatttaattagaaaaaaaatgcaacagcacgactgtatcatgaaatgcaaaaagaacacgagatcgcaatgtaagaatcacgtacttgcttcctgtttcagcaggcgaagagctcacagtcacaggcgttgaaacagcggctactgcaggccactttctagcaggcagaggtgggaattcttcgcaaaacttttcgcagagaaaactagtacctaagataggttcgaaagatccaaactcaagaccttcgactagtgatgttttgattggagaagaagcctcagttgcaggtgaggatggctgagatgtattggattcttggagaccattgccaacacaatgaggaagctccacactagatgatgatgatgccgtcatttccctgttttgcacttctgatggatggagtgtccgtagttcccttgattcattgtttggtctgacaaggtcttcatcattaccaggtttttggctgtcaaccatgttcatgtttgtgcaaatattccattcctggcttgctggtgctctctcctgagcaaaacttccttcagctgtaactgtacttttgcttgagtgatcctgtttctttgatggtgtatgacttgtattttcaaatgtaataccgccattgcttgaacttgaacatcccatttcaggcgaactgcgccggcgaatgtagccaattgggttagttttaatcttgaacggccgatctggtaacatttctctctggcttcttccattataatagaatatgcgttccttgtaagtatgataattctgtaacaagtgaatagctaaattacatggatttattaagaatgcaccaatacatgatttataatttatactactatggaggttccgtgtgtagcctaaacaaaagctcatttccagctttccatgccaatattgaagcataaggaacaataaaataattagttgatctacacaacacaaaaacttttcaaagtttaaaaacatggagcatgcacaagaaataatacctccattccataatataagcatttctgcacgttttccaaaatgtatctagacatccttccatccagaactccagataaaatgcatagaaacgcttatatttggaacagagggagtagattatgtcccaagagtcctcaccattctgggaatgtatgtgccagttccacccttcccacggtttgttttttgacttgatgtcgcacgattatttgttgtggtataagaccaacaatatttatagtcaactgaattaactgcaggaaatgaaagctgtgcgaatgcattggataatacatctgttccagaaagcaatgatacattctgtgcatatggacaaacaagaatcgagtcaatttattgaaagcgaaactaattcgaaacagtggacaacaaaaagttaatgaacaaagctgcaaaggttcttacattgagagtatgcatgccagctccatgcgtcccaacaatatccactgtgttatggagcggagaaactggagatttctcagaatcagcgacaggagatggaggcaacgccaatctgttatttgttccagagggcaatgccacattctgctgacaaaccgcattcacttggacctcagtgcgtgatactgatttctgagaaatttctcttgtgctatgcgaacagtaaactcgagataggttccctctctgggtataagcagatgaaactaacaatggccttagagcccttccatcagtatttgagaagctgctctgggttggaatattgaaggagtcattgtttactgcgccagaaaaacttgcttcctgaatcaaccaatcaaacatggactccaggtggtactgaacttttcgaaggcattctaagtgcaaatccagatctcctgatagatccaacaaatttgatggtgaaaaatgagaaagtggcagtttttcttcatggagatcgctcctatttgtctcagctgggcaagaattggaaatatccaaagtatttatacgagtagagggagtcaatatttgtgactggttgttcgcataaatatgttgctccatagatgatctaccgaggggtaaatattcctctcttgcacagtcgtagtgtcgtttcatgttgttgcccttctcttgggaaaatggtgagtggctactgaaactgtctcctgagaccttgttgtaaaaacaactatctgaagtcctctgcagatcaggacttctattttcatcttcactcatatcagattcttttacgtctgatgaatcttcccaaagtgcatattcactttcaggatcaagtgacggttcgaatgaaccattattgccaacgtctgatctttttcctcttccatggctcttcaaggtgttcacaaaaaatccaaagatttcagtaggaataaggtcagtaggtaacatgagaatttgactcaggttttgtgcaccaaatgagaaagcacctcgtatgcggtaaaagcttcctgcagaaaataaacatagatgtacaaaacctatgagaaccatccttcaaagagatctcatgtatgtatgtagttagcaacatatgcctatttcacaagcacagtacctgttctacatgagtaagcacacatacaggaacgtggtggtggaatatagaaaggaaaacaacgcacagaataaagaaagataaaatgatgtagcctccaggttattctgacctttgctgacgcttctgccaagattattactggactttattgggtcaattatgtttagatacttcgggcgaaaattcatgttagatccatcagaatcctttttaagtacaataagtctatcacacgagccattagggccaaacagtaattcatcatgtatccctgaaggttcaactgtcacagggattataataattagaccagtaagtacatgcttggcgatcacttgacaaagcaaaagaatacctgagtatgactcaccagttaggttgggcaaggatgacaaaggaacaggaccatttaaacttatgcaatacttatcccagtcaaacttgctaaaatattccaaaaacttatacaagacctgtttgaacaaagaaggtaccatgcaaaaattttagtccctatgtaaattcccttactaaactgctgaaaagccattgggtgtttcatccaaaaaaaaaaagtttagtccacccatctcagaaagaggctgataaaaattgtgaaaaatgttatgctaccaagaagtacctctaagggactatgcagcgatttgtgaaatatattgaatatgtaaagaacaagaacttccaaggcataagtagatattagtccacgatgagctcccagtatgtggctttcatggtaacaccaagccttgattagcataatgctcctcttgaacagatggtcgttcccaacttcatggtcaacctgaagaaggaatatatactcaactttgttatcaattttgcacgctatatttgttgaaattactgggcagtattcaagatgaatacttccaaatggagcagatagttcagatttccatgtattaccagctcaagaagacagagtgtggtcaccccaccaatttggttgaacgagatgtcaacaacaatattgtcaataacacatttgatgagctttacctggatgcaaaagcaacagcagtattttaaaacggtgtataaaaatatatcagtagcgtatgtagaggtaagaactacatagttaaatctctgccttcttaagagatcatgcatgatactaatgtaaagacatggaaaaatgtaaaaaacattgttactgctccatatgaccatatcatactatacccaaactatctctggaataaataactcaacagaagtatgtcatacaaaaatgcacctcagcatcgatgaattgcaaacccgtgattgcaacatcagcaccatcttcctgctcctctaactcaagtataccacgaacctcactaatgaaagtgctgtccggagctgtgttcccaagtatagttatgtcaatatccccatcagggaggtaggtcttcaaaggaacagatccaaatgcaaagacctgaaatcatcaaacagaaacaccatcttagagaatgctgaatgcaacatagtgtaaagtgcaagatcactatgactgcaccggctcaagaatcaaaatcctgctgtatctacaagtacaacatgcagagaggatttcactacggcggcataaacaagtatccattgcttgcttagcccaagcatgtgatgactgatgagtcaccaagaaatgtaacgagctcacagttgaccaaaccacgccgcacccgattgcatgcatgcaagcacatttacgagcaagctagatagccaaccttttccccttcaatagagctagaaatgatacatttgctgtcattaaaataaataaataaaaagctacaaaccacagtgaaaaggaagggtttaaccgttcatgtttgctgaaaagaagcctgtatttacgctaaggtgaaaggtaaaaagttattagatcatctaagctagtaaaaaaagccaccaccaaaaaggccaaagcataatagcttctcttattttataaaacaaaaactgacatgacgacatgatgtcactcgctcagcacagcaatttggagccactcgagtaatagaataggactggttagtcaaacaaatgtcattagaaaaagacctctcgatgcatgagctgatgggtacgagaataagaaccgattaactaccagttagtcctaatcgcaatcaccgaaacggagcaaagacgaaagcgacatatgagctcatcagcaaaactggacgcgaagcgattaattaagcgcacacgcgctcatcaactcatctaacaccaaaccccaaagacgccgcccgcgattgggatcgagaagaagaaaaaacgatcccatccgaaacggaagcgcccatcaactcatcatcccacaagcgagtgcttattctacttttttttttgtttgcggcacggcacttgtttgcgaaaaggaaaaggaaaaaaaaaagtgaatcagcggcggatcatgcggcgcggcggcggcggtcggagtagatccgccgccgccgacaccggccggagaaaacgctcgcgatgagattgggggggaacgaacctcgcagccgagcgcggngccgaagagcagcttgaggtagccgatgatgccctgccgcgtccgctccgcctcctccgtgggttgcacccgtaacaccacctcgtccgcggccgcctccgccgcccggatcgccttccgccggataaacgccggccgcggcgccctcgtcgccatcaccgccgccagcgtcattctccccgagccggccgacgccgaccaccacccgccaccgtagtcccgccggccgcggtacgccgccatcgatcgctagcttactactactactactggttcaagctgccatgtttggggaatcatcagatcatcaaacaagagcgaaatcaaagggggttttgcaagagcgagagatcaaaatcttattacctatttgcttcttacgatttcattttcgatcgatcccttccgtttctcggtggagttttgagttttctcttgtggttttgtgtctcaaaactcaaaagagatctggatttggggcccaatgctctctcctattgtctcgcctttatatagatcagtaggggctacagtgtactttgatatctgccttttctttttctttttttttgtctatgagttatatatatatatatatatatatatatatatatatatatattctttatggctactgcctttattgaagtggatatggatgccaaaactgggggtcattcgaggatgtatggttggtatggatagataggcattcagtttcaaatataagaaaatgaatcctttaattcctgaagagttttggtgtgatcacataaaaaatatttcaaaactgttgtttgcggtgtagatatgtttcttggaattatttattccaaaactccttttaataatatttgagaaaacaaacaccttatcatgttatttttaaaacactagctttgactactctgacaaagttggtattgccgaataataccgttaaatcacatgtgatagcggcaaaaaaaaagggacaattagagtcaaagcatgtctagccacatcatccctacttacactaccaaaatggattactattccatgtgcgacaacgctaaaaagtatgtgtaaggttacaatatgcatgcaacatcagctcaaattgcgcgccaacaacatggcaccaccatgtgtatgcaatggctccaataagtttggatgagtttgtcgcatgctcaatctgccacatcagccctactagtatgccaacaacatggaaacactatgtatgtggttgtatccaaaaagtttaagtaaggttatgacataccctgctacatcagctctactggtgtactacgtcaaaaggtttggataagattacgcatgcgcgccacattagccctattggcgcgtcggtgcgcaatcaatacaatttaggcttcctcctccttcccttctctatcttctctttccttcaccattccgcccaaagccgtgccttactagggttaagaatcacctaacaaagcatggtgtttgttaattaattcgtactagcattactaggggtttccgccttgcgagagtgacgatgacaaatggcaaactatcattgaaacaagttagtttttacgagttgaaactcgatgtatgttgcacatgctagtaataatgatgttaaagatattaaaattttaacactataaatgttggttatatctcggattatgtcattctaaactaaaagaagagtccatgtcaattataacgagctaattattaattttgaaatttagagttggattaatgaaatagcgtatactaaattgagagtccaagattagtatagatttatatttaattctaaatatattaattatttaatttttaaagcaactaaagctaactgagtccaaagtatttctaattatatgttttttatttaacatggattattcatatgatttcatgccatgataatatggaccatgctactaatgataggtgttgctacctatgtgattatgatggaaaaagagtgaagtcatgaaacaattttctaaatcatattggtgtaacaaaggttgtgaaagtagagtgggtgaaagcaatgccaaagaaagggtatactcctagttgttatctagattcaatgttagcaatagtggagaccataggcccctaggtcaatctcagagtctcacacattgtcgagaagctatagttgttaagcatgacactgggaaaaaaactcagtcctaggggaggacctcctaggaggtatttgcagtagaggaaacttctcgctgcagaatcgagaaaaaaactcgaaggcgcctgcaggtgtgtaacactgaaagcaacatggtggtaaggggtctttcttttaatctagccccgaaaatatctatcccacaagaagtagtcaaactcttaacattggaatgctagtaaggcattgtgatcactaggctaaacattgataggactgctaataactctactagggttctaaaagtggaatgtaaacatttgcacaagaattatatattgtgtggatttttttaataaggcacaataaaat

SEQ ID NO: 9906 - DNA, 2969 bp, Oryza sativa
aaaaatatgtgatcttgcaagccaaaatgagttcaacacatttgtgccaacttaagtgtaatttcagtaagtttttttttcggggaaaagaagcctttttcagactatttatctttaatagaagcttgaagaaaagtataagacgtataggtcaagacatttatgttgcacaccaaacgtttggaaatctcaactctaaatttagaagtcagaaatccattcagtatattccactagataatgtgaccaaatctggtgagtgttaactccacaaagattttgcgagtaccttatcttctcccctaattgattgtgtgtaaagtgtatatttttttagactatgaaagaggcagcagtactgatatttatatattttttatttgcggatccaaacataaaactgcactcactacaagaaaatctactttagttttttttttttgaatggacaaaaaaaatctactccatcggttaaaaaaaacataggaatgtataggtgacatatcctagtacaagaatctaaacaagagtctgttcaaattcgttgtagtaagatatatttcattgtactaagatatgttatatccagtgctagatttgttttttatgggacggacacgagtatcgtcccatgaaaaaacaaatcctagctccgatctaattacttggttactagaagtctcatgacatcttagtaaaaatttacatatatcgttaccgcgtcagcgatcaacctggtcaaaaagaggttcgaacatactatggttcattcaaaaagatcatacaccactgccaagtttaaagatcggtcatatatttctctttgcaaaatatgaaactggacagcaaaagactaatacagggtagaaaagactataggataatctgaacttcgaagatactaaaagataagtaatgatgtggtttcttattgtagcttctctatagcaaataactatactacaataaagaaccagagagagagagagagagagagtactttgcatgcatagctcgcattgccagtacgttctaatcacattcagctataatgtatttaagtttaaaccatgttggtttttaaaaagtgtataagccacttttaagccataatgtacttccaatttagaccatgtttggttttcagaaagtgtataagccacttttaaagataaaaatagttgaaacaacacgccattttctcaacagctgatactgttccacactttcatagtacgggcccattaagaattagcatagtaacacaaaaatgtacatattttcaaagacaacaagtctacaacataactaaaagaatacataaaagtcactggaaacccactcagtgcccctcaccccctaaatcaaacaacacacaacacacaagaaataaacccgatgtttccaaacgagcatatctaagtctctacatgatcagccacacgatgatcaacaaacaaacaatgtaactaaaattgaaagaattgaattgaaaaaaaaaaactagtgggagagagggaagcagttcaggaaggcatgtcagactatgaacaaagaaaactaaacggacggagcaatttgttgacatgtaggtctataattagaatgtgctgttgctttcacctgcagatattgaactaccctcagacttcaccactacctctgcctcatttttcacagccactggtcctttgccaatgtccagcccttggagccgcccaagcgagtcttgctgcatcatatcagagagggaatttgggtgggatagcatctggtggctagggacacttggatgaggttgttggaattgatgtggcagctgctgaacgcctgcatggtgctgaactgcgtgttggtcagatagctggaagaaggaagggctgtacgggacctgctgcattcctgtattatacgcatcatttgactttgccatctcacccgtagcaatcttaagcctctccacttcctgcttcagtgcatcgttgagagctgcgaaacaatatggtatttctattagcaggaaaaacaacacgtatcctaatctatgctgtgtttcagatgttcacaagttgttcaaaatgtcaatactaatagcttgagaaatctcaatattccttacatgacagagctttatcctctaaaatgatgaatcagttttcagtataagtttatgttcagcaatagagcatggcacttaccagcagtgcaaaattttagctagttccattgtgaagtaatgcagaaagatttctattgaagctaaacggtaactaagtgttggagctctcacaaatgattagatttaccaaagtaaacaatggaaaggattgagatcgcatgataaaacttgcattaaaaaacgacgataacacaatgtcttacatacaagaaatagcaaatgttgataagatatcttctaaaagtatgcagccagcctacagcaacgagctacctttcaacacaagtttattggaaataacgaaaatcaagagttgagatgtacgggcagagtgctcaccatcacgcagctgagcctgttgctccatggcttgcaatctaatcttgagctcagcattttctgcagaaagtccggttgtgtctctctgcccagaaaaacaaaacgtcttaaaaggatattcacagcttttaatacaaaaatatgggcatgatcacaaactttgaatactggtcaacagtgaacagagtaaaaaaaaaatacagtgttactagaacctaatagtcctggtcaatagagagcatacattttcattgttaggtaccaccattcagctcaacaaattattggccaaccatatagaatatatttggatgagaattcgacctttccacaacatgtgctatagccaatatgagcataaagctagtcacataatcctatcatgtgttatactccctccgtttcacaatgtaagtcattctagcatttcccacattcatattgatggtaa

SEQ ID NO: 9907 - DNA, 2283 bp, Oryza sativa
ccccatctagatggttatatgtctagatccattaacatcaatatgaatgtgggaaatgctagaatgacttacattgtgaaacggaggaagtagttatcatggcatatgcatcagttcaaataaattgttctactaatggatgatccacttaattgtaaagaagttgcagtttggttagcacatgtactagtaagtggcacaactgcctgttcaatacagttcaaaaggcacatttactatgcacattattgtttttgcactgatgaactaaacatagtagtagtactgcaacccatgagacaaacaaatggataaaaggtacctgaaatagtgtcagttgtgctgacagtgtggtagcctcagtttgaagagtttgaactttccgctctaactctgttatatatcgagccttcctttcctttgatcgggctgcagactgtctgtttgctagaattctgcaccaaagcaagctcagaaattttacatttactcatgagctgcagaaagctgatacaatgcacttgctaaaaatgatttagttaacattataaagttcaaatggttaattaaatcgaggagagctgtctttgaatataatgattattactacataagttgtagagctatgcacaaaagtttgctcttatagtaccagttgcatatatgaccgtacaccatgaacctgtgcgttaacagtcttgattgtagtacagcattttgattaaaagaccactacatggtgattctctaatggaaaaaaatatctctgttattttcaaatagaaaaacatatttaagaaagtggaccatgctaagttcactgcatatatggcccttaggtatgaaataaagaaggccttgagaaaagggggaaagagtatcagaagagtgcatgcttaagaaacacaaaagcaaagtgcttcccactactgccccgttcgccttgcgctcacagcttatttaaagactaaacaaagtgatgcagttttttgttctaagacaaaccacaaaatagaacagtgttgacattgcaaccatgttatcattgaataagtaaaattattatatgcagtttcatcacatacagaagcatattttgttataaaatactgttgaagagagaagagaatgtggggccaaatgaggaaaggttttactaagtgacatgaattaaaccctatataatgaatatacgcagttaaatactgtataacttccccgcaaaaaaaaatattgtataacttggttgcagcacaatagtttgataaaagaaacagttttgggtagagaatttatagctaataagtgttgcatagtaaatataaaattattgcacataacgaacatatgtcgttcgctccaaggccttcttattttggaacaaaacaacatggattggctttttggtccaagaaagcaacttgccaaacaagaaattggcatttcaaccacctctatgagtgcttacgttccaaaaagaagcccgcgtaagcgaggaaggcgagaccttcaggacatccaattcagttggtcaggttgctgcagtcctatcgtacaagctgcctttcactatccatagagattccagaccactagcaccatatattgggcctcaatagactatgaaatgatttgtttctgttaacatttatttttctaccacctttctttgcttgcaaaatctaatgctatatctagacaataaagtctcactaattcaagagtaaacacaataaatgtatatatatatatatatatatatatatatatatatatatatatatatatatatatatatttcgttggttggtcatcaaaagcaagaggtaccaataatcctaccaaccagcaaatcaagtctaagatagcatgagaatccgaagggtgtcgtcaccttttggcgcgcttggggtcgatggcggcgagctcggccagctgctcggaggacatggccttcttagcctccataacctcggagaacacgcctcctgctccgtcttgctgcttcccaaggccagggccggggccacccgcaccggccccgaaggcgaagccgtcgaaggaggcgctgtggcggtgcttggtggggcggggaggggaggaggtctcggcggcgcggtcgcggtcggcgccggcgatcttctccatgtccatgaaggtggagaagaggtcgtcctcggagccgatctcgtcgaagcccccgccgtccgcgccgcccccgaggcccaggtcgtccgggaagcggaaggccacctcagatctggcgcgccggtggtgcggcgg

SEQ ID NO: 9908 - DNA, 15600 bp, Oryza sativa
cttccccgccgccgccgaatacgacgacgccgatggcgacgggtttgaggatgccaccggtgcagcgattgggtgtcagctgcgcgggagcagggcggcggcggcgcgctgggccccagggcgcaagcggccgtgactggcggcggaggcacgcgggagcagggcgtcggcggcgcgcggggccacagggcgcaagcggcggcggcgtcgaggagggcgtcggcgcgcggggccatagggtggaagcggcgccgtggaggagggcatcgtcggcgttgggccttctccgtggcggcgaggatctcctccgtcttcgccgcgcgcctcgtcttgagcccaggggcaaatggctcggtatggcgaggtgtggccctctgcccctaccccctacccccttctcgtactcctccggacagagcatggcggcaggcagaagtagcaagtcggcaggttggagcagccaaggggcgccggtcgccggtcgccggggtcctgggagcagctgcggggtgcggtctgtagcacagtagcagccgccaagcggcaaccgtcaaggcggcaagggcaggtggaggcgcagaggggcgccgccgccgggatccagtcccgggtgcagagctgcggcatccgtgccacaacgtacaaggaggagcgcggcgcggtcaccgcattccagagcaggatgatgccgccgccgtggccgacgagggagaaggcggagttcggggatgtcgacgacgtgtgcggcgtatccgccggccagccgctcgtggatgacatgtggggcccacgtgggtcccaccattttttattattttgtgtggaactgacatgtgggtcccatagggttttattattttccggatcgaattgtcacgtaagcgccatgtcagatgaagaccgagtcaaaatagccacgtaagtgccatatcagccaaaaccaccgagggacctcatctgcactagtttcgattgatgaggaatccattgtgtctggtttttttggttgagggacaaaaatcggattcattgacaagttaagggacctaagatgaacttattccttttgtgaccgattttgggctgatgttgtgtgggctttttggtagcctctaagccgtttcatgacttcattcacctcatctccaagatcatcttcggcccggcattcacctttctcaacttatcatttctcgtttttagtaaactagtttcccaagttttcccaaattgctaaacggtggtatgttttttaaaaaaattatagaaaagttattttgaaatgtcatatttatgtatttttaagtttatttaagctaatgcttaattaatcgtgcacgaatagaccgttccgttttacatataggagacagagttctcaaccttcacctctgaacatagcttttttcaaaacctttagattttccaaaccatctaaattcttgtctatattttaggaatatgtagttatgcaattctagaaaaataaacgataagttagaagttgggacttgggaagcctagtttatctaaattcttatcagtcgtttgtcagagtgagcagctgattctacgaatatgtagttatacatttttttaaaaaaaatgaacggtaagtcagaaagcggaaaccagcttttctaaatttacatcagacgtttctcagagttaagcagaagctccaataaacaggacctaagtttcgagaactgtagagccatttgggttttagagcggcaaatcaggtgagttattactggatgtcttggctttggatacatacaacaactagctgcccaccgaggtatgagcaaataaggtgagcctcgtggttaaaaattacaaggtacagtcagtatcatacagccttctacacgtgtgtttacacaagaaagcaagtgaaggactacaagaacacaatgaaaccctatgagattctcaacatcaaaactcaccagctgctgttcctgtaaaaaaagggggaagccgataagatgcacacacaacaaattcaatacccatcctgccatccacacactcaacacggtcagcctcaagctcaagctaaagcagcagcagagtcaccggcagccttgtccggctggttatctccagcctcgtcgacggccatgctctccggctgctctgccgtcgccacacgcccgccgtcgttgttggacgtccgctcttcgctctccaccagagccggctgcggaaccgtggctgcacctgtacatgtgctggagctcccttgctccccagccaagctcgtcaggccgttctgcttcatgtagttctccagtggccggttggccacctccaggaggctgaccatgctcacccgaggctgcccgccatgccgctcctcgtctcggacggcagtagggtggaagttcaggtctatgtggcccttgttgatgtcaaccttgtcgaacatggtcacatctccgtctcgggtagtgtcaaccgtctgtggggatcttgacaggctgcttccctcaggctcatctctgttcatccaagcgatcttcttgctcgcctcggcctcctctcgctccgactgccgttgcttcttcctcatcatcagtgtcttgaagcgacgcctaacggtcatgcagacattgcaggtgcaagctgggttgtgcttcgggcccttcccgctaggtggctggatacacactatgcaggtgcagccagggcgatgccgggggtgctttgtggttgtcgcaacagaaggggaaccttggttcccgacatcaccatagactgcggcagtggcaaaggcatcaaggctgaccgcatccatttcggggatgttctgcttaaaaccaaagctgttccttcgcctcctcatatctgtggtaatattcaagttattgatttttcttttttttttttacaagtttgtcaccagaaatgatgcagtatgtgctacccagtccctatatacttgttatcaatttcaattgtgataagagatgcctattataccagactatccatgttttatttgcccactatcatgctatatgctatatgcaggttcttttttcctagaatgatgtaacatgtcctgaaatgcacgaaattccttttaaataaagtcagagcctccaaatgtccattatggcatgcccagagcatcttgctatcaaggcgtgcatatgaaaagcatggataccttcgtattgctgaagaacaatgtgcaattctttgggggttaattcttcaggtgcagagcaggaacagctgcaaatatgttggaaataattttagttagctaatcatgatgtacaatgaacagttctatcaaatgacgaaagtgtggctagaatgtttttccacaaacagcatacctttttgagtcgattgtgttgtcagcacatgtccacttggatgcaacaataacattaagtggtaaccggcgccattttgagcaatcatcacattgaatccattgatcttgttccctaaaaaatacacagtaaggtattggcaaaaattagtcactggcacagagaatatttgtatggtgtctatgcagagggcaaaccctttaaaatgatatcaataccatacagctccaaggcaatatctattgaaatctaaacaatcgcttaatatttttgttgttttatttccaccacttatggttttcctcatgatgaaaactagagtactaaacggtatcttctgaataaggttcttacccagtagaacggatggtaaaaattgatctctttgcaaacacagggggttcctgcatatgtataatatagttagattaaattcaatcattccaaggcctctcctgagggctgagaaaaaagaagtcagaatttcatgtttcccacaaacgtgaataatgaaatggccagcaaacttacatcatactcttcaatttcgtagtcctcaatcatcacgacagtaggttttgcagttggagcaggacgcaacagctcctgaacctcatcccagtaaagctttagttcccaggcttcttcagcatccattgaaagcctcctgcttttggaaccaatattgcggcctctctttaaaaactgcaaagacccctcatctggcctgctgccgaatttatctgtcttaagccaactaacatccccgtcagctgagttcacatgatgatcgtatatagagcttgtatggagatctgcagccccctttattgactgaagaaatcctgaataaccacttactattgctaaattctcatttgtactagaaaataatgtatccccaagaatggaaccgttggcaatagctgaaatctgtgagtcctgtacagaagtaacataaaaacattgataaaggaagggaaaaaggaaagtgaaacaagcatttgcaggaaaataaattagtaggaagaatgttaggaaaatctaacttactggcaaactgacagtgtttgtggccttccggaagcccataacaagtttccctccaggttctatccgactaaaagtcactgaaaagaaaacaagaatcaccattaagtatgaaaaccttcccagtgagatcacatttaatatggaacaattctacttagcatgtttaaatatattaccacacaaaattcctataacaagtaagatatgaccatgaaatattaatcaggcattgaattttgacctagacgtgacaattaaatgactatgggaggacccctatttgtccctgtcaattccatgtgtaggtcaatttgttctttcaaattctgtacactcaatttagacatttgtgaatacttaaggagattcccctatcaactggcaactttactgccatgagtgctttcccaaatagttttgaagtacttttgaactatgttagatcctttgaaggtatgcaataggaaaatcattgcttatatgtaatcaggcatcagtaataaaattgtaaaaaaagaacaggtgatatcatgtccaaggagatttaacctgtatcaccagcctgtaattgtaatgattgtatgcatggtgtaaccccctccaagacatacattctgctgttgttatttggccagaatctgaactgaaaatgccattctttgccttttgcgtcttgaattgtcaaaggacgaccttctggctgagaaattggagggaaatatgcctacaaaatgtatctcggcaactcaggatgacagcaaacatgaaaagaaatatgttaaaatagttatgctgagaaacaattgtccccactcccagtagttagcaaccattttgcaaagaatgtaaagtagcagtgctctattgcaaaatactgtaaccatgaaaatatttaaataaattatttatataagattattgagcatgttgggaaccaaagaatgtcaagtagcataacaatactaacaagtgtaacaatggcctaggtctctgttgatcaggtattctatgtcagtgtttacgtgaagtagtaaaattaggttccacatcggctgtatttctttctagtcctaactcttgtgcatatactactatataatatagtcacatagatcttgtcaaagcataataaaggttattgttttttgtaacatgtggatgggagggtgttcctgatcctcatttgtatcaaaggatctttaaataatagggaatatgatacaaaaacgataaatcagtaatgaggtaacaacactaaaattttattaacaggaggcagaaccacaaaaggttgtgaacaaaaaaatacctccgcacaggcttttggtagaacaaggcgccctatgcggcctgcatcactggcgcttagaaccttctcaaacagggggacaatggtggaatttgaacttgaagagaaatatagttaaggaaaaccaaaatagcatccagatcagaaataggtatgcacaatatgaaataattcgccctgattgatcagttacagagattgtattatacgcaaagtatgttagctacttatgcataatatcaccaagaagttgataaatataataaggatactctccagaaatttgctgtagctcttggtctgttattctaggccaatatcgaggaagtaattgattgcggcccctaccttctgcaggtggccttgcaacacgaagatgcggaagcatatctttcgttggatcaaaaacagcaccttcaccaacccttggcggtctggtcagaaaatgacgagccctttgtgcatgctgaaatggagataatgcagtggtaagctctcttccttcaggaaatcctgttgttggtgatagcataggtctttccacagttgaagtagcctccaacttgtttccattactagcaattcccaagctcatgttgaggcatgcctcagaaagtgattcacttgtcgtgctttctgtagttgggtctttattttcatctcttcgagactccaatgcactttgagatctagttaggaaaggtatccttcccatgtccccgatactaagggtaggtagttcccatttaatctgcctcgcaccattctctagttctttttgcctcaaaatattactgctttgcccagcttctacgtttttcaccatgaatggaaggttgttcttagcgataatagtaagatcatcgtttctggcatcgaccataagggaggatgtctccagtggtctaccagacaataaatcatcgcttttgccaaaaagtctctggttattttgggatgaaaaaagcttggggacgactggacttggaacctacaaaaaaaaggaacaatcagataatttggaaaagaaatacaaatatgcaacaaacaaacttacagattgaactgctgaatttttaatgcaagtgacacattgaactccaccgctatcaagtagatcaaaggagttcttcgaagcaatacatccacaatggagacgctggaatagtgaagttctttagagttactgttgcagaacaatctagcaccaaaaatgtgcatacatttcacagcataggtcaccatctcaccttcccacaaaatgagcagtccctccagccagattctttttggtgaaatatatcacaaaacacaagctgctcatatgccaacctacataaagcataaatggcataatcaaaatagatagatcaaggaaattggacttcaaattggtataggggattaaagtaacctccttttcagaagaaaacactctttaaccttatgttgttcaactaagcatatgtttttctccatcaccaaaaatcaattgtaagaaaaatcaggttgcataactacaccaatttcacaatacatctattttttaccaagcagcaattttgacaactcatagagctttggcaaacaaattcccccctttttacaccaaagcgcaggaaacgtcatccgggacagcaatccagttacaagtcaccacaaatataattttaattgtgagaagctcatgtgcagcaagtaactgaacgatcatcgaaatcccagttgagcatgatgtccactcaattaactgctagctaatcgcacaacgagccatcaagtcaaccttccaaagtttcaccggattttccactttccaaaaattctacacgcgcaacactgttgcttctaccccggcacagtttcctcataaatcaactaatttgggcgccaatacgagatcaccacaaatggtaatggtaaaaatcacatcaaacaagtaataaacacaagttgtagccgttggaaaaacaaataaatttagggagaaaaagaggggaaatcatcgagacgatatacaggaaacaaccaaaaaaaaaagagcacagcagctaattcatgcagccagccatttcagccgcggcgcgtggaccaccatgggcgcgcacagcaagctagcgcggaggaggaggaaccgagagaggaagaggcggaggcgtacccgcacttgtcgcagagcacggcgaagccaccggatcgcagcggccagcccttcctccactcccctcccgccggggacggggccggggccccgcacgcggcgttcatgcacctcttcgccgccaccaacgccgccgccgccgcagccatccccgccatggccactccgatcaatagaagaagaaaaagaaaagctcaccgcatcaccccacccacacagctcgagcctagtagagagcagtaaagatcgaggcaagaggatgatgcggtgggtaggggaagcgtagttttccggtggatgtggagatggcaccaaaccaaaacgatcgatcgctggcgactcgggtgcggatgcggggaagaaaaggaaaaccaaccagatggggggagcaagaagaggagactgaagaattactcctgctgctgatgctgcagcagccaaggcgcagtaaatacttcagtaaggtattcggttcaccctgtgctgtactactgtagtagtacaaactacggaggaggggacgatgtgactgaaattttcatgattttccacataaatattacactccatagcagcaagtttaatagtatagctaactaaaagttctaaatcatcttaatttaatagataatttatcactaaatatatactactatactattaatatttagtcacattgttatacacacattacgttttgaagtttatgtagcaccgctgttcgtctctctccttttatctactcgatatgtatatataactgctctattatacctgctataaggtaaagattgggagcaaagtgaggaagcttttctctctcttttttgtttcataaaaaaaaggagatatttaaggattgcacagttgcacgcacgcacgacatgctctgctggtttaattaatttttctctcttgggccgggtcctatgctgcggtggcaggggtgtggtgttgtgttcgcgttgcgcgtctccacgactttgcacgcaggtcaggtgtctgcagtgcaggtgcagtacttggctgtcgatctgccctctctggtctctggatgggggtgaactcagtctgtgtccgcaaatgccaatccaccatcccagttgttacagcgacacctgcgttactgtataaacaacgggatcctctctgtctctgcgtcctggttcaagtcaccgctatacagtttcaatgcagaaaatttgcgagaggatacacatgctgaacagagttgaatttttcactggaatttgtagtactgctagtatattctctgggatgaaaacagaggaaatgattcgctgccgctgcgtcgtctgcatgcatgtcgaacgggggcagcagcagcaaaaaaatcgatcgatcgctgcacgagcacgagccgaattgaatgcacaaggaatgccactaccacgacccgaccaatccccaatactagtactagaactactactaggagaggcactgttgcagtccagccttgaataccgtcgccaacccaggcggccaccgcgcgcgctgcatgtccggcggccaaatctcccatgaaacgtcgccgtcggttcaggtgggagcccgcgccgagccacacgttactctgctctgctccacccggcgcggcacacgcacgcacaaccacgcgcgcggcgcacctcacctcgtagcacgcacgcacgcacgcgagcccaagcgcacggtgtgtcgcggtcgaggcggggtggtggcggaggcgcccgcgacgtggacgccgcaaccgccctcgtttctttcctcctccactcccacgtcgcggctttcgctgacgtgcgcgcgaccacgaccgggagagagctcccgtgccggccccgcgagtcaccatgccatacgtgccgctgccgtcatcagcccgatcgatgacatgtgggtcccgcgggggcgtgggtgcggggtggggtccacgggtcaatgtcccgggaccggtaaagcccaggtagagtcctactcgaatcccccgtgagcgtgagagagggagagagagaaacgacgcgagcgcgaggttacgtgcacccggcaacggtggccgtcacgactatgacagctcgggttgttggggcccacgtggaagcgagtggacggtgttggtgggacgagtggaaacgaagggggagaaggaatgatgaggtagttgaatgaatggaatgaggggaataatatactcctactccgtattccgctcaatgggagtgaggaggcaggttgattgattggtcgcctcgcctcgcccgttgggtttgtgcttggttcgagcggtttagtatttttggttggggtaaaaatggtgggctggtagccgtcggccgcacagacggtcacggcaacggcacatggagattagaatgtgacgtaatataagtaccataaatttggacaaacttctgttcaaattcattatactatattacatctcattccaatcctaaattgggttttaccgttttacaggacggagagagtacttaattgtctcctactccctctgtcgaaacatgaattcggcaataataaaacggggtagcgcacgagacctaaaagtggatggatgcagagacaaaggatttagacaggttcagaccctctcaatgagaggtaataccctactcctgtttggggatttgaatccgccgggtgtagtatagatctgacgatcaagttgtctcctgccccctagagggcctcctgcccaccttatataggatggggggcaggattacaagatagaaaccttaaccaacacggtatcggtttcctaaatctactttacaatcttatcaaaccaggactttaggccgttccataatatacagggaaacgtaatacccaagtcataatctgttacatatttcatatatataagttatcccctataactagtcggataaccatgccgtgtgggtatggggtacccataatctccacagtagcccctgagaccttcacagtcgaaaagataatcttctctcgaactagattactccaaaaccgagtacttcaatcatctttgccatggtctcccgagtatttttaccaaatctgaagactgtggagggctgaaaaataaagtcaggtgcatcgactagatgcaccgagtggtttcgataattatagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacacatgtaacatgctcccgggtgatatagaccatgtgatctgagtgattatcccttatgggatactccaaaatagatataacaattgaatcccgactggcgcaagtattcagttgataacccttacggggaataataaatagtccagtctttgagcatataaaatagacccatgatcatgaattcatgttgcatatatccggagcaagtccaaattgaagatataatacttgtatttgagctagtaagcccctgagcacgtagtcacaattgttcattgatggtagctgacgcagttggcatagagacaagacgacctatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagtaatgatgataagcatcaacagagatgatcaaacatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttagcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacatggcattgcatgccgagatgtcgaggttcacaaagacgtcgtgggtggtgaagtagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagctccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcagcggacgaggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggtggcggacgaggcggccggtcggtgaagacgtagacgcccaacaacggcggcataaaggccagccgtgcaggcggaaacaccagtcggcagcggacgaggcggccggtcggtgaagacgtagacgcccaacaacggcagcataataggccggccgtgcaggcggaaacaccagtcggcggcggtcgaggcgagccggtggtgacgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagttttacggatcagaattttctactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcgggggcaccactcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccatgaacggtggtgtgaccaaccaaccgtataggcgaggacaccagtcggcggcaacggaggcaggccggcggtgaagtcgtagacgcccaacagcggcggcataataggccagccgtgtaggcagaaacaccagtcggcggcgacggaggcaggccggcggtgaagtcgtagacgcccatgaacggtggtgtgaccaaccaaccgtataggcgaggacaccagtcggcggcgacgga

SEQ ID NO: 9909 - DNA, 2746 bp, Oryza sativa
gcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccatgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttgacggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccggcacaaagttccatcgcacttctcgacggaaaactcgacgcggcccctacctggcgcgccaactgtcgaaacatgaatttggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcaagttgtctcctgccccctagagggcctcctgcccaccttatataggatggggggcatgattacaagatagaaaccttaaccaacacggtatcggtttcctaaatctactttacaatcttatcaaaccaggactttaggccgttccataatatacagggaaacgtaatacccaagtcataatctgttacatatttcatatatataagttatcccctataactagtcggataaccatgccgtgtgggtatggggtacccataatctccacaccctccatcccaaatcaacatagtacatgatgtgacatcttagtactatgaatttagacatatatctgtctaaatttgttgtactaaaatatatcacgttcagttctagattttttttttcgcgcgacggatggagtaactctgtactattactattgatccattttagtctggatatactagttgttcgggaaagctagctagcgcgtgcgcgccgccggcgcatgtttcagtgagttaacctaactaactagttagttaaggataatggcataattaggagaagattatctttttgttgggatatttttactaatagattgaaaacttttaaattagatttgaaaacttttgacttaagatttaaactttgaagtcaaattttaaaatctttcaactcaaactttgaaatttttctcttaaaatttaaatttgcaagacaaattttgaaaattttcaactcaaggtttaaaaacttttaagtcaagatttaaaaatttttaagtcaagctttaaattcaaaacatttgaaaacacgtgtgttgaagattaaaaaaataatcagaaaaagtgtaaaaggtaaagaaaaaatttcatgaaaaaaaagaaaaaaatcgcgtgggggaggggctggcgcgccaattaaccaaaccccctagttgttagtgtatgtcatgtcgaaaagtctcaaaacttacgcttaagcacagaaaaatattgccaactcatcgtgtgacatggttagctgccctttgtgtaatttattttccttatgtatgcacgtctagattgttttttataaaacacgtcaaaatatttaatgctttaaagtttttgtttattataatgatgtagctatcggcctatctctgtttgacgtataagttatttgacgtgtaggaaaataagtttttgtaatttattttccttatgtatgctcgttcacctccagaaaaaaacatgttatcataagaaaatacaagcttataatacatcgtacattcatgcgacaacgcccttgctataactcacaagtcccttgtacacagttggaggtggtgtggtggatttatataaattccccatcaatcaccaacgcaagagagagaaaaaaaagaatccacatcaatcggtgctgcttaaaagtgatggttaaacaaatcttgacatactcgtatactacaggccacaaagtaaatgaatgaatggataaaaatggctcagaatacgattgcctgtcacgattgcaatcttagaatactatattgtgcactattgaccagtgaaacaaatgtattttttcggtatgaatatgagatctttcgatggttaaattaaaagcaaattcagcacaacttaaatgcctttctagaaaaatattgcgcaaaaatggtaaattagtgcaaaagcctgcaggcgttgattttatctcggacggatgcgctggtagttcagttttcatacgaagttattgctcctctcccttatcatctcgcatgcaaggcttcgccttattctccacagcaaaggcagg

SEQ ID NO: 9910 - DNA, 15315 bp, Oryza sativa
actaaatattaatagtgtagtatgtaactattgtattgatgaactattagattgattatagatgaattagagctagtagttggctatactacgaagcttgctcttagtagttagtagtaagtggaggcaatgagagcagggttgggcaggcctgtctacgtgatgacctttttaattcattgatagaacatacagagactgtaattgcctctcccttttgcccatgatatctgcatccaacgcatcccatgaccgtgtagttgggtttaaccgttgcatcttgagataagaaaatcctcagtcacactctaaaataattttgcatgctcgcactcgactaatgcatgaaactctgattcattgccattgttacagacttacagataggacaattactttttttttcatatggcctatgtggagtttagaaaagaaaaacaaagatagattatgtgtctcaaaaacatgtgactttcaattcaacttatacaaagttgtaacaaaataaactatgaatgtgtatattagttttagtttaatttatatttgatattgcatatttatacactggtataatttgtattaatttatcttgttatttttataattattgagatgacatgagaagacgagaggacgttctctccacgaataaaaactctttacctgtttatgaagatgctgcatgtggattgtggaccatgcggggttgccctaattgagagcatctctgttcctaattgttgcggttattcggagctggtccttcgtcttgaacacagtcgccaactcgccatgattcaacgggaaaaaaaatggggccgagaggtctcagagctgcctgcgacgattcaccactttcagggagcatccagctctcctgtagcaccgaaaacacacacaggccattctttctactgacagtatgtactctaggcctaccgttcaattcgtatactactacgagtacgttgaagctactcccacagtctcccacattcacactctcgctaccctcatactgtactacagtatgagcttgtactccctccgtttcaaaacgtttgacaccgttgactttttaagtacatgtttgaccgttcgtcttattcaaaaaaatttatgaaatatgtaaaaatatatgtgcacatgaaagtatatttaacaatgaatcaaatgatatgaaaagaataaataattacttaatttttttttaataagacgaatggtcaaacacatactaaaaagtcaatggtgtcaaacattttaaaacggagggagtatataagagctgacaccggtgggaacggaggaagcttgacacttcactaccggttctctcgaaccataggattctcgctaaaccctccttaaaacatacttcttccgtttcaaaatgtttgacgccattgattttttagcatatgtttgaccgtttgtcttattcaaaaaatttaagtaattattaatccttttcctatcatttgattcattgttaaatatatttttatgtaggcatataattttacatattttacaaaagtttttgaataagacaaacgattaaacatgtgctaaaaagtcaacggtgtcaaatattttgaaatggagggagtatatactatatctatgaaaaaaaggttgaagctttggcctggtttagttggtaaaattctttgctcctgcgtgtcacatcagatatacggatacatatttgaaatattaaatgtagtctaataacaaaataaattacaaattccgttaggaaattttgagacgaatttattaagcctaattaatatgtcattagcaaatgtttattgtagcaccacattgttaaatcatgacacaattaggcttaaaagattcgtcttgatatttacacgcaaattgtgtaattgatttttttcatatttaatcctccatgtatgtgtccaaacatttgatatgataggtgaagtttttgttttggtaactaaacagctcctttatctctatgttcagccatatactactatttattgctagatttgcctctaacaggtgattatattcacaactaattaaacattttgtacgaggtaaatgcttaaacatttatatacatatagtacttcttccgtcctaaaataacgaattttgacagttcttcagattcgttattctaagatgagatttagtccatctttcttgctatcactatattttggaacgaagttatcatattgtggtccttgctgtatgtactggcaaggtttaccgcacgattatcgtggttatcacgtgtgataactttcttaaattttaacattacgatatatctcgcggtaaccgtacggtttttacaataaccacgtagttatcgcaataaccgttaaactatgggacgatggtaaccacccaaaaatagtttggggagccctgtgtgcaggtcacttggtcagagcaataataattactccaactctggatggaaacaagaggttacagtatagatcatcgtcgcacagttaaggctggacccatcaaccatatgcacgcaccatatatagctgcagcactcaacgcgattattccaaatggacccttgtttcggaccgttgccgatggtagcgaaccgccattttgcgctggctctgagggcctgacgacgtcagagttagggcttccctgggtgcgtttgggccttcaattaccgtacacgataccattaagcccaatattgtttggcccatcaactgctcagcccagagccccaaagaaagccaccaactagacgaagaaggaacaccagcactctttaccatttctaaaaataagcatttctagaattcaaaattgtactactacgatatatataagtatttctaaggtattgattccaatacatgaaaatttgtacattttcaaccaatgaaatgcttgggaaagtaatctaaacgattcaaagtttaaaatttgaccactgaaatgactttagaagatcttttttcaatgcattagtttttactaaaagaccaatctagaaattcctttattttggaaaaggagagcagtacacaaccaattaggtggcctgatcgatgaactcagaaagcctgtcgtggatactattcacttttaaactttgttcgctcgtcttttttacaaaatatttacaaagacaaaaggattccacattatttaaacatattatgtcctaatataaacatgaaactttaactcaatttagtctaacaattttgtagtgcaatgttaaaggcaaaatagtcggttatttgaaaatgtgaaacggatggagtacaatccccagcaagaaggaacatacatatgcttacaaagcctcatcaacagaagtgaacattgctatgctcgtggaatcctcaactcaaatcttgtttaggtgtagaatgctcttccggtctctttattaaggactattgtctgaacaacagtatttacaagcttttaacatataggagtatctcgctgaaaaacaaaaaaacatgtaggagtagagtaagaacaagaccagaagctcataattatgactagaggccaatgaggtgttaattctggggagatcctaatctgtcctgcaagtttcagcaaagagaaaaagaggatatgcaaaaatcttgtcgtttcagaaacataagctatactgaatttttttttatcttctgggcacaaagggtagctccaagcctaccactctgtcaagatggcgaccaccgatactgctgccagctcccagttaagcttgctgcaatttcagatatcagcatgctccacaggacgatgttgattcggtgtttcttgattctccaggggcatgtactgagccatgatcgcacgaatctctgaatccatgtaactctggtttggcatgatggtaacacaaagtatgagttagccgtagattattgcaaacataagaagaactagaaaattacgtgatcattcggagatggattagaatagaaggatgagttgtttacccgtagccgatatttgtatacggcatatgctccaattccagccaaagcgaggccaaagaaaataacccaaaggaagccccagcccactgacgaagaagcaactttgcctgcacagtgattgcgaaaggcgtcacataaaacgttctaaagcgaatgaaattatgtgtgcatcaaagttccactcctgttttgcatcaaatcaacataacataacatacaacattttgaatgaggcatgaaagaattgtgatatctttcaaaaggaatttggttgtgatagtccgttatcaaacatgacaatgatccagatcatggcgcagtcaagcagacttgcattgcatattttcaagccgccagcagatggactatcgcaaaagcaaaactaggaacatctgaaatttctacagaagtttcaaggctgagtaacaagggatgatacaagtgtatgttgggataacaatctcagaacatgatcacaaggtccagaatgccgataagtagaaaattgaacaatataagactacaagggaacaaaaaaaaaggttaggggactcactgatgcaagtgtcatgctctctcatgtataacatattacttccaccacagctgcactcatagcttccccatgtattctcacaagagcagtccttgcactggcagaaaagcttgtctttgcattcatcaatatctgaaaacgccaaccagagatatgttaagtaatcacctaacagtttcaaactattcagggtttgccagtactagtttgtatgggttttacaagatggttggctcaagcagaaatatcaatctttctatatttaaaaggaaagttttgccacatggagtaatattaccttcacaactttttataccatcacccttgaaacctggtgggcatttgcagcctttagattcttcattctgtagagttccatgattagttctgacctcatagaacagccgcaaactagaagacctctggaagagattcttactgagcaggcagaaaccgtcttcccatttttagtttccttccagcagcctccgttgttgatttggcacctaccgacaccagaagctgccaaagggccagccgtaaaccaaacaatgtaatactaatagttgaaataataaaacaattaggatgtgttatgcatagcacagtctatagcaaggaaacagtattgtttcaaacaaatgaaaaaatgattccaaagaaataaatgctgccaacccatcttgacgaaataaaatgcaaatgtgtaccttcacagtgagtgtacccgtcaccaacgaacttcacaccacgggcaatagggcattcacaaactcgcccacggaaggtgtcctacaatatgtaacacagcaaataagaatgtgcacctcaaactgaatagaggtgaatgtcgtaaccagtatcagattatcaataggtagtactacctccgtttcaggttataaaacgttttgactttggtcaatgtcaaactgctttaattttaaccaagtttataaaaaaaagtagtaacattttctattaggaatgtatagccatatatgtataggattcttttgtatccttagtttccttgtatactcctctaattgaggaccctgtatattggaaaggctataatatatggtcaccccccctctttggggagtgtggtgttccctcctattctctctacatggtatcagatttcaggttctactccttccttccgcacccctgatctcccctctgtgttgcgccttgcgccggcgacgtcccctgctggtcgccgccctcctcgtcgccatgtcgacgtcttctgccacctctgctgcgaccgacaactccacagcatcggcctccaccaactccgtcgcgaccgtcttcgtcaacccgtacgcgaccatctccgtcaagactcatgtcccgatctccctcgagcttcgcaaccccaacttcaacaagtggaagaccttcttccgctcgatgtgcggcaagttcggcctcctcgaccacctcgacgactccgcacctcctgcagcccccgacacctcatgggagcaagccgacttctgcatccgcagctggctattcggctcggtcaccgacgacgtcctcgacctcgccatggaaccggatcagacggctcgcgccctttggctcgccatcgccgacctctttcaagcgaacaaggaaccacgtgcaatctttcttcatcatgagttccgctccatgatccaaggcgatctctccatcactgcctactgccagcgcatgaagacggcagccgatgcccttcgcgacgtcgggcaccccgtcacggagtcgcagctggttctcaaccttctgcgcggcgtcaactccaacttcaccagtacggcggacaacatcgcaagtgctcctgtcctcccgtctttcgcttctgcgcggaacacccttgttctcaaggaactccgtctggccaacgacgccaaagttcagacagagaccgcccttgtcgcggcaagcagcgctgctgcctcttgcccctcgggctcctgctcctccactggaggtggcggcaagggtggaaacaagaagaagaatggcggccgcaactacaaccgcaatggcggcggtaacaacagcggcaacaacagcggcagcggtggtggaaatcgtcaaggcggcggcggcggcaccttctcctttgctgtcccgcgccccccaactggaccatgggtctgtgtctcccaatgggccggccagcagcagcagcagcagtggcgcgcccccggcatcctcgggccttttcctcaagcccacaccgcctttgccggcccgtactcgtcgccgaccacctctgcagcgcaaccggcctgggatcaggctagactggtggctgccctcaaccagatgacggtccacagccccaattcttgggtcctcgacaccggcgcgacctcgcacatgtcatccaccgatggtatactcgttacccgcttacccaactctcacacctatattactgtcggcaatggtcacactattccggttttatgtcgtggctcttcctttctacctataggcaccaccaaatttgatctcaaacatgtccttgttgctccttccttggttcgcaatcttctttccgttcgccaattcactcgtgacaaccattgttctattgaatttgatgagtttggtttttctgtcaaggacctccggacccggcgcgtgattcttcgctgcaatagtcatggcgatctctacaccctaccggcagccgcaccacccatcgccgcccactgcttccacgccacctccaccaccatttggcatcgccgccttggccatcccggatctgcagccatcctcgctctatagcgcctctctgccataccctcgtcaaagccagatagttccctttgtcatgcatgtcaattaggcaaacatacccgtcttccctttactagatcaagctccagtacttcctctccttttgaattagttcattgcgatgtatggacatctcctgttttgagtacctctggctacaaattttatttggttattctcgatgacttcagtcatttttgttggacattccctcttcatcataagtctgatgttcaccagcacattgtggattttgttgcatatacacacacacagtttggtcgccatttgaaatgcatacaggcagacaatggcgctgagttcgtcaaccgcagcaccacctccttccttgctagccgcggctgcctgctccgcctttcctgcccatacacatccccgcaaaatggcaaagccgagcgtgtacttcgcaccattaacaactcagtccgcacccttctcctgcaagcctccatgcctcctgcctattgggccgaaggtttagccacagccacatatctcctaaaccgacgtccttcctcatccatacagaactccatcccattccagctcctccacaataaaatcccggactactccctattgcgtgtgtttggatgtctttgctaccctaaccttagtgccaccgctagccacaaactcgcccctcgctctgccgcatgcgttttcttaggctatcccacctcacacaaaggttaccgctgcttcgacctctccactcgccgcatcatcatttctcgccatgttgtcttcgatgagacttgttttccgtttgctcgtcacccggtcgatgtctcttcgtttgattttctgctacaggaagtgactactcccaccgtggtcgctccacccgtcacgggtgtcgagcaaccgcggccctccctgccccgcgccacggatgacccggtgcggtcgtctttggtggctgctccctcggctgaggtcgagcagccgcttcttccctacacgatggtggtcccggctgctgggttggcttggccggctgctggggacccagtgcccacgacccggacggccaccgggcctcttcttccaactacggcacggctggtcgagcccttcccgcacgtctatcgacgacgacaggccacgccaccaccgcgcctcgacgctgcaccggcacctcccctagtcgtgccgcccccgccaagccgcatggtcacgcgctcccagaccggctccctcaggcctgtcgaccgcctcatcctggcggcttcccactccgctatctccccggttctgaccaactaccgcagcgcgctcgccgatcccaactggcgtgctgccatggcggatgagtacaaggccttgatcgacaacggcacttggcgcttggtgccccgccccccgggtgctaacatcgtcatgggcaagtggatcttcaagcacaagtttcactccgacggctctctcgctcggtacaaagcttgttgggtggttcgcggctactcccaacaacacggcatcgactacgacgagaccttcagccccatcgtcaagccgtccacgatccgagtcgtcctcagcattgcgacctcacgatcatggcccatccaccagctcgatgccaagaacgccttccttcatggcacgttggacgagacggtgtactgccagcagccctccggctttgtcgacccggccgcgcccgacgccgtttgtcttcttcagcgttctctctatggcttaaagcaagcccctcgcgcatggtaccagcggttcgccacctacatccgtcagctcggatttgttgcctcgacctccgacacgtccctctttgtctacaaggatcgagaccgcatcgcctacctcctgctctacgtcgacgacatcatcctcactgcctcctccacggatctacttcgcctcatcaccactcggctgcactccgagtttgccatgacggacctcggcgacttgcacttcttcctcggcatctccgtccggcgctcctcagacggcctcttcctgtcccagcgacagtacgccattgatcttcttcagcgagccggcatgtctgaatgccaccccaccgccaccccagttgacgctcgggccaagctctccgcctccgatggcgcccccgtcaaggatccgaccgagtacaggagccttgcaggagctttacagtacctcactctcactcggccggagctcgcctatgctgtccagcaagtctgcctcttcatgcatgatccacgggagccccaccttgccttggtcacgcgcattctgcgctacgtcaaaggctctctctccgccggactccacatcggcaccgggcctgtcaagtctctgacggcttactctgatgctgactgggccggctgtcctgactcacgacgctccacctccggctactgcgttttcctcggcgacaatctgatctcttggtcttccaagcgtcagacgactgtctctcggtctagtgcggaggctgagtaccgcgctgttgcccacgccgtcgccgaatgctgctggcttcgccagcttctccaggagcttcatgcccccatcgcctctgcgaccgttgtttactgtgacaacgtcagcgctgtctacatgacggccaatccagtgcatcaccgtcgcacgaagcacatcgagatcgacattcacttcgttcgggagaaggtggctctcggacaggtctgtgtgctccatgtaccgtcgtcccatcagttcgtcgatatcatgaccaaggggctgcctgtgcagttgttcactgatttcaggtccagtccttgcgttcgtgatcctcccgttgcgactgcaggcgggtattaggaatgtatagccatatatgtataggattcttttgtatccttagtttccttgtatactcctctaattgaggatcctgtatattggaaaggctataatatatggtcaccccccctctttggggagtgtggtgttccctcctattctctctacattttcaacccaaaacaaatttattatcaaaatatattaaattattgatttgatgacactaatttagtattataaatattactatatttgtctataaacttagtcaaacttgaaacagtttgactttgtccaaagttaaaacgtcttataacctgaaacggatggagtagcatttttccattaaaattttataccttgcacgcagtaaaattattagtcttgtcctgccagcaccctccattgctctccaaacattcatttgtttggatctctataaacgagagagcaaggtaataaaaggagagaaaaatcagtacagcatcgatcaaaatcagtaaacttcataaaatgaaacataaaaatttacaaaccttgactcaaacaaacatcaggttcagttgtctcctcaaatcctgagcatactgcttttaacacagcacttttctccagcttacctaaagagagactattatatgacataacaggctacagcatcgagctaaagaaaaattgcgcaatagatactactagtgcacctctgtactgcttgttgttaacgacaagggtcggcaatatagtgacatctcctcgagagccttgaccaatctgaaaggacaaaatccacaaagatcaacctaccacagaactattgaataatttatgaatgaacagactctacataacaaaaacattatgattagtaatcaatagtctttacttgagcatcttgttccgctttaagcacgggattttcttcatcagcttcagggtctcccacacacttgttgatcctctcaaggtccaatcctgtgaaatgacatatcaaatggttcaaatcaaccatttggttcaaacaataaagcaattatgctgaacaaagttaactacaccaaccaagtgacttgataacaccattagcgcattcacgcgtgtatttcttctccttcattgggcacctaattgaaaaatcgtgtacataatcccaccacacccatggtttgtgagtttcattgccaaccttgaacaagcaaatctgaatcaggttctgaagcacaacatcttttccatcatatccaatgttgaaatcctgctctggatctggagcgcagtatctcccatgattgatacactgagatctgcactgcttgctcaggacaaaagcttccggacaataccatgtaatgtagtgaggggtgaactgagtgtaaccccttttctcaagaacctgtgctgttcctctgaagttcctcacaaaattcatttgcatgtcacatttggcaccacattcatcgttgctgtttgtccagaattcatactctacacgctcatcaggatgagggagagattccctccaatccagaaggacattgaccatatcaccgttttccagtgctttcttaaggtcgtccccaaacttcttcgttacaagtgctgaaggaacagtaattttctctatgtaatctgtgccactagactctggagagtccattgttatcaaaggctccaatctatcatcggcaacaagaacagctgcagctccagcggtttgagcattccatccctttgttgtgaagtagcagtctgcacatcacaaagaattaaagatccccactttgaacaataaaatctgctttaacagttacattacgcctaagaaacaggagaaaagaagttacagccaaacatacaaatggcatgactacattatttttatggaacacaaagatactgatatttcttcttccataaaatgtaattaccaacaaataatgcagagttgagaactttcacctcctgtttaacctaatattcagaatgaaatccactaggctggttcacatatttatactgatggccatatatacagttctatgtatagtgtccatttctagctctaaatcgccttctatgtgcagcttttctaccaataaaactgtagccaaagcagtgacataagttgtagagcaagacctttgaaattgcaaagaaagaaaataaatcctttttgaaatagcagtagccgcaaaagctaaataatttggacagtcaaagcacatgattttattccctgactcactcaaaaagcacaacaactaaacgtaagcgtgcacaatctttctctaaacaagatttgaccatggaacccagctacttacccaaaattccaacaaaccatgtaccgaacttacaagcagatagagaactgcactatatgccaactaccaaatcaggtaccctactaattaggacaaaattgcatatgaaatgacaaatagcgtgtatcgaattatcctagttaaggaaaaatccatgataaaccattagacaataaaaaagaactaaagcagcttgtaatgacagtgcacccctctgccaaacttattcactgacagaatatggctacagagtacaaaatgaatcgttttccttaaatggactgcagagtacatagacttccaagttccaaatcattttgtttgggttaggagttaagagtagaacaattcaagaacatgttgttattaacattaggtgcaaactttcagtcaaaagaaaaaaaaacattaggtgcaaactgctagttaggacaaaatgagaaaaaaaatgcgagtaacattattaaatttctcatatcctagaactagaagtgactgttagctaggaccacattcaataaataaaataaattaaaagatgcgatatttaaaatcactcacgagagggaaaataaatctcccccaataataaataaaaactgaaacgggttcgaataaatcaagaaagggggaggacctccgcgatcgacgaggaggaagatggggaggccgccgggcttgggcttgaaggagaggtcgaagtcgtcgaaggacctgcaggccttcttgttggccttggggtagacgacgaccccgtgcatggtgcccccgtactgcggcatcccgaagttgccgatggcgcactcgtagacgccccggagccccgccggcgacgtcacccgcaggctgttcttctccaccacgaacctccccgccgcctcccccgccatggacgccaccaccacgagcagcacggcacaccccatcatcgtcatcttctcccaattaatcctcggcaaaagaggattggggatcaaagaaaagatgggttcttggatcgagctaacgatcgatcgatcagaaatcgcggtttgggtggcgtggtggcttggtagggagaaaaggcgaggcgaggctttcgcgggagcaggagtgcaataaaggaagcctgccctacgaaggatttgaccgggagctatcggtatcgctattgctaatttgctaggattgctaaagctagcggagtgagatgagatccggagatagagatgtactccctccatccaaaatatttgacgccattgactttttaaaaaatgtttgaccgttagtcttattcaaaaaatttaagtaattattaattctattccaatcatttgatttattgttaaatatacttttatgtatatatatagatttacatatttcaaaaaaaaatttaaataagataaacggttaaatttgtttaaaaaaatcaacggcattaaacatttagggaagtagggagtatgtacgtggcgagtgctcgtgggcattggggttggaagttggaacgcttccaatgcagatgtgtcactgtacatgttctattctcttcttgctcgtctcgtcttttctttgcttttgcgtctcgtgttcgtgagcgtgagtatcgatatcgtgagggctcggcgaccgggcgcctttatgctagaaaattgacgcgccttatggcgcgataagcatctaacccgtatacattttatagaacacatgtaaaaaaatatataaaaaaattaaaaatatatttttacaacatatatatttgtattgctaagatggctcgaaaaaggttatcattttcgctctagatggtagaaatttccacattagtcactaagaaataaaaaagatttggaccattagattcaaaacaaaaaactagcagttgtatatgagatccaatcatattttaaaaatcttttgattagaaaatacaattttattttaaaaatagaatttatattgaatatagttctacttttaaaatttagcatcatgcaatttacagaacaatccgctagtttttaataaaacatgaagtaaatcatattattatggaatccttcaaattccactatttttcatccaaactgtttaaggctcctttgtttgtgtaaaattataattgaattgtctactgaactaaattatataatacatgattttttgaacacttggaaaaaaatatatctcaaatgtgatacaaatcacgaatctatcgttagcgcccatatttctaaccacattatttatattttagaccgggccatatattttgttgtcttttcctttttatggccataccggtgaactctgtcaaccaaatctgcatccaaccagcctgcaagtagtaatacactcacttatgtttcttctagaaatcaccagggtcctctcaaaaataaaaatcatcgcatggattgatccactggacttttctggattttttttctcaccaaatagatacgtgtcaaataattagaggggaactaatcagctgacaataaagattatatagagagagataggaaggatcacctctctatgtttctcaaagagaggtaaatttctagaaattgtaccagattgacacgtggcaatttttggagatggttagctaattttttcaggctgccaggtggcccaataatatgccacgatcagcaccctgcaatcgatatgtaagatatcattaatctggaaaagctgtctgtccaaatatatactttattttaatttttatgtaggattgtggatttatgtccaacgcttacgtccatttaattaaaaaaattattaatatttttatacagttattagatgaata

SEQ ID NO: 9911 - DNA, 27818 bp, Oryza sativa
attttttcagcctcttttcaacaactaaccggagactaatttgcgtcaataaatgaagacagtaacagataaaacgacgccaagacgataaaacagtaaatggttcgatactcaggagctagatatgatatatatccatcgatggatcaattcatatgaaggcagtcagcacgcatacggcagtctgaaagcatgcatctacgacaaacaatcatcaggaccacgaatttatatcactgctaaaccaagaaaaaggtttcgctgagatgagaaaaaaccaagaaaaaggtttcgctgagatgagaaataactcaatataatcatcattcccctcctggggtttacatgcaagagaaacctacattaaaatcaaacaagggaacatgactgtcttttatattatttgcagggtcatccaagttctcttcactcagaaatcatcccggaaacgtaaatgtatcaaaagttgcagccttccatatgcctggcagacttatgcctctggttcgggtttctcaaagaaagttttcttaatccagtcaaatggctgcacaagaaatcaaaagaatattcagaaccggaaagatcatcacatttaagaatttaattgttcacaacaaaaaggtagaagacaacacattaactgcaaaactataacttcaacacagatcaaagttaagagcggaaatcccagattatgtatcttgtaaccagttgtgtaactcaagttacatgttaacaggtagagtaaccccatacataacagatcacataggtataaacgaatattctattcgcatgtttcaacaatgcagcaaaggcctcccagattctaatcacaagaggctaaaggaaagtaaggaacaaagttttattcgctacaaggagcaaagtgcaggtttcagcccaacggaattccacgtcttaggcttaaaaaactaggaacatattccatgaaccataatgaacaagttatatcatgtgctgaagctctctcagataaagaaataaagcacccagacagaaaactgtgttggaacccaagacagtgctaacaggccatgtagggtacatttagctacacaagttagtcacacagcaaggaatcaaatctcagtaaaagtaatcaggaatagtgtagtacataagtcggtcaattaaaattcaataaccggtttgcacagaggtcttgaaagagcaattgctggggaaagctcacccaaaaacatagactcttgccttgcccaagggccatatcacaaagtacaggtaaaaataaattgactgatccaaaatggcgaatttgtttggctgtatctaggggctcctatggtgagtttatgggcatatattggttatgttgaactgtcaaagattttatcagatattcctcctaggagagaacaggaaattatacatcttcactacaaaaaagcccatcagggtaaagcaaatcaaggtagtgagcagaaaactagcaggatctcgtgaaagcaaaattatattacacaactacgataactaaaagtttattatgttatccatcaaatgttgcaaaattcaaataatgggatgtatacttgcattagttaccgaattgtacaatgtaccgagtttaactgtcaatcaaagtttgtgtttttgctaaactttcttctaatatatgcctattaatcatcaggcaaaatatttaatggtatgaatatcatcacaaagttatataaggcatggtagacacagccaaacagcaattcctgtagataaagttgtggccttagtctccacagaatcatttcttcttcccccatcaatttctctatcagatcaagcggcaaatttgactgcaacctacaaaccatatacgtaatccgtgtaacgcgcagaaatcataaggtagcaaatcgaacagaggagccctacgaccgatccaacacgccacgcagatctagggaccgacaacatgccaaacaaacatgacagatcctacctacaaaaaccaaaccctaacgtcgatggggcaaaacatatctacggatcaagacatccctacaagctggggggggggggtataaaaaggcgtcgtggatcgaaccccctgacctggacgaggtagatggcggcggtgccggcgaagacgccccaggtggcggcggcggcgatgtcggtggactgggggcggcgccgtggagagatgaagcggaagaggccggagctcgacgccgggagagccatcgccgccgcaaatctcgtcgcgtcgactcgacctagggcaaggtaaggaggaggaatgcgagaggaaggagacgacaagggttgcggaattttgttgcttgttctcatccttcttccgcgtgtatatgggcctaagtgggccgacgggctgaagagctcgtggtagatgggccggatacactatgggcctgaaacagtacgggcctaaaggccttaggtggtgggttcatctggccttattgggggacagaataactcttgtcatttattcaggcaaattttgttcagtttttctctgaaaaagtaactgtaggtaaattatttttttttgagaattatacggtacaacgcagacactcacaacgcacgcacactcacccctatgaacgcacgcactcaaattctacccttatgagcatcttcgaagactaggccggcaaatccatcttggagattgacgaagtcaccacagacgcctcgctgtcgacggatacgtcgcctaccactgaaagcacaaattaaagccgttaaatcctggaaagacctaaggttctactgaggctcttataagcactagactacaggctctttcgcaactgtaggtaaattattgtgtccaattggattataaaaagtaggaaaagttgctgcactctcagataaacataatcaaattaatacaggttctaattgagcaccaacttgctatatgaaaactgaacttcttcgcttgccgtcttaaaatgtgttgccttttggaattgagtatatatatcacgacaatacagtatgaattagctttacaacaattctccttacaagttgtagtgagtcttgacgatgaaggtgaatcgagacaaaaacacccaatagtgaaaggagttgaatgaaacgtacatgcacgcatgcattcagattcagttggcgaccaaagacaaattcagtagtaaactctcgtagtgtcgatacctatcaagcccagaattattgagccatactttgagctcgtgccacagaaatgtttaatctgatcgagctgatcttaacttttttgcattgtttttgtggacggatcagagtcggtgaagtgaaaaaagggaagaaaattcagcagcacacagtcactagctgagtgtacttgcgtggcaggtggtttttatcggcaagtaaaatccctcgacctaaaaagcatgctcttagttgagaataaacaagtagacagcacatcgttctaactcgcatatccatagttccaaaccggcagattcactgaaaggaacctatgatatacaactaactaacgattccattatatgtgttgcttaatttaattgtaaaggtcatgggagtgatcattagaacaggctttcgacgtaagaaatacacttgaatcgtattatttatatttacgaggaaaagcagaaggatccaaagttcagaacagtaatgcactatctagggaatgttcggaatgctttcagaatctctgttagccaaatcaaacagctttatgatctttagatcgactttcattagccttgagtgtgttgataaccatgcatgtccttttactgatcactagctagctagcacatgccaaagaaaaaaagcaccaaggctttaattttacacgtgtaaattcatggatagaaaactggaaatggatacaaaaaatattctaaactatttgtgaaagagatcgagatcgatcgatcgatcgacttcagaccacgacttggtcacgaagttttcactgctttcgctcgctagctacatggttatcgataacttggagagaattattggatttgttgacttaattgagacaaaaacatggacgagttttgtatatgatctatctaaccgaaagaatagttcgtcgttggggtccatacaagcacgtgctaccttgcttccgctgttgaaatgatcaaagtgtgtgtattatatgtgtagctagagccatgcgacctaatgatcgacaatgtcaacttcaacctattaatgtaggcactatacaacaaacaagagactcaacttgactctctagatatatttatatgagggtcgacttatgttcttacgcgctgcaagttgagaattaaatttcctctatgttttccaattaatcgttcgtgcaaataatccatatatatgcacggtctagaactgtagatcaagtcatcgcaagtgaaaaacaaaagaccaatcaatatctattccattatctaaatatcaactgcttcctgagttccaataactagttactgagctaatatatacctccgtatcagaatatctccctccgtccgtatcagaatctaaaaatcaccctagatgtgtcccatccaaccaaaacttattatattttgagatggaggagtaatttttagctatttatctgaattattttaggatgaatggagcaattaacttgatctaatacttttattaaaattaacttatgttgataattctaaaactacaattacacgtacgtacaggagaccatacactgtatgcatcttgaccatacattggatgcaggtagacacatgtaacaagaggctgaatgaatgccacgtacgtgatggatatatgcagtaattaattaacgcagtcttccgcaggatcttaatttgtttccgatgtgaagtgttttgtctccttgcatgtgtcgattgattgagccatttttcaagtacatgacagtacctataaacgcatgcactagctagctactccctccgtttgtatatcataagtcattttgattttttatagttaattttatttaaatttaattaagtttatagaaaaatatagtagcattttcaactcaaaacaaacatgctatcaaaatatgttaaatgttagatttaatgaaactaatttagctttttagatgctactaagtttttataaacttaatcaaactaaataaagtttgactgaaaaataagttaaaacgatttataacataaaacaaaaacaaactgaaggagtaattttaagtagaatgtaagtcaatagtctaagtcttcggggtgaaagactttgataggtggaaatggacttggatggatcggagggagtagtgggccgctaatacgaaagtttgttgtgacagcaacttctgaattctgaaaaaactaaaaagcttttccaaacttttgttgtcacgggggggcaacgtggatatccatgggtccaggcaagcatctattcagagaaaggccttttagagcttgcaagaggttagtggcatgagtgcacaatctaaacaaagccacatataaaaaatattatgtgtagttcaagaaaattataaattatgtgcagtagcttaaagggcataaattaaaggctaaccacgaactggattgataccagccggcaaaaccatgtacaataaataactacttcatcaaatagttgttaactaaactatgctttaaattaaactatgctttcaaattaatcttatcaaaatcttgccatttcctctaagatatagaaaggcgttgtcattggcatgatactaaatctgttaagattcgattcacacatgtgcaataatgctaatctaattctgcaaattcagcagcaagctatactatgcatacatgatcgtaactaattgacagagcagcaacattcttgttccatatgccatgcatatggtagatttttccctcgaatccaaggaggaatgacacatatagagttaattacactatggtccaccttttgttaccaaagttttattttgggctatcctctaactcatattttcactttggacctttggtgcacttttaaccacccaaagtcattttatgtagctgcatctactctataatattgtaaagaattgcccgtgtaagttgaaaaagattaccggtttacaggttgctgatgtgtttaaagttggaaaattcatttatgtattcctaaaaagtttatggggtggtccaaagtgaaagaaaggtaaagtaacctagcccaaagtgaaaaaatgtgttaaagggtggtccaaagtgaaactttggtaataaaaggtggccctaacgcaatttactcacacacatatatataccatgaaacttttcaccatacatctatggtgtcacatatgcacattaatttatcactaagaaaattcaaacccacgaaataaaaaaaagataaatttagctgtaaattcttttccacaacttttataatctgtttgaataacattatattttggggggtgaggaacatatgcatgcaagggacatcttgctccctataaaatgaccactctgaacaaaaaaaaagtaacagcatgagtttattggagtttttatctagacataaatttgttgtcaaatactccctccatacttgtaaagaaagtcgttttggacagcgatatggtctctaaaacataactttgacttcttgtttctataaaagtatttattgaaaaggtgatatacgtatacttttatgaaagtatttttcaagacaaatctattcatataatttttacattttcaaactcaacaaattgagagttatttatgatttatattcccaaggtttgacttaaacattgttctaaacgacttcttttataagtacagagggagcgtacgttgagcacacacacttcaatttaaagttggtttatgcgtaaaatttccccgctagctagctagattctttcttgcattttatatattgattgttatgttccaaatccaattggacaaactaaattaaattagattagatctttcatctagttatttttggagcattaaatgacctatatataggtagcgcaaaaggtaacacggagtatatattactttcactactatatattaatttcaaattatgtttcaatacttacaaaatcacatacacacaactcactagtacagcgatcaactaatacacatatttactacgtaccgtatatatattggatttcctccaatagcagtacacacatgtactacaagtattgctaatttgctatagcctcacagcaatagtattatgcatgcatgcatacacttctgcatgcaaatagcggacttgtttttcttgaatattagtagtagcaataattagcatggcaagaatgtatgcatgcacagcccttgttaaggatcgaagccaaacatgtcgtcgtcatccccaggaagattcccaaaggagccagtcatgaacccgaggctgctgggagaggacgggaagctgccggccatgtcacctccggcgagccctgacggccagtcgtaatccgcaggcgctgaacccacgatcgacgtcgacggcgttgtcaccgccgatcccaccacggcggagagcggcaggctgctgctgagcgccgccgcctcgctggcgcactccgaggacagtaccggagagtggcagttggcgaagctgcaggacggcgtcggatcaacggcttctgccatcaaacgatggcggctctgacgaagagggtcgactctgcttgtgctcgcgccgccgctggatccgaagctgatgaggttcgcgtagtctgcagcgggagcttcggcctcgacgacgaacgggatggtggaagggtcgctgcaggtgtgctcaccgtagtagctgatgacgaactccgacgagttagactcggaggtctgtacttgctttgtggccatacaaccttggtctggcctatgcgtgcacctgtagtagctcctgcagagagatcaacaactagatctttaattaaggaatgcaagctgcaaaattgcatcgtatgatgctcctgaatagataacatgttacagcaacgatttggtgctaactatgctatgttgctatctaataataaatacacagttcaagttgagcagtattttcctactctttttagtaattgcaacaactaactaatacagttcaattgaattaagcacatgtgtattggagtagtatatatctaactatgtgaagctaaccatgatccggccggaaccggaagatcggaacactattctccaattaactggagtagctaagcgagttgtccagttgcattggcaagtgttcgatcggccggtacaagggcctttaatttcttgctgggttaatcatcattacgtactagctaactaccatgcacaagggcgaagaatctggtcatgttactgcagaattagttgaataatctatacgtacataccttggattatttggggagtcctgtatatgtttctgcccgtactttcgccattgcctgccgtcctccagctccttggtcgtgaccatcctgacaaaaggacttttcgatctgccacatgttacagcagataggagcaactatcatatccagagacacacacccaaatctccactagcatgctcggcagaccacggtatgtacgtatacaagagtgtcatatatatagctagttgctcatagcttttggtcttttcaatataagaaacaggaaatgatcttttgtgagagaagaaagctactggtagtaaaaattcccccctgatcattggcacgtaaagttaagattaaaccccactgctagacaaggcaatatactcccaacgtactctccaagttgcataaaggaggtagctagcatgatgtgtgaatcgctatcatatatatgggtaatagtattactaccgcatgtggtaagcatagctagctagttgcgcatccagttgcagatgattattgagaaaaaagggttttaactttcttcaccttcttctaccggagctgctccgcctgtgcggcccggccacggccttggcgcctttcttcttcctcccgcccgatcctcttcttcctcctcctcctccaggcgacatcaccgacagcgagctggactgcagcctgctcatcaccccgtctatcagctgattcagctgcctggtgctcgccgccgccgcacagctcgacggcgatgtcccatgtagcatgctgtggagcatcgccgcttgctcgcgcatctcgagcaggtcgtccataacttcatgtggctccgcgccgccgtctccaacgccaccatcaggagacgccatgggaggagccgctactatagctaattgctgctgctagcagtctagtattactaggaaagctagcaaagtaggaactagatattctcagctttgctactcttgtattgacacctgctcatcagccgtagctagactgctagagtagataggttattgggcagcagctgcagtttttattggtgtgctcggtgggaagttgagaggaaaagtagacgacgagggcgatcgggagggggggaagaggaagaacaactcaccaaaggaaatggcttggaacatggaaggaggggcccagctggatgtgtgtcgcctgtacgtcatcgccgtgacgaggccgtgagctcatggacggtcggttcatgctccatgcacggcccggctggtgctagtgaacccctgagaaaaaaaatggcagtactggaaatcgtatataattaagatgattgtttaatcactgggaaaatgtggaatggtcctagctagctcccaactgtggtggagaaattcatgcttggttcttttcatttatatatggtatatggaatgcatagttatattgcaagtgcagcagttgtttaatttcaagccattgcatgcgttagatgcctatcttcttgtagatctgatggcagacaatttttcactactacttgcctagtgatgatgctagcactacagctgttattagttgatgtatagttgtcactcatacattttctaagtggcatgttggcacttgaatattagaagttttcacttagcatgcagtgcaagctaactgaaggacaagtagaagatatacacgtgttacctttgctccttcactggtcatgcatacaagtcatcacacatccggtacaggacgttgagggataagcaatatatcgatcatagcaactataaactctctcccctgctccctgaaaataatgtttctccatccattttgtgcactgtacgtgcacacagcagcaaattgtccaagtggagagcatctgctatctgccaaaacaacaactgctcaaagcaattttcttacgaaaacatttccatctaggtaggatgactggaaacaaggataacggaaacacccatggagaccacccccacattagtttattctagggcaaaagcccctgcctgtagtttcatttcttattatatgtgtgggaaacactttctcccacgtactttttcgttccaaaaagaatcggtttttagatgcttgtaagactactgtaagtacatattcaaggagaagctctgaacttaaaaaaaaacgggggaaacaatgaagcaggagaagagaaaatattgcccagctgcctgtcaacttgcatagccgaatagcactcgacgcaagccgacatgggaaacacaggcttaccacaggcatagaagaataattaggaccccaaccacttcctaaataatgaaagtaaataccccccatcggtaacagaaacagtatatgtgtccataaatctatgtatgaagacaaacatatagtggaccacaaatgacaaaagaaatggcacttctcggcatgtgagtatgtgacaactgtcttccagtaagaacaatagcttgaccaaaaatgatctgaactgatctttcatttactaaagcaatgttcataaacatgtacacatgttaaggatatttattacctatcaaaaatcaaaaggaaaataagacggcgggttttatacaatgatacacatgcttctgtcaggctaactaactaaatttcacaacatctccttaagtacatacccgatgctcgggggtgtcctaaacattctatcactgatgccagattctaatataatgatccgagaagctccagaccatagtatatccctaccttctgtaattttaacataatttagaactaagaaggcaatcgataaatccaattaactaaaatatctacagcatcaattatttcaacctctttcattgcctctccgagttccagttgaaagaataagtcagctgataacttaatgctggttgtcatgttgctccaataacctcctttcagcagctaagccagctgcaacagatggaggtaaacttctcatatgcccaccggccccaccgtaattcttattctcctgttctgaaggctgatcaagtgttgccacaggaaataaagactcaatatccttcagtgtcaaaacaagctcatctttgaaattttttgatttacggtgtatcgtggagcaaacagctctgcccctgtttaatttgtagatgctctcttcaatagtattcttcacctaaaaacaatataatgctttaggaatttctccatggatggtttaaatgagatgaagtagctcaggatttggtgcttacaataaaacggtggataaacgtgcttttgtcttgcccaactctatggatcctgctgatagcttgcgcctcagctgcagggtttaacaacggctccactaatattacatgttgtgcttccaaaagattaagaccatttgcaccatgctggataagcattagcaatacttgagcaggttgcatcttggaaaatgacttctttgctttctctccacttatactacttgccagacctttgaactgggcaagcgctgtttgcgattttctgtgaaaagtaacacactttcagtaaccccattgtcattgtccacaagattcaagcatatagaagaggaccctccttggtgataatcatctagcaataggactagaagcagagtagggggaaaaaatcaagttttaacttaaagaaatactccctccgttcagaaatataaggcatattatgtttcatcaggataaggctttgactaacaattgctttactaatatactccctccatcccaaaatatattaacttctagcattcaaaatttgtcccaaaataaaacaactcctccacctacttcttctcaaccaatcaaaaccctccccattgaatttctccacttactccatcttcttaactaatcacggcattctcccatttaattccacctatttcttaatatatgtgcccaaccctaaaagttcttatgggacggaagggaacattatttatgcgacacaaaagcatatcataagtaagtctgaatacgaatctaacaacatcaattttgtcacaaaaattatatcctaatagagtaattgttgatcaaatccttgtcctaacaaaacaaaggaacaaaatacaatttatatttttgaatggagaggagtataatcttgtatgcactttgcgctaccttcaaaaaatgtgtataaacagatatacaatatcattactcagctcagcatagtgagaaaactcagccttggttacgagtatctcaccttcctcctttcatccgaacataagagatattgttagcggcaagggagtgctctagcacatcaagaacatcattccagcttgaaaaaacaagtattttggctgctccgtcagttgaagtgatcctcaaaatccttcttgtcacagcttcaatcttaattacaataaatcaccaaaataaattaatcagttattgcacccaacctgaagatagaactactaaggagcatgagtttggtagtttggtcagtgattgcacgtgcattcacattgcaccaacttttatgctctgtagaaaaattgtgacaatataggcaggtctgtgcctatcttatcagggataaaaaaacaattgtataattaggaacttactttgtgttatgagcatgggtcagaatttctctggcagcggttttgttcacgctgaacagtaccacacagtacgccattaatttaggtatcaggataaatggtttttatattgtatattcccattaaatttttatggatatactcgtttctatatttgataattgcaagtaccaagcaatttaagatgacatgaaatctatcgtatacatgttattatattaaaatagggtaaatatggattaatataatgatgttgattgatttgattctgctatgattgtatgagaaataaacctaagagttgtatattaaatacaattctactttcaatgcaattttatttagctctgcgcaaacgcatgggaaattcacctggttagttaattcaaaaggcaattacttgctttatgcaaaacagtaactattgccttctatgcaaaaccagtacaaacagacatgtgaagtctaaacaaagttgctatgcagtatctgccttctaaatgtaatatagcaggttgtaactcaataagcagtaatcagatatttgaaatgcgggacatataaacaattacaaggaaattaaataaaacctttgttccatatgaaccttggacagaaatagcgctttctgccaaatcctcaatttctctatcagcatttcctctctggttttcaactacaaaagcaacattttcaagatctgtacgttgacggcaagtagggcacataatccattttttgctcctcccaaagtgggctgcagcttgttctgtcatgtaaagacagcctgagagcagtgaatagataaattcagtaaagatcaagagtttagtatacatcagatgaataaaattgtcatggatagatcagcatggaacttggagttggaaaattgaaagatcaacagaaccaatctataatacaaaacataggcacatgtgttgcatgcttacaacagaacagaaacagtagaaacattaactacgtgacaagttgtctttcttccactgaaataaatttaagaaaaatagcataaaagtataagttgtaaataaaatagaagacaactcttgggatactcacacttgcagcaaacgaaatggccacattggaaaaccattttctggtcaaagatcttctcctgacaaattgggcatggttcattgataatatcagaagcagtttgccctgtggcagggatggaagttgctatagcaacactgttgcctgactcgggcagtgattcaccatgcttgcccagtggtttcttgttggatagcaccaatccctaaaagtaaataaaatacaatgagaatttctaaaataacagataagatgggttatggattcttatgggaaaattaagaaagataatgcctgataataaagtagattctgtattgaaaggaggcagttatatacttttatccaagtaaatgatgagagctgtccaggtggaaattatacagttgagcagtgtttagaaataaatggaatgtagaatatgtaaaatagaatatcaaattcacggcagagtgcaacccatgatagcaagtattgacctttaagtatctgagttggcctcttatacgagctaaagatgacaaagacaagaatttttcacttgtaaactgcacattgtatggtataagctcttctctagtaacaatattgactgcactgggttcatcatctttctccttgagctgcaggcgtgagagagacatcttgatctcatcatgggcacgcagtaactgggtctgtgctattgatagattccttgcttgagagaactccttgcgcatagcctacattagcacataatggtcagacaatatcctatctcgtggtatttttgaaccttcacattttagactaaaacatatggatcacttagtaaacaaagattataaggtttgacatgtggaaaggttcctaattagattcacctccatctttccatatgttctctagacattacaaatgcaagtgatctaacaagacaatagtaaattttacattgatgcaggttaatgataacaaaaagaagttctgctgcaggggggaaaataccaagacacagtaaaatagagataagatactcatgttttatcattccgactcaataataatgttttgtttgcttttaatttactacaaaaatcaagacacagcaaaatagagataagatgctcatgttttatcattccaactcaaataataatgttttatttgcttttaatttactacaaaaatcaagacacagcaaaatagagataagatactcatgttttatcattccaactcaaataataatgttttatctgcttttaatatactacggtgataaaatttatttcagcaactgcaattaccagctaaaacatgtcagaagagaaggcagtgacattaaaaatattttctgtacctcaaaaagcagcaaattctttttagcaattttagcagattgctctcccattattgtctttgagtgggttagaataacccttaaggaagtctcaattcgagaaggatgcctgtagacctgtaaacagcaaccatataaaaacataaaaatggtagataaaacataaatggatcactatatatgcacttttaattgccatagaaaatccaagaaatttataaaccatttcaaagtaatttccgacaaatgaaaagttgaacgaaatcatatctgacacttgataatatacaaaagcgagttgatctatacaggcagtagtgcagtacagtcttttttgacagaaataagtcattaaccatttcaatttgataaatagaaataacctagttacaggaacagagtggtgggggcgaaagtccaggaaccagaagcaaataagatgtggtctaactaccagatctctagtagtttagactaagaagggaagtttaagaaacaaaaatataagacccccaggcacaggtatggattaatcaaatgaaagcctgaaaggtgacatctgcttagctatatttcaatataaaagacatgacaagatgataccagaaaaccttctcgagcagatcttggattcttattgtcgtcaccaggttcagatccctcgttagttttagtattacgaaaaaactgattcaactcatattttcgcctttgcaagtcccttgcttcctctactgaggcaataacagaatcattatttgatttcttaacaagaaacagacgtgcttcatacccctacaagaattgatgaaataaatgcatgatcaacaagcagaagtagggaggtacctcaaaaaacattagcatataaaactacctgaaacagatcatccaattcacattggatgcataaagaaccattaccatcatagcaatttggacaatatcgctgacactcaatgtcttcatcctttgggctatccattgttttgtcaagttctaaaagtctgtccatcacttgttgccttgaactttgcagagaatcaataccagtttgaatggtatacttcaacccagcaatggtttgaaccctaagcagagaacaagacaaccaagttatccatcaattgccataaaaggttttaatttatacaacctctaaacaattaaatcactgcaaacaggaaggacaacaaattgaatggacaaactgaacataattttctgctgacctggaagacatccctgttgaacccaagccagtggtgcttttattggaagaaatatcaatcttcctaatgagctcatcagcagaatccttgttctgttcaatgcaatccaaagcatacagccaccaattcatattttgattctgtaactccatactgagagttgagacctagaagcagaacagcagaatttcattatataaatagtgatgacttctacattctacaacactgaaaatacttaggtggagagattattgttatagagcattacaaaggagacatagaacattccaaagggggaagcatggaataggagacgagaaaataaataagttaaaatcgctaggtgcaactaaaatatagcagtaaaaaaacaacctctgtgaatgatgcactgaaatctttctgtgctattagtagctttgaagtaaaaactgacagatacttttctctgattgaattgcaagtatttttcaaacaaccatcagctaagcatacagatgacgtgtggcatccagaatcattctctacatccatctcttcacttccacatacttgtgtattgatgtttttgtcttccttggatgtttctggattatcagtcatcaaacttgacctgctattctcacaaattttctttcgctttatgccacacagacctgagtcagcgggactagtttcctttctttttcgcgcaccatggacttcagaggtttgttcttttagtgggcattcttgcaaatactcagaactagctctgagcagctccgcaagattgtggttgatatgaagattcaacaaagggtcaacacggaaatcatcaaaattttcacaggccaaagctagtgcttctttatacagagagatggcctcttgattattttgttcaatgacagcaagtccagcaagaccattcagggcgacaacaattttcctgagctcttcctccccttcgacttttgctttcccaataagaacctgcataaaaaggataactaacaaccttgagcacattatcatgtaattacactgaaaattatatggtaaggtacataaaatcattagttgtttacctgtaaaatttcacccattgataaaggagtacgctgcagggagcagagaccgaaactccccacttgcgggtggcaacaagcttgtcgaagtttgagcagtgggactaggagtttggcaatgtcatcattggagaggtacaaatttgatacaacattcgagtctgagagagaaagggagtggcgttgtggtatttttttaaataaaggaaatacagggtggtattgtggtaactgttcagcaactaaaccacatgtttagctgtattttgattttgtatccaaataaaatctttaaggagtttaagagcattgtagacattattactttgttagaaagcaaagcgtaaataaagatgaaaatttcagacagcacatttttttcattggctggtcatatgagagaaaactaaaacaagaaagagaaaggcagacacaaaagtaatggatgaacatcctgtccccacggtatcaatctagcaagcagtaatgtgtgaagtacctgatattggctcgcttttgttggcatcatctctgatacgtcttataatttcatgtgcatggtccatgcaagtggcatgctgcttctgatagaaatattcttcaattgatgaaaagatgagccacgaaaagcactcttcttgtggaggcagctgtaactcccgtgaaacatgaattttagaggagcgccacatgatttccttgaagaacttgtgtgcataattcatagctaccatgtcccccttctgcaggtcaatttgatgaaaacacaagagagggattaatcaatccaaccatcaagaagagaatgttatcaaagcccacaatggcgtaacacagacaacacagaaaaaaaattggtgcactaagcaacgaatttgcagtgtctttgttttttcagggttttaagttcttagtatatgccctgtcacatcctcattttagccatccaaccattagtactcccttctcctcctcgttctctctgcattaatggaggcatgatagttgtttagcctcttgtttgatatgcctttgatttctaaaacaacagtctttttgggatggagagagtagtaattagccaaacagtaagatctatagtaatccagaattagattatgtaaatccatcattactactatgtatataatattcaagttctgttactatagataaagtgatcaatatttacacaagtggtgaacaatgcagcgtgacaatcttccattttcaataggtggcgcaacctctaaattaggtagcatgtaataaatacccatagttactggtagtagtcaacgtacctcatatgggtccctaataatatccacccaccatctatatgtgtcaaaaggatgagttttgagaaagcgaagaagcccaaaaagatcatcaagccggcgttgtattggagttcccgtgatacaccagcggtgttgagcatttagcctcattgccatctcagtcacagaagttttgctggactctaccatctgagcttcatccaaacatagccgccaccagtggacccttgttaggacagttggagtgacagggtacctagagagttgaagacagttcagcaggagttaagacagctattttcacactgatgcatcaatggtatatctaatgggctaacaatgggcatgatggggtacccggaacaaatatgttagtttgcctatctcagtttatacaaactagaataatcagtaaatgatacctcttttgatatctcaaaaaacggcgatcaccatcatgccgatcagaatcatgtgatagatcttctttcaggacatcataagttgtcaaaacaatgtcagctgtgcttatctcagccatatcacttttttgggtagatgttaagtccgtgttctttgcaccttcataaatgcaaactttcagagatcctggtcttgtgtgtctaagagcaaaaggagaaaccggtgagcattacaatcatcatttgcagagagtcatattaagtaagagtaaatgccgaacatttgaaaaaaaaatcaagttttgcaattagcattcaataaaaagctgggtgatcatgctgccgatatattgaggataatgacctagcattacctgcttaaacaagtctagtgaactagattacaagtttggtaacatgcaccacgatttgctcaaaattggacttattctagataaaaggcattttatcacgagtgtccttaattcttatagaagcatgagaagaacttgaattcaagtttgctaaactctccaatgctcagaatcaagcagaggtaaagaggacattatgtggcttacacagagaaatcaaaacaaggaaaatatgtggcttacacagaaatcaaaagttcaaaactatctttctacattctaatttgggagaaataggagcataaagaatggtaatgcaagaagtttctgatatagtaatgtgtatatttaaaacatagaaaatactatatcacaatactgttcaactactgtacaggtaaaagaaatcataccggattatctcagagtgccactgtgccaatattggtgatgggcatactatcagcgtagcattactagatatattagtttgggcggcttcaataagctccaagcacaatgtgcaaatatatttttcttctgtctctgcaatgcaatacctgtctttcttcttccttctattttttgactttagggttcctttttcattgtttgatgcttcatcaccatcatcatcatcaacatgcatttcctcctttggtgagtaaccaacacaactagcgtgttgccaagcgtcacatatgtcacactggatccatatcccctggtatgcagaggttacacttgcagctccacaaatgcactcaactctttctcttttatgcctctttatctgatctgctccttttatattcgaagagacagaacagtctgctgaatatggcctgcgatgtgcaaaaatgcaagccaaaagctcaacagttttccctaagcccatttcatctgtatttaattaagcacaccaaaagcatcctcattagtgacaaaaaaataaatgcatttgatttatcttaacaaacttaatatcaacataccagccaaaatgcccccagagacataaggtggagaaggttctggatgcatcgagacatttccactgtgaagaaacagatttgatgaaatttgaggatactcatacaaagaacgatttaaaattcagataaatgaaaagaaagtgtttaagacacattacattctggatgcaaaagacacttccactgtgaagtaacagatttgataaaaattgaggatgctcataagaagattacaaaatcccagtaatggaaacattgtatttagataaaaggatatacagagtaagaaaataaaatgcaaaacaaacaaaaaatgtgtctagggtaggtatataatgtgtttccaattgtctgaaaagaaccaaatagaaccttgacatcaactaagcataactgacaacaaacacaaagccaacaccatcatacatgaaaccaaattatcatttatttccttgcatccatgatggcaaaagctgatagatagttaacataatattgtcttcatatcagtcattataattaaatgaagcagtgaaaaggatggtcaatatagtgtttcacacatagtagggtctttactagcatttaaggaaaacgtagcaaaatcatgggaagtgtatgtgatatgtattaaactcttacttgaatggattgtagaacatcctagatttcttgtgcataaaatctatgggaacacaataaggtgcagaatgaacataatgttgatttggtgatgaaatcattgtgtttcccttttcacgttgaaccatccaattcgctgcacgaagttgataggttctgagatgaggaagcaaatcgggaagctcctcttccaacagtccagcctccctgtcaacaagtaaaagaaaagaaaatcataaggtaacagcaataaatagtagctacatgttttgtacaacttaagataatagaaaatcatatgcatttgcctgaagacagaatatgtttgtaataaaaataaagcatttatctcatgttggtataaatgcttcacacacaacgtcaaaaaaaatgcttcacacacaacgtcaaaaaaaatgcttcacacacttcttgaagtgcgcaattgtggttttagaccacccacaacaatttattcctaataacttgtgagataatgagatgtataaatgtaagggaacatacattgagggcttaacggcttcgtagaaagcagcaagatcaaactgagaatccttctttggggtaaaatcaccattagcacctccatttataggccgggcaagaccatccatcccatatattgcagccgaggtcatgacctcaggacgaacccaagccatcatattcatgaaactcttcctccacggatgccttgtcacctccaacaatgattcgcatgtagcaaaagcctgctccatcaaccccaatctaactctaaatgatgcaaccgacacggaatcagcagaccgagatacagcaaaggcatgaacacgcaatgtcacgaatctcaatctaaccaaatgggcgaggcctgatacaccttcatcgggaccatcaaaacatccagagaaaaccataccggcgatggcatactccaggatcacacaatctgaaggtaccacaggccactggccaagccggaaaccctcctccggcgcgtcgcgcacccgcaggcgcaacgagcacctcttctccctctctgcctcgtgcagagccgctacgtccaacgccccctctccctcgccggagatcctcacgtcgcgcatgaccaactccgcgaggtcccggcggtcgccgtcgctcaaacaccacgtgctatcatccacctcgaagcacacatcctctctcctcctagcctcgcccttcgccgcgcgcctcgatttggaggcgccgccgctgccgctagggctcggcgcgtcgggctccgcggcagcggcagcgccggggcctaggcctaccgcccgggccggccgcgatttcctcctccccatgcgcgatcccagcagattaatcgagcatccgatccgggttttagctctccggaagtagaattggggggagcctcacgccctcaccaaatcaaaacaaaaaaaaatctccaaaacctagcaatgattcgtggattggagctcgcgaggtcgagcaggaatggaattcgagggatgagatgatgggtggatgaggcgtcgctcgagagattggatggtggcggaggattggaggagctcgccgctgttatcttctcgcgaggggttttaggacgaactgaagaggaagggggaatggggacgaagggtagtcccggtaaatttttgaaagtgtcaaggttttttagtctcgatggtgttatgttgtgaaaatgcaaaattattagtgctaaaagtgttaaaggaaagaaggtggccttaaattggtgaataataatcctctaaataccaagaatgcccttcgctaattaaatcaagaagcaatcagcaaggtttcggagtgcgagcgggttctagggttctagcactgcaacggcagcgggagagagatgaaaaatcaaatggataaaagttgtgcactattagcaaggaaaataacattgccttgtctataatatacatttgattctaataaaatctatcacttcacaacacttgattttgtaaaccccggatgtgataccggtttaaaacagcagtatatgcataaatagacgtcatatactttctttacaaaataaaaaaaatgattttctcgcatatcatctacttcctacctccatctcccttctcccttaatgttatatctcatcttttcattgagaaggttttcaatccattttcaacaaaaaaaatcttagatgcacaacctaaaatcaacttaacaccctcttttctattacaaaacatggtcctcgtatattaccttgttttagcggtgatggtatactatgagtctatccccgaaaaaaactgagtctacaacaaataacaaaagaaagaagaaaatcaccttcttctcaaacagagtatttgagagtcatctgacttcagtgtttacccaataccttgaaaataggagaaagacatagagtaaagaaggagaagttatagaggagtcgtgatgacgtacaggttaagaaaaggataagcaataaggttgtgtttagatccaagggtgaaaagttttggcatgtcacataggtgttgacagaaaacacgtggcctgggagatctgcttaactccagtgcaggtccaaagctcgtctttggatgtattagcgtgccagttgatttgatcctgtaatcaacaagaaatagaagcaaagaaaccgtagttaaatctataaatgatagccgatcggctagatgccgatgacatatcatttatctttgggccgatgtcatccatgtatcgatcggcagtcatgaatacgtaaagaagaactaaatctactcgatcggctgtagatattaacaatatataatccttatatcgatatatacttaaatcaagtgattgggatagatcggtcgccataccgagacagtataaatcacttggatcgaaatatatattaataattagactatatacgttcatagcatagccgatcagatagatctagcatgtatcggctaatactccgataccactctatgttaagatgttaaagcaagtagaatatactaaacaaaagcctaatatacttaaatgcggcaagatcttaacgcaaagggcagatttaacatgtcaatcaagcatataggataaagagtagttaaatcagatacgatcggctgaaactccgatgctattctaatcggcaactagaaggcaggctagggattgatattctaagcacgacttaatagatcaaacttaactgatgcagcattaagtatgaaaagaaaaataatatctagacaatcaagccgctagaagtctcatggaacggtagatgtctcatataatctagaccaatatcaatatttaacctaatcggctaccctctattgacagatattaaccgacggtaggttagatgatgatattgctagagattatgtaaaacatatgataactcgacgaattacataaacaagattagaatgtcataaagatggaagcactaatcccgagaacgcaagccgccataacaagtttacctcttgttgaagatagaaaccgatgcagctcaacccgaaagcaagaactcgtcgaaataaaatgaaagtaaaaaagggtggcgatgcgccgaaattgtattaaacatgtgtgttttattacatagggctcagggtccatttatacccgaggattacaagatatgcccatatcggacacaaccattatctctaacaaactctaagacaccacaagtctttgcggcagacttttgcccacacttatctataaggaattcacataaaatatcctagttaatagatacaattgccttcccaggactctatccatgcgtggcaatcatcttgaagtacattaacttgaacccgatgtcgcgcacaagtcgtattgtcggaatcggcaatatcggcttatttagctcgactcagactcagccgatcttgtcgtagccgatctggacttcagccgattcctgccctgttttcaaactcgatctccgcttccgactttgcttcgatctaatcttctctccgatgctgatgttaccaaatttggttgtcaacaataggatatacggacacacgtttgaagtattaaacgtagactaataacaaaacaaattacagattccgcctgtaaactgcgagacgaacttattaagcctaattaatctgtcgttagcaaatgtctactgtagcacacattgttaaatcatggagcaattgggcttaaaagattcatctcgcaatttacacgtaatttgtgtaattagttttttttactatatttaatactccatgcatattttcaaacattcgatgtgacggggtgaaaaatttttgcgtgggaactaaacatggcctaacactagccttctcccctatcctttactgacattgaggaggtggagagtagtagagagaaaaaagaaggcggagagtgggctgtgtttgagggtgaggggattgagaagattgggaagatatgcaaaacgaggtgagccattagcgcatgattaattgagtattaactattttaaatttcaaaaatggactaatatgaatttttaaagcaactttcatatagaaatttttttgcaaaaaaatacaccgtttagtagtttgggaagcgtgcgcgcggaaaacgagtgacaatctccccaatctctccccaatctcctttgaggaggaggggattgaggagattgggaagatacgtaaaacgaggtgagccattagctcatgattaattgattattaactattttaaatttcaaaaatggattaatgtgattttttaaaagaactttcctatagaaaatttttacaaaaaacgcaccatttggttgtttgggaagcttgcacacggaaaacgatgtgctaagtacataggaggaagagggattggcaggagtttctattactacaggataaatttctactattacatgtgtcacatgactcacatgtagggtttaaaaaaaagtagatgtaactcatccatttttttaaaaaaaaagagttgaaggacattaaatgtctaggtttgaagttcatgataaattccatcatacatcattttttttccctctacgtgagcagcatttaaattataaaagctattaaactatatttatatccatgttttctaaaccttttaaagaaattctctttcgccataatgacaatgctgagtattcacacttgaaacacaaacaaacaaataaacaagagtggtgatggcggacaagattaagaaatggcatctataatggcactccttaacttacttatcatatccattgccatcaaggagttggagagaggtagagaggaaagtggagtgggagagaatatattctaggaagaatatggatgtgcttagttatttagaagccaacgctaaaaaacaaattgcgatgaaaaaaatatcataaaatcaaattttaaaatttaaattctggtatctgtttataagctatgaggcaaacgatgtaaccttagagttttaaagagaacgatgataatttgtccgattaaatattcctatctaggtttagagttcgtaataaatttgtccataaatcaaactttcccctttctgtagcatcactggagttcaaattgtaacgcagatatttaaccatatttatgttgtgtacttaaagttttaccaaaagaaagttccttttcaccgggatcgtaaagtgttgtatttacatttagatgcagcaccattacacccgaaaatgaacaaaacaaacaacctgttgatccaccaatatgaaacctacctaaatgaatccgaatgaaattcactctacctataagaattccaacgactgaaaattctgtcaaaattccagcacctgaatctatctctagttctctacactactatgacttgatcctgattgctcccattccagtcgtccccttgctgttgagtatccccggcaatggccaaccggaccctctcagcctcgacctcttcagcgcgccgctgcaatcctcgtctgagtcatcgtcgccgccgtcgtcgtcgaggtcgacgcagacgcctttccctttccggtcgtacagcgcggcggcctccggcgtcgtcctctcggagaagctctcgtacaggtcaggcgagtgctgccggaacagcaggtcgctcgccgagccgtaccccatcagccggtgcaggctggagccatgctgctgcgtcgccgccgccgccatctcgtcgacggtgttgaacgacgagttcctcgacacgtgcagcggctgctcgtcctccgtggagtagctcacgtcgacgtggccgaagtcgtccaggaacgc

SEQ ID NO: 9912 - DNA, 2164 bp, Oryza sativa
cccggaacttttcttgccttcagcatcagattcagtctggtcgcttcgttgaacatcttgcagttcggtgttactgtcttctctactctctgaaaattgcaccttgccttcagatgctctgtcactgcactgtgcatcagctgcagtagctgcatctcctcttgtgagatcttcagaattgccaacagcttgctgactggtactctgaacatgctcttcctccttctcagctggcaccactcgctctggctcaggagcattgttcctcgccgacacgagatcatcagtctcgcgtcggcttgtcatgtcagctccttgctgcccactgctgatttgagcttcaggagtggatccactggtgcttgcaacatcactggagcccaggtgcttgctgtgaggaggcaggccactccccaaagaggagggagcactgatcacctcctgtgagttgccggtgcggtttttcgctgcgtaaaaaaagcaacaaaatccgtcagagactgaccaaaaggcaaaaatccaagatcaaattctcgatcatgagcagtcatggagcttgaattcttacctcggagggtagtgccgcatccaccgcattggtacaccggcgcgccggtgggctcctgaagaacactgaagcatttgggacacctcacatggcgaaccactctggcgtctgagattgccatgagccgacaaggccacagaacatcactcgcatgcagcaaaaggtgtatccggcaggtgctaaccgatcaagctcgatgtctgtgttgggagacagttacaagaaaaatactcgtcagtgttctgcttcatcgaatctgcagtttctgacggaagaagagaggaaatccaggaaatttgtactacttgtgtggaattttgttgactgataatatatactaatacatagaacttagtttacatgcgaatacaatagtaaaggaaaatgcccggtaagccttaagcacgtaagcatcaagaagcgacatgtatgtttgaactttgaactgttcgtcgagggcattatgtaattttctaaatttaaaaactagtggtgtatcagaactctgatgatgtcattagtcctaattaacacaataactatagctactagtagtagtggagtactatacaagacgaagtacaggatttagacagaatcttcctcaacagaaagtcacggtttttgtgtgtgaccacgcacacaaggtgtaagccacagcaaatgaacgaacagaacagaaagagccggctattggacactacaagctggtagaagatgcttgcccatttccagttaatttccaaaacccttggtaatcctaggtacgttatctttcgcatgatgaaaaacaattaagaaaccaaaaaacatttctgaaaccttaagagagaaaaaaaaaagaacttgctgagctgatgcctaaaaacttgaagtagatgaagaaagcagaggaggaagaagacagtcgggtacaggagcacccactcacctatcttttgttttttttggtttctcgctttccccttcagttccagacgcttctcctagctcctgcttcgatctctcctgttcccaatcctcagaaactactcaatccgatcctcaagctccaaatttccaaaatcaatcctcagaagctccacgcttctcctgctccaactccaattcttccggctctctctcagatgcagagagaaagagagagagagagagagagagagagagagagagagagagagagagagggagaagagacagctccaattcttggcagttatgggtgcagtgacgccaggagaaacgatgctgatatatataaataaaaatgggagcgtcgtgtgaagaggaaggaggaagaagcagctgaggaagcaagaaatgatggggtttggggtgatgtaaaaatgaagcggcgtggtggagaaatatttatatgcgatggggtggagaagaagtctgaccgcttccgcgatagcgagtggctggctttggactcctcctcctcttggagaagaagaggagggcagggagggccaggtcgtttggtgcgaccgtgtcgccgacgccagtcgcgagtgccaccgcgtcgtcatatccagcgcccgcccgccgctgcctgctgctgctgtggcatactggctcgctcgctcgctg

SEQ ID NO: 9913 - DNA, 5610 bp, Oryza sativa
  unsure (1)..(5610): unsure at all n locations
cgagagggagacagagaggcgggcgacaacggtggctggggagagagggagatggatgcagggctggggatggcgaggagggaggcggcggcggtggctggggagggcgaggaggaaagcggcggcggcgagcggcaggggaagagaggagggaggtggcggcggcaagctgggaggaggcggcgacgaatgggcgacgaggatagcgataagaagaagctagaagccaaaagtgggggaggaagaaaagagaaggaaaaaaaaaagaatgagctggggaggggtatttggggatttttcacctgggactccattgggccaagacacccattgtgggctatagtactctcaccgggttgttttagattttgaggaacccatttagggataccttctattgcgaattgagtttcctacgagtgtcctcagttagtgaggatactctatgagtgtctcacattgtatatgtgagtactcctactttattctcctgttttaaacaggtcaagaaaataaaattggttagtacgagaactatttatttgcaacaaattgtactagtgtgtaccaactggagtccggaatcgtgtgcatagcacagacaaagcaagttttgcagacacacgcaatcattagaaaaaaaaaacgccgcggccaaacagaacagcaataaccgcatgaagcatgttccttgcttaaacaaagaagaaaagcgcaagcatgccgtttcacatccatacgtggagcaagcgagctagagagaccaacccactttcaatgggcagcgatcacttacacgaggaaaataaaaaggcaacgatatgtgtatgatggtctttgacctcgtgcagagctagctagctctatctatctcttggcatcgtacctgtgtactataggactatctacgtgtgtgcgcagtgagcatagaaaacgaagtgccgttgatagttttggtcgtgatgttgttgccgcatgccggtgcgacaaatatcacataggaggctcaggaaggcatggaccgatggacggttcggccaaatgaatgagccgatagccacagcgttcggctatcatgatcatgaaacgaaaaaggcgtttcttggctgcaggtaggcaccgtcggtgtacacatggcagctagagcggctcgttctcgtacggcctcgtactagtacgcaacgtacgtgtggccgcgggcggcgccggtgccggccgcctctgcgactgcacggtgcgactgtgcgagcttcaccaacctgcagctatcgacctacttctccttaccaaccggttcgcgcgcggcatggcacgaggaaaaatagttttaattacttgtttactagtatcttttctaaaagaaaaagaagatagattaatgtgcaacatttatataaattataacaaacatataaattagactttaatagtatatgtatattcatcttttttataacttgtaaatgccgaatttaaacttatacttcctccgtcccaaaatataagggattctgggtggatgggagacttcttatcctaccaatctgattaaaaaacctgttaatattcgtagtgctaggatatgtcacatccacccaaaatcccttatattatgtggcggagggagtatgtttttacaataatatattagtgcatactactaatatactccttccgtattttaatgtataacgccgttaacttttcgaccaacgtttgatcattcgttttatttaaaaattttgtgtgaatatgaaaatatttatgtcatgcttaaagaacatttgatgacgaatcaaatcacaataaaataaatgataattatataaattttttgaataagacgaatggtcaaacgttgaaaaaaagtaaacggcgtcatacattaaaatatggagggaatatttcttaaaattaagtacacgagtgtacgttcactgagttttcctactcctatatgctttcctagcgaatacgcctatcaggatagaggtgaaagtgaaacgtgagcggggcccaaagatgctgggcttggcgactcggttttccggctctgaagtgacggttttttacgcgccaattctctcgcgcggatcacagaaacacgcgggcagatagagaagagaaagagacccggctgcgacgagtctaactgccaacctggcagcacttccagcaagcggaagagggtcggtcatatttatcccataatatggctaattttttttagaaaaaaagggaaatgagtaaacgacctggcggcgcggttagtcgggcccaccacccacccactggggagtgggccctccctcccgcatacacgttgcagctggacgcggcgttcacaccaactcaacgtgcgcccattcggaaggagcacccatctttcccctttctccttctcctcctcctactcccagccgctcactcgaaccccccccccgaccttccttgccgccgctgccccgagggcgcgggagataacctcgccggagcaccgccaccgccgctgtcgatcttcttccccgaggcaaagccaggaggtctctacctctctctctctctctctctctgaattcgtcgccccgtttctcagcttgctttaatttgtgtgaaatttgagttgatcgatattgcttcgtgtttcggtttcttgatgtggatttggtcctttaggatgattcttctccctttttttttgtcagtggaaatgttgtgctttcctcccgcatctcatgtgcttctcctgaatgaatcctagggttgatttgtcgagccaggttttccagttttccatttttgttttgagcaatcggttaaattcaggtcggaagggagctcccctaccgccgattcctcaagcttcttacattgaacagatgatttcgatgtggagatgtggttgggagagggagaagagcttgtgccttttagactgagctttgcatgcttaatgggaatatcaattggatgaaaatgatccctgatcgggacaccattctcggttgattttttgttcaggcgttcagcaaaatgctggtagcgaactattgtttatgaattatgagattaactagggattagtgtgtacaattatcagtaacaggaggcgttgaccatcatagtgtagctacgatgaccatcatagtgtagctacgattatagtagattcttgagctaatttttaggctgaatgcatagtccctgctttattagaggtaggacattggttgaagcagggcggaagctttttactctagaaatttagaggtagactttatgaatctaaaggtcaactggaacccaaaggtttaggttgtaaagttagatgctctttgattgcttttctatgactctaatatgtgcattctgatagactgcaacggccagctgactggcattttttactttgaaacatatttctactagatactgtgattgattgtgattttgctttattgtgccattcagaactaaatgcaatatttagcatcagatatctgcatatgtataattccaaacaaagtaaaaactgaaaggaaaaatgttcccaaaagaattcagaataactttctaaacttcccatgcaaatgatttttttcccctgtaaattaactagttccacaaaaaagaatccctgtctagcccttataaaacctgttgttcagtatgttctctctttcctatagagataagactaacaccatattcattttgcttccagtctagacaaactcagcttcatgagttcaagttcaggaaaagcactggcatccagcatctcctattcagcaggaaagagcagcattttcttgctctgcctctttgcaggatacttgggaattcctggccgaaaattccacttgctcaagaccgtttgcagcactgcatctccttccatcattggaagttgtggagggaaccttctttagactactttagcacaagtcttcagtttctattagtgtggaagcttggcctgcaaaaccagcaaccttagctacgtagtaggcctttggatgatggtttcttctcagacatcctctctgacaagaactatcgcacaggaccccgagctcttcacagcaaaaataattctcccaatgggtcccccggatgttatctctgaaaatgatgagtttgatttctctgatgtttttggcaccactccagttcagacgccaacaggcatttcggtagctggtccagacagtcctgcacctttggctgagtccaatgagggggtttacaatgatcctattgtcatcatcaagcgatctcattctcttgttggtccaacatcacttgttagccagtccctgcgacttagcaatctcactctaaataaaacagaggggtcatcagaacctgcagaagaaaaggaaaggaacctagggcagctcagtgatgaagagtttgacaatgccacaacagaaaatgaaggtattgggcttgatgactttgaaatcttgaagcttgtaggccaaggggcatttgggaaagtctttcaggtgagaaagaaaggtacttcagagatatacgcgatgaaagttatgaggaaggataagatcttggaaaagaaccatgcggagtacatgaaagccgaaagagatatattaacaaaagttgaccatccttttgtagtgcagctcaggtactcctttcaggtacgtgtgtacatcaatgttcttatctctatgttgaaatcacttttagtgatatcttagtacctatgtttgaacacagacaaaatatcgactttatcttgtcctggacttcataaatgggggacatctcttcttccagctctacaagcaaggattgttcaggtgactgtatacttctagctagtacttttgtctgtcaaaagaaaatgtttccggccctataactcaaccgttttgtttaacagggaggaacttgcacggatctatactgctgaaattgtatctgctgtagctcaccttcacgacaacgggattatgcatagagatctcaagcctgaaaatatccttttggatgctgatggccatgtaagaatgccttcttcaacaatctcctcctgctacttcttttccattttgctgatatcttttttgttgcctcatttcaaggccatgctcactgactttggccttgccaaagaatttaatgagaatacaagatcaaactcgatgtgtggaacagttgagtatatggccccagagattattcttggtcgggggcatgataaggcagctgactggtggagtgttggaatcctcctctttgaaatgctcacgggaaaggtgtgctgccaacttgcatgagagggtaatcttcccatttgcattcattcattgctaaataatcccttactctttgcaacacgctgcagcctccgtttgttgggaacagggataaagttcagcagaagatagtgaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9914 - DNA, 613 bp, Oryza sativa
ttgccacgtaagcgccacgtcaatgccatgtcagatgaagaccgagtcaaaatagccacgtaggcgccacgtcaatgccacgtcagatgaagaccgagtcaaaatagccacgtaggcgtcacgtcagctaaaaccgctctcaaaaccgccgagggatctcatctgcaccggttttggtagttgagggacccgttgtgtctggtttttcggttgagggacgaaaatcagattcgttggcaagttaagggacctcagatgaacttattccgtcacaaaaacaagcctgcaccgagaagccaaccagccagcccaatgcatgttgcatggcagtcacattccacatcacatgcttcaccaccatagccggaagcaagcaaccaaggaaggaataccagatcccgcactggcgtggcgtctcaaaaccaaggcgaccgaggcgagcaagcaagccccacactcgcacacacgccacgccaccccctcactctcctcctcttctcttcaaccactggtgtgtggtgtgtgtggttctcttctcacaggtagaaggaagcaatggcgatgccgcccaagcccggcgatcagccctccccggggcggagccccaacccca

SEQ ID NO: 9915 - DNA, 611 bp, Oryza sativa
tcctgcacccccctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcact

SEQ ID NO: 9916 - DNA, 636 bp, Oryza sativa
cttggcagttttttatacagtccaggtcgtttgagagatcagatgcatgaagatcgatttgctaatgagagtactgggtcaaggttttctgatttttcggcctcaagcactggtgacattagaaatgatgtgctttctcctagctctcaggatacagggtacagcagtccttctatccaccattcaaggaatgtgtcttctgaaaatcctccatcccatcggcatccgaatgcaacttctcaaattgattttaatggagtccgacgatcacaggttaatgttctccccattcatgttatatgtttccagctaatgctcattgacttaaaaccaacttctgaggtagagtggtttgaaataaatataccatctttctatgtgcagagaacaggttcttcaggaagttttggatcatttgatggtagctcagcatctaataagtcagttgattcaggtgccttacctgatgcacctacagaaaagccagtgaattctgctgtaaatcgtcagtctgttgcgccccccatggctcattcagcacaattgtatgcctcacagagcaatataaactcttcagtcagccaaactgctcccaccagggaatgtgtgcaacatggaagggttcacatggtctct

SEQ ID NO: 9917 - DNA, 2019 bp, Oryza sativa
ccatcatttcgtggaccacttcaacagcaactggtatgttttatcaatgattcaaggttctttgctctgcaagctttcctgatttgttctacaacagtttgattttgattgagaacaagcatatacattttttctgttacttcccaacttatgacagatagttttatcctttttattcctggtatctagtttaccatgatattgttggctcattgctgaatggacaatttatgaaatttggaacctgttagaaagatgatgctagactggatttttttttatctgtatggattgctgagattattaatgcacacagacagaatggtcttgtaattttgcatgtaagccttttagttattttgcttgttaatcttgttatagtctgtattcacctacagtgagtacttttttctacaatctattggtttgggactttgggcacaaatgatgatgcctgtcgtggggcgctacctggagccttattatgtcagttttctaaatggtttgttttgctttttaactgttcttttgaattttgtttcaggacatcgtgccatctcagcctgcaaaatcaacaaatccatttgacatggcatttgagtctgatgttgaagccagtaacatggtgtgtattaattatactatgatgtggtttgtggtcatgataattataatatggattctagcttttttttaatggatataatcatattttaagacatttggaataaacaactaggaccaattatctaatactctagagacatttatttgcgatctttgtttttagacatgttaacaatagcttagttggttccatgctgcaaacttctatttttcttttgttgtttctttattcactatttctttctgtccttttcagttcatggatctgacctcgctgcaagaaacgttgccaaatccccatgtcaatacagattattccaacttgactgagtcatggatacctcataattctaacatgccttatatttcctctgggccacagggtatctgatcctttatatctccatgatcctcacgcacaagaacacaagcatactctactcttaatgctaatacaatatcggattctgttgttgtttcaggagggttatcatacatggcaacacaagtacaagactccctcatgctgtaagctcctttctaacaagttattgtagttagcattagggcttagtttctaaatgacctcctgtaacaggaactccgcacaagggtcatttccgcccagaaatccattcgaatgaatgctgatagtggtggacagataagcgaagcagtttgcaactgcgtggaacctaaatggaccatggggtagtcgggtgtaccacacgcatcgaagtatatttgtgtcaaatctgcacattgaagtgaatatatatatctcggatttcatactctctggtttcctgtatatgagaaaggagtgttcagaataccaaacaggcgggctggagttcttttttgcctgaagcaagctgccctttttcattgctgttaccctgtctgggaccctggtgaaacctgcgggtttgttctcacctggctgtcatttgaccttattggggtgtccttgttaaacccaattgtcattaaaaaaggtcgtagacgcatacccatcaaatgactagatcatttgcattctttggttcttcagcatgaacttgtgaaaatgtgttggttcaccgaatggacggattgttgcgaggtgttatttattgagaagtagtagtatattgcttttcttggtactacgttgaaactgtttatatataactaaaacttgtcattggccttgtttgtatcctccgggctattaaatagccctccggaatcttgctatttaggagtattaaacgtagattaccgataaaatcgattccataacccctggctattttgcgagacgaatctaatgatgtatattaatctctaattagcagctgattactgtagcatcactgtagcaaatcatggattaatatacctcgttag

SEQ ID NO: 9918 - DNA, 9612 bp, Oryza sativa
  unsure (1)..(9612): unsure at all n locations
aggtatcgatgacatgttagagttgctctatagaggccatagacgacttcatctttgaaaagctatctgcatgttctctatatttgaccatgtaatttcggatccaatccaaaatgttgcagtagagaatgcaaacaaatttcaaaaaaaaaaaaaactagacaagggaagcaaacttcacccaaaaaaaaattgtagtcgcagtgccggtccagttttcgaagatgcttataggggtaggatttacgtgcgtgcgttttttaggggtgagtgtacatgtatagtgagtgtcttcttaaaaaaaagggaaaatattgatgaaaaaaagagaaaaatcggtgatgaaagcgtgcctgaagctgaaccaccagaccgtacgagcagaggaagccaggaaggaacaaaagctcgtctcctacggtcctaccctgccctggttggggttgtcctaaaaccctacctaaaatccccaccccgcttcctcctcccaacccctccccgacgccaccatgcgccccttccaccctccccgccccaacgccggccaaccccaccgcccgcgccccggcgaccccgccccgcctcccctccccatgcacccgggcttcaaccctccgcccgtccccaacctcgccgccgccaaccccatggccgccgcggcggcggccaaccctttcctcgcgatgcagctcttcggccaggcgcagcagctccagagcctcggcttcctcgccgccgccgcgctccagcagcaccatcaccagccgcagccgcaggcccccttcttccccgggggaggtttcccgccgaaccccaaccagttcggggccttccctgtccagcacgccgggttcaacggcggcggggcgtttcgacctggtggcgtgggcgtgggcgtggccggcccccgtactccccgcccgatgatgggcgcccctggtaatggttacaacagcggtggcggcagcggccatggtaccggagctggtgcgccgagacccatgctgaatggtggggggaacgatcggaatagcagtgctgggaagggcggtgaggtgaggaattattttgctgttgtgtattgaaatcgatagattgtctatgaacgaaaagtagtcttttagcctatacgatcattagggactgtgcaattcttatattgaggaaatatccacaattgcatattttaccagtatatatgtcatgcgatcatatcttgctgatattttttttcctggtgggttcatgggtattagtaagaccagttaagatcaacccatattatgtggtcagaagtatgatgtctcggtctctcagacttttagtacgcaaacgactcttgactacatctggatagtgtatgttcagcatgaaagatataactgaatttacttgtcatgctctctgtttctaacaattgcctgacctgatctatgatgagcacatgtcggctcgattccaaatgaccttctgttcttttctgcaatgttcgttgaacctttttgtactatatctgcaagttttgctcgtgcttctttatattttttcatattgatgtgcgtgaaatgttacctactaggttctttcggcatactatgactgagctattaggaaccgattagataatggccatatcatcagtaaaatctcatggatagacatggttttgcacctcatcgtttattgcaattgtgtttcgttattgtacctattcaggtttggcttagcattgtattccaatttctgtttctctgcaacaggtaaaccacactaagatcaagccagatggcatccctcgttttacctctgaaaatggtgagaggaaaaatacaacagatcagaaagcccgattcaactctggaagagattgtagggatagcaggcaatttggcccatctggtggaaggggaaggggaaggggaaggtctttcaatcaaggtcgtggaggaggtagtgaatattgtatatatgccatatggttaagcatataggcaatacattgtatcaccttttgcttttggggacgcatactccttactgttgtcaagtgagcatgcagcatttcatgttttacttatcttgtttttatttgctgcaatggtttcataactctgtattattgaattgtgcacatgttttgatcatcttagctgcatgcaggataatgaatgcctttaatacatcatacctacaagattatcagtatttccagctaactgctgaattgatgtatcgcctgtcaggaaacaacaactggagagatgcaaaatccaacttcagaagcagtgacagtccaagtccagcatcaggacaacgccgcaatgacagtccagcatctggaggacaccggaagtatgtatactggacactagtttttttaattaaaaatattattgtaattggtaatctttttatgtgccttagatggtcacaattctggtttatctgtaataatgattatttagttattgcttctcccactcgtagcgctgaccgctaattattgcgtgtcaacaatgcattgctcaactagtacgcttatatttctgttccatctaacgagctgctgttctacatttctaaaccatgtcgatggtttccagaaaaaaaaagagttaattcagtgtgtaaatctagggaggaaacccatttactaaattacagggttgtacagaatgtcgtaaactttatggtcctttattacctgttagttgtggttttctggttcttgtcttgattttttttaaaaaatattcatggagtagtgatgtttttagtgtcaattgagtttgttcctgcaggcggcctcgtataatttatgatgcaaacgaagttaaacagtggcttgaagcacgcaagaagaactatcctacaagtgtcaacataaataaggtcaatgtttgtctttaaatacctctttttattaggcctcagcaactttatgtccacatcagactatcagagaagcatcatcaactgaccacttaatgcagaagttgtctgagagtcgaccagatggtgagaagaaggatgaagaggcccaaatgcgccgtcaggtaaagcaatctattgctatgattcatcatgcatcttctttaggttcaaagggagagggggttgatctagctttgaatggttctataagtacattttttttaacaaactaaatagaagcttttgccacagtattctgattgtgaacttttggggatgaattatttatgttggcaaatgtaagttgctcatgctcttacgtgtgattgttcattctcttgtgtatttcaggaactcaaggaagtattagaaaaacagaaagaattgggttttgaactccctgaactaccacctggctatctatctgaacatgaggatcaaggcaatggtaggagaagtaactggaaaacacaacgcagggattgtcgttttggaaaccgtgctgataacaaaagatcaaggtatgaccgcaatgattttcagtctaagagacccaaggtacggaaccaaactcattgtgatgatggggcagtgctcaagagcagggagccaaccctcttgcagaaacttcttagttcggatgtcaagagggacaggcataggcttctccacacgttcaaattcatggtccttaacaatttcttcagtgattatcctgataagcccttggagtttcctagtgttaaagtaaaccagatcgaacttgaaagcaacattgctgaagaggacctagatgacttgatgaacagcgagacggcaaaggacagcatccttgatttgaaggaaaatggtgatcagaaagactcgagctcaattgatggagaatcagacctcgatgacgacaatgatgatgaagatgaagaagatgatgatgatggcaatggccagtgctgagagcagcgacaaggatgagaacgaggacgtcgatgcagggcagatgtaatacgccgtttttttaaaacatgatggaagtaaacgactccagacgtctacacccaaaggtatactcaaccaaaatgtaatgcacctgaagtcagaggtgcaagtatccagcagggcacaggccaactgtgtttttggtgtatagttggcgttcacaaatgatatttatgtagctgcctttgaaattttgttatcagttgcatttgctattatgtgttttgctgtttggagaaagcacatgtgctccttagaggtggccacgtgttgtgtcaggagccgtgttatttcaggctgaaaccccagagtaaaagagggtcagggcaccaatggagaatggtacccagggcccaggctgggcaacctccaacataagcgtgacagttccttctctttaccggaaaagcggcagcaatacaatctttctcccttctgctctgaaacagaactccactcaactgatgagtgatgcacatcagcatatggcctcccaacacagcacaagtccagctagctacctcctgcactgcacggcgagccatctcttcctcacggtcacggcagcatgccatgcatgcaaccttcatcagttctaggctcacttctgccactacccagtctaccaccaccttcaatagccttcaccttcccaatgacggcccatcaatgctgccagcggaggcgagaagacagagacccagccttgtttgtttgggaaagcttgagattgagaagttaaggtggtgtttggttgaagggactaaagtggccctctcacaaaaatataagtccctactatagggacttatacttctgtgagagggactaaatttagtccctagttcccaaacaccccctaagggggtgtttagatggggctaaaactttttagcccatgtcacatcggatgtttggacgctaatttggagtattaaacataaactaataaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaatatccgatgtgacatgaacttggaataagtccctggaaacctaacaggccctaaaaatgttagcttttccctgactcttaattcattttctagattttagctagtttttgcttgtctcagtgtctctctctctatatattttaactttgttgcccctttgtgtcatctcagtttccactctaaaaaaagagattatgttagctattgatgtttaaggaagctaaaacttttctccccaaacaagagcttgcccagattccgctccgatctccctccaactgaatttccgagcagaatttaaggcccccgcgaaggcgctgtacccagttctttcccagtccccagtccccactcgcggccagactgtggcgccttgccgcccccgcattgatgccgcattcaaagtagacgcgcgcgcacacatggcagcagcgaccatcaatctatccgctcggctctggcctcgcaaccaatcgcccatgcacgcattcaagctgcggttttgccccggtcgggttcttctccctccctcctccgcgatattgctgcatgcggctagcgtggtggagtgggatcagtactactactgtgccacggctcggccgcattgaagagcgtccaggagtaggagtagccggtgtgatcctagctaataatcggcgatccagcgagtgaatgagagcaagtttaaccgtgtagcccactactagctccaattcatctatagccaatctaatagccaattcatacaatagttgcttactatactattaatatatggtcccacctgtcatacacacattatattttggagtccgcgctgtagctggctacagatttataactcactgctcttctctctcatcttttatcttattaaaatatatttatagctggctaatagcctgctattgtannctctgagcgtgatacggaggacgagccggtcggcgagacagccagccaggcaggtctgggtcgatcggcaggacaggggtactggacccagccgggtggatttcgattaaattcaccgttggatttgaccacagtgacccgtgacgtctttgaagagtggatctctgattctgtgtgtagtgtgttgggagatttcttcttcacttgctattggttcagtataaatgtataatgtactaacaacagtagtagcaagtttgatgaagcctgaaagacatcacagcactacagctagatttgtaccactgcgggccactcgggagaacgtacgcacgctagaattttttctggtatctacagaaatggaactgattccgtatagtagtagaaatgtagcatgagaattctaaccgggcgcgtacaaaatcgcagtcgtgctcgtctcatcccgctgtatataagcaggcgactcctgtgtacccgcgcacacgcaaaccatttgcatttgagccttttgcttgccttctctcctgtcctgactgcagcgagagatcagtagggagagggcaatggcattgacggtgcggctgcacacggcggtggcggcggtggccgtggccgtggtggtggcgatggggatggcggcggcgcagatgtcgccggcgggggcgccggcgccggcgggcgggatcagcccggcgtgcatggacgcggtgctcaacatgtcggactgcctgacgtacgtgatgaacgggagcacggcgcggaagcccgacgagccgtgctgcccggagctggcggggctgctcgagtccaagcccgtctgcctctgccagctgctcgccggcggcgccagctcgtacgacatcagcgtcgactacaagcgcgccatggcgctcccgggctctgcggcctcgccgcgccgcccgtcaccgcatgcgcgcgtacgcacaattactccatcgcctctcttttgctcctcccttttttagttcgcttgcaagggtttaattctgcctagcatagttgcaaaccgtggattttgacgaatagtagaacgtttacttgcgtattactagtactagtaatgtttttttgggaatactcaaaagatttgcgcatctttgtatgaagagaataattacagctgaacgagaacacagaaaaaataattaatactccctccatctacttttttttgatagtcatattttatcttggcacacagaccaaggataagtaattctacttatcatccatataaacatgctactagtcattccttataaacaagcgattcactgatatttacgtttctcaatgcgcatgtagccaatcatgtgtgtaagaatggagagtcatgcattaaatccgagaaagtcattaaaatgataggttgttgaagtgaaatatgcttatcaaaaataaaatttttagatttggaaatatgactatcaaaataaatggagagaggactattaatactagcaatgtgcgtgacacaacaccaaaagttagaaaggagaacaacttaaactgcatctgttctttgttcacatcagtctgtagctagctaggtagcttagctagtggaaatgtgatcaccctaatggtttattaccctgtccaaagctccaaatatcatttcactaaccccaacagtatatcttaccattccattcatcgaattttactgttttaaagaccgtataaaattaacttttggttacacacaaaatgcagttcttggagtacctgtgcctatggcgccttctgcatcgccgatggcaggcctcgggccatctactgaaccacaaatgcctggtaagtactactgctcatgtgctttcttggttcagtttcatatcatatatgtatattctgagtatccaggctcaagaaaattctaaacagctcatgataattaattgtgctataacaaacaataaacggagagaaaattggcatgttcttaacttattttagctgcatatatatctagatccttctgtccatggtagcacggtacagtacagcatataatagttccactaagtatccattagtgctcataatttttttttgaacggaacggaagtgctcataatttctcagctgattttgcttacggaagttctgtagttgagcagtgtcattgtaggctactacagtgctagggatcctgagtcctgacgagtcagcctgtcactagtcacacatttgcttgatcagctaaactctgcttctggcgatgcatttctgcagagaaatcgccgtcggcctcgccgtccgagtcgagtaaccatgctcccggccgcttcaccgccctcgccgcggtggtcctcgccgttgcagccgccgggatggtttagaaaatgcctggattttcggccgatcgatctcaagatttagcccgacgattcttgtttattcttgccacacatttggctgtgtattaatttacaacacgttacagtacgtatgcgcaatgaacgatatttttctgctttgctttaaattcttataattaactagtaactcttccttgtcgtaagttgctagagcatatggtgagactatatgtacacacgtagtgatatctggccatccgcagtagctacttggggccttctgttaattattttcagtgtttaaatgcttggtttttggaggcgaggtggagaggatttttggaaagatgtgagctggagatgatcaaagtgtggggaaaaaaagcattggattcgccggtcggcaatacacggcggccggccccgatcggccgtaaggcgctgtaggttcatgaatgctaagattccgatcccttcattcaatcgcttcccaactgtttgagaaattttggttgcgtctcctcgtggcgggccatgtgatttccggttgctcctctccctcccgtgcgtgtatgtagggacgacgcacggcacgggggctggatggatcacgggatcaagcggatgaggcgcttgtgatctcgcaacaaagagctctaccaagccgtacgtccgtcgctagccatcgtgccatgccatcatgtgttccgggatccaaaacatgtcgacgccgccgaccgtacgtcgcgatgcgctcgatcgctgcgggcacatgtgtcgctgccagcttctgctcgatcatgtccgcccagcacatgccccggcccgttcgcgcctcggcttcgtgcgactgttcgtgggcacccgctcgttcgacgcagacgctgaggcggcggcgagctccgcactggactccgcgggagcgccgaagcgtcgtccgcgcctccaccatccggttgcagatgctggcaggctgaccgctgacggcggcaactcgacctgctcacatgctgctgaggccgcacaccgccaggacacccaccgtacgaactactccctcaatctcaatatacagtaacctaagataaatttaattttattctagaattataaatctgaacattagatttatagttttatgatgaatctaatcgtatcctaggttgttacatattaggaagttgaaaacgatataattcctgtggaaacaattctcgattggtccgtcagaaattcttggttcttcatgttcatc

SEQ ID NO: 9919 - DNA, 1109 bp, Oryza sativa
aaattaaaaaaggaaaatttactaatatataaatatacaaccaaatcataaactgaattacctctaattacagatgcagtgcatagagtttggtctgtatatatattagtgactttatgttatattatatgacaactatagtatgcagaattttacttattttttaattttgtttctttcatgccaattagtgttgcatcttacttttgtatcagaccagaatagtaacacatgttaattgtatcaagtcaactcctagacatacagttgaatgaattaattgaatagcacaatcaatacatttctgtattatagccttactataattgaaaaccaactaaaattggtgcataccatgctggtgttctcctctttttatttgatgttgcagtctcactagcataagcatctgagttataggagtatttgtatgttggagcaaaaaaaatcttcccctcattccaccccttaaatactctcccagcatcacgttcgattttgagctggagtgttatacaggacataagtgagggggaaaaaagtattttgcagaggaaaaatagctttcaataatataatggaagtatcaaaagatttgcatatttcagatttcacttgttttaaatttcaaaaccagtaagcacagaggagtaccataatggtgtctaaggaaaaaatgcttcctataatattgttttgaaatagtaattgtttctcaggtacatgatattgctattccagaaaaaatggatcattttcctgcaacaagaaatggaagttacctgatccctttcaaagagaacatcccaattattttccatcaaaaaatttttggtatctgcatagctcagtgcgatacgatagttcagatctccgaaccatatcaccttactgaaacaaacagcgtatagcttagaaatatacgcttgacaagatacatatatttactaattacaagcacactaaaagcacattcttactcatgctcaagaattttctctgggatttttcgcacacctctcctgcaaatccttgaaaacagtgtaagcctcagtatctcaagaacatcagagttcctccggaattcatcaccttctttctgacctgaa

SEQ ID NO: 9920 - DNA, 631 bp, Oryza sativa
tcagctcgtagcgggatagccgacggatattgcgccgatagcgcaacacctcccatgcttgtcgcaggcggatcaggccgaatagggtataggccagcgccgcaaccagcccgatctcgggtgacagggccacagcccagggcgagtacacgcacagtactgcggcagcgatgcaaattgctaccgtgtaaagctccaccgcgggacggagcttggactccatcgcatgctcggccatgaccttactcactgctccaatgatgtggcagtgatcaagacagggtaatgctcaatctgcaggcgggtggcgatgtcgttaccgttgaccggtaggatggtgacactaggagcggctgctcggatccgagccaaggctccggtatcggccacttcgacggcaaggccagccgcgccgatttcctgcagctcagtcgcgcgttgacgcaaccaagccagtgattgggtatcctcacccaccaggaaaaatggccgtaagcccggcatgtttagggcgcgagacgtgatttggccggggctcaagagggagctgcgaacgggtaatatccaggtttcatcggcaaatgtggacaagtccgtatgcatggcgcgaccaggctggagattgttgttt

SEQ ID NO: 9921 - DNA, 702 bp, Oryza sativa
ccaacaattatggtttgaaacgtcgaggctttcatggacgtgcctccgcctgatgggacgagtctggtgtagcccgcacgatgccgacatcagctttctgctgttcgaagcagaccgaacggctgacctcatcggtcgtgagttgccaggcggagccagccagtacctgtagtgcgctgcgtaacgcaatcgggccgagtcggtaatgggctgcaggcagaggccgagtgaaaagtgtctttactggttcggtggtagggcagagcgaataacccgagcgctgcagcacgtaatgcatcgcctcctctaccgagggattaaggttggacggtatgctcacatcaattatttgagcgagaagatcacgttgctccgtagtgggctctgtgctcaccagggtatagcgaccataacggatctccgccggatggtttgcttcggccgggctccttgataattgggtccgattgagccactgtcgatctttggattagtcggcaatggggtggaaatttgcgcgctgcaggcactcaaaaaaaacagcaggcagacaggcgtaaaaaaacgctccatgaaaaaacctcatgtcagattcagtacagaacctgacatgaggtgaaggatcgattcagtgagaaatccgatttatggcaggtcgtgttaacgctaaatactttgcactgcatcataggggtgcaggaa

SEQ ID NO: 9922 - DNA, 630 bp, Oryza sativa
ccagcgtcgcatccggcgacgggttggggtggtcgggggattggggggtaggaggaggaggggcctatgctgttccccgggcttagagtgatggccggggaggtcgcggcttggcggtggaaggggtcgtcgacggcgacggcgagggaaaccgtgtaggcggcgggctgcgccggtggagacggggaaggcgcagttgcgcagctaatcgatcggcgaggggagggagagagagagagagagagagagagagagagagttcactgttctagaggtagaagatgcacagaacccgttggatcttagaaccaacggcccaaattttggctgagatcttgcgaagaaaacaaacaagtagcagcttaatttgttttgtaagatattagtattatgtaagatatagtgactaaagtacttccacttttgaaactttgtcctagatatgctatagtaggctgcctgatttctctgttcagacagatgtttatgtttctaatctgatttctctgtacaggctgcgattgttctcggcatggaagatctcaaggatgaatgctacaataggatgctgcaagatcatcagatgggaccacagcaagtgaagctgtttttgcagaatgtgctgggaca

SEQ ID NO: 9923 - DNA, 4413 bp, Oryza sativa
  unsure (1)..(4413): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattctaagatcaactaagcatgtcgacagattaaaccaagaacaccaaagatggactgaacaaattgtttcaagcctcactccttattgccaagccaaccggcttatcatctacagagctttcttggcccatgtccaagaagccgcaaacgaagcttgagcgatgcaagcaagcaagcatatgcattatgcatccactcacttaccctctccatcccttcccgcgccgacggcgtctgcggcaatgtcattgcccacggctatcaacctctccttctcctcctccgcagtcgccgaggcggccggcgcatcagacttctgcgacccggttaacctcgcgagtagcacgaaggacatgccacccagcacgttgtttatgcaccggagagcaacgacggacaccttgaacaccgacggcggcgcggcgttggcgagcaggtactcgacgccgttcagcgtctggtaccgcaggttgctgctgacccccatgtggatcgcccaggtagcggcgttgagcagcgtgggcggcgccttgttcggggtctcgaacgccgggtccatgcgtttccgcagcgagatgaggccgttggagatcgcggtgccggcgagccccgcggcgaaccccacggcggcgaacgtggcgcccttggatagcagcgtcgcgacgcgggagcccaaggagtaggcgccggcctcgaacatgtggctggggagccccgacgcggcggcggacgcggcggccgaggcgccggcggtgggcgcgaggaggtacatgaggacgaagttgaggatggatccgacgacgagggtggagaagacgaagtcgagctcgttgagcccgaagttcgggcgggacgccatgtcgccgagcacgcaggcgctgacgccgacgagctcctccatgagcaccttgaacgggaactgcggatccgcggcgacgcgtgccgcccacccggcgaggaagatgccgaggatgccgccgctgctgcccccggaatccgcggcgtcgccagatccgccgccgccgccgtaggagcgcggcggcgggggcagcctgccacctggcccagacggaccagacggggacggggatcggaggcggaggaggagggcggacgacgacgaggagagcggggagaaggagaggctaccggcgcggggcggggagaggcgcggggaggagtcgaggtgcgtgggcgccgtggcagggaggaacttggcggcggtgaacgccatggaggccatggcgatcgggaggggagggcgccgcgcaggcttggcggcggcggcggggaggagagtgagatgggctttcgatgggggaagaagggttttggtggttggttggtgtagtgcaggctgtgctgtgcaggagtggtagtgaaaggtgtttggtgggggtgggtggccattttgtactgtacaacatgcgatgcgcttgcaacagaacgacggctgcacctggacgcgacgcgagagcgacgagacctactccttctgattggaaaaaatcgacgcatatgattctcgaactgcttgaatgcaaaattggaattttgccgtttcaaaattgaagtacggtgatttcttctgagattgtctctgattccaactatggctcaaagccagattgctagttatggctgtgtttcggaggtatgggttgggaaaacgacgtaattcctctgttgcatcaatatgaatatagtaaatgctagaatgatttgcattgtgaaacggaggaagtaatagtttagcaaataattaattatgtattatctaaaaaaatgaaaaatggattagtatgattttcttaaagcaaaattcatatagaaaatttctaaaaaagacactctgtttagcaatttgggaaccgtgcgtgcgaaaagaagttgagaacttgcaaaaaggaacacagcataattagaatgtttcacagtttcactgtttcaggctgtcgcgttttttttttgtcaagtttaggtagagttgtcaagcactctggcataacatgcgaaagtcagttatctagcaggaattgtcagaacacacgcgaaaacatttctgcattctttcagggataacattcattcagggagaagaaggatgctcttgcggctgtcaatagaaattagccactgcttcagagatcaatctgttgacatggctatgttgtcgcaaacaggaaacggaaaaccttaagaccagtatatagcagttacagagcacataccataaaggaaactgctcatcacatcagatggagataaagagaatgttaccggttacattttcataacagagcacctctttgggaatatacaacttatccaggaggccagttcatctgacgtccccctagaagatgaatatggaggtgatatacagactgacctacataacacagaaaaagtcagtccaactatcttaataagaaaggcctcaccgtctcaatgggatcaagcttatgctcacatccgttaggcccatcattgatgacaatcctgaatccatcatcaaggttctcctgctttgcaatggtcttagcagcgtaaagaagatggcccataacctcaacgtgtctttcttctgcctatgacaattgaaataggtgccagttgtagtatcattcagcaaaataatgtggctactcaaggatcatgatttgttgaaatgtgatatcatgattcttataaattattttaccacaatcaacgtgtacacggcaagtcggcaagatatattaacatggtagatgagcggatgacctgcgtggcagtgcccggcctcttagcgagttggtagagttttatagttactaatccgtagtatgttacggacatgaggatgaaaaaaaagtaaaatgttgtgttagatccaagaagcctaaggtataatattgaacttaaggtacaaagctacagagagagagagagagagagagagagagagattattatccattagtaaaaagaggcaatagtctactattttcaagcatctaccactctgccataacactcattctagtgaactgggtacatagctcactgtgaacttcacatatgaagaattcaagatggaatcaactaaatagaacccattacgatgtttaaaagataagatgaaactaagtacctttgagagcctagacaatccatctttaaccttgggaattattataatatgtactggagcttggggtgatatgtctctgaatgcaagggtctgcactgataagattcaaaacgtgacctattagcagctcattttcattcacaatcatgttcaagcaaacaacaaacgaattagttagtacatagcagtgattactaattaatgcagataccaaagttagttatcacggggaccgagccagaaaactagaacagttcttttcatgaacactgaatggagagaggataattaaccttccatatcaatattagctgtgaatgtgaacaaagaattcgaccacggcacaaaattctttcaggtgactagtgagataaatataaatgaaataacatgtacatctcgaacctttctttggaaccttcatttcatctaatgtgatgacacacaaatctgttgtgttcccagaagatgagtaatgctttctcccgcattaaaaaaaatcataaaaccggttaaaaagtatactttttttttatttaacttcacgaaagcacaactttgcaagaataaatattgaaaaactaaaactaaatcatatgacattggtcccactagtacgacaaacaatcaaacttccattagcacatgctaagttgctaactctggaacggctctctgtgataatgcctttgttgagcagcaccgccttgatgattctcacctgctccacctttgagccctctattttgaaatgcgaactgaagggaaaagaacatgtatcgctatggttgataagtacatccagatgtagcggggatagggggatgagttggcatggccgttcattgtgtgcagcttgcccagttattgtgtactaagtaggaggtggggtgtggtaacaggatgactccagatgtccgataacaggatgagtgacagtgttgtagattttcaatagttactgttccaaagttgtagttttgtgaagttggaacagaaggttgtggttttcttatgacaattttgaccccaaaaaaataagtcgttgctttgtgaaatttactctttcccgttttggagaa

SEQ ID NO: 9924 - DNA, 1287 bp, Oryza sativa
gtttgatagtttgatctccttagcgaatcaactcctcccacataatcaatctaaagggttattcaaattatataacgatcagaactgcattaacctaataactcatgctcgagctacatttttgtacaaattttacagcccccggtaccgaaactgcacaatagaatctgttcatccaacatccaatatcttccgtgcgcttactagaacaaatttctcgcagaactggtcaagtgaacaagacatcatgatgcgcatagatgagagagagagatacagagagactgacatggttggtccgtcggaggggccggcggcgagtgcggcctccttttcgccggccgtccgagaagattgggacaaatgagacgcgagaactgcgaggcggccgccgcttccgctcgccggcggcggcagctgcggcggcggtcgactggcactggcccggctcatcccttccccgacttcctcgcccaatcgctgacttactgctgcctccatcaccgtcacgctcgcacctcagcttttcaacagatttcccgcttactaaaggtcaaaacgtattttccagctttacgctatgttgccagtgtaaacgtacacgtgaaagacgcctgcacagactgctctgtaccgcattacaaccgctcttcttaaaacgatgctcccaacatactccctaatgtttgacgccgttaacttttttaaaaaattttgaccattcgtcttatttaaaaaatttaagtaattattaattctttttctatcatttgatttatttttaaatatatttttatgtatacatatagttttacacatttcacaaaagttttaagacgaacggtcaaacatgtttaaaaaagtcaactgtatcaaacatttaagaaatgagggagtattttactagtgctctttactagttcacttattttggaacggaggaaatatacaataagcatttaattactactagcttattgcatttaattactactagcttatttcagatcgaagaagtatatataacaagcatttgattgctggtgttaatccgaactcttatgattctcaagcccacaacatatgagaagacccgagctgccaagggagcaagtcctatcaaagcatcaatctatcatcatctggataatgtgagaatgacatatacggatgtttttttttgttttcttctatagattctgatttgaatgggatgagattcgtgctgtgaaaattacaaaaagagagaaacaaatcgcatcctagattccaagagtaaaagatgtt

SEQ ID NO: 9925 - DNA, 2500 bp, Oryza sativa
caaaattagcataatatatagtactagctaaattgatatccagtggcaagtgctaaaactttgaattatcattaaaggagtactactgccaattttcttgccacatcagatgcactgaaacaatgtggtaccagaaaaatatgaaatataaatagacatgagattaatacttctagctttccagggacatgattcagtccgttggatccttgctaatcttcctatagtacgaaggatgcttaaaagacgcatggccatccagggttaatgggatcaaaataacttagaaaatatcttttattgctaacactgctttgtttgaggagctaaccaattagtcagagggatgcaatatgttagaaccagagatgcaatatgttagaaccagagtccacaacagtattctgcaagcagaattcttcaaatgccataggtaagaagttactttattggacagtcatccaaaagttgacatgcagaagacaattcctacacacaaacaatgaccatgacgaagacctcttgattgtaacttgatacactacctatgaagtagtacagctcatcataccagatgataatattgctgttgattagactgcgatgtatttctatgttttccatcacaagattactcctagtataatgctgccccattttattatcgacttagagtgaataatagtataaggtagtcttttcgaagatatttaaggaaaaatacaagatacccccaatatccaccagaaaattagtttcctcccttcaggcacaaataagatactggctcaaataaatgcttgacgggacatgcctaataattagatcaactaatagaatgaacagtatatggctcactcctacagtcctacctaaaaacagtcacctcaagtggtggaagcaaatacttaagattatattattattatagagctgtgaaaacattgaaaaatcataaggtgtagtaaggccataaaagggtcttagtgatgtatgacaagtacatatcaacaaggtagcttgacaatatgaaatagtaaaaactagacataagagacagtacaagtgatagtatttatttcctgtcacttaccaaatagtctgactcctattcagaggcagaaagtgaagacaaattagggaagaattaattggttaatttataggacaagcatgcaccggggaaaaatacttgataggggaaatttgcaacattctgatataattgcagtggaaaagacagtaccttttgcctctttagcctcacattctcctcttctaaacgagaaaccttgttttcaagttcattagtgtaggcctgtcacaaatgaaatgtaattatgcaatcatgtgggtaatacacaaactcacaggtcacatgaagaaactaaatttaaagtaacagtggccttcttaatcatcatatgcagcaagaacaatgctaattaaaaatttgccacaaatagaaaggtgtaaaacacatattgcacctgcttcctggctcttgaacgggcagctgactccctgttcttgatcatcctcttctgccttctctccatcaacttatctgccacatcccctgacatgcctcgcttccttccaggcgtctgcgaatcggacattccgccgatcattcctgaagaagtctggccatcagagtaggatggctccagaatagcaccggggccaacattaagtggctgagggaccaatcgattcggaaaataagcaccctgcacaccttgctgcccatggtgatgagcatcagtagatgcaatctgctgcttatactgctctatccagtgtgatccaggtgccagatccacagtcccggttgctgtaacacctcttccaaccggatccacattgcctacatcactaagctccttgagagatccttgggtgacaaccccagctttgaccaggaaatcctcgagcgtcacctccccaagcgtcggctgcctctctcgccgccgtcgacctccgccgccgccgccgcccgtttcggcattcctcttcggagcagcctggatccccttccacacctcgtccaccgtcttcttgctgagctcaggcggcatcgtgatgctcccctgccgcaggaggcccgagcccggctgatgctgctggctactggtggtggcaccggcaccgtcggcgatggccaggccgtcagggaacacgctccggagcagctcgtcgaggttcatgctgtgcagcggctcgcccagctggctctgcacctcgtcgagggtgaggctgtacatggatccctgcctccccagactccgcatccgccctcctccgcgccgcgcgacgcccccgcctccggccttcgacgccattgtctggctccccatgatcgagacgagatttctgctgctacgaggtaaagaatggataccttcacaattgaattcgatccagccgcgttcagccccggcaggcagaccgacctgcttgtccccggtcgccgcggtgcaggcgaggaggtcggtca

SEQ ID NO: 9926 - DNA, 15204 bp, Oryza sativa
ttcctgcacccctaacttggcttcaacgaaattggagctagtgctcatctagtggtaagtaaataaatgtagccataacatgcgaactcctagatgagttctggaacctctctttcgagggattttctaagattttcctatgagtagaagtgtttctatagcttggttcttgacatctatcccgagaggcttgcccactatcaggattccttaaaccaaccaaaacaaaccaaacaacacatcacgtattttatttgaacttctaaagatgcatcctactaatagagatagcaatctagcatcgaggccaagttgtttatctagtttaactttttgagcctcttgtcgctgtaaatttatctggcaacttcaaaactgcactattatgtccagaatttgttttggaaatttaaattatgttcaaattatatgttgcaaaattaagtcaatatttttttttagaaaacacattataaacgcaaacgcttacatacacacgcataggggttgacaaaataagaccgaaccgaagaaccgaaccgaaaagaccgagaccgagaaattcggtctcagccctcaaaagaccaaatttttttcggacaattcggttattggcttcagttaactaaattaaccgagaaaaccgaattgtggcccaataggcctaggaggcccaataagcccagtaaattgctaaaccctagaagtcaccgctcctagtcatgagtcacgcgacgccctcaacccatccatcgcgccacctccgcctccgatccccatccatcgcgccgcctccgcccatcgcgccgcatcgcctccgcgggcatccatcgtgccgccgccgcctctagccagcccacctacgccatggccccgatgagcgccgcctccagccaacccgcctccgctgcaaccccgacgagcaccgccgaccgtcttggcgccgcctccagccaggctccgccgcggcccggacgggtgccgccatccgcctcggcgccgcctccagccgagctccgccacggccccaacaggtgccgccgtccgccttggcgccgcctccagccagcccgcctccgccacggccccgacaagcaccacctccagctgggctccgccgtggcctcgccactagcccttgtcgccgagccaccgaacgtctccagcgaatcggtctgaccgagaccgagatcgaatttgccggtcctgagtttcttggatgaaattccgtcctgatttttcaaaaaccgaaatgaacgaatgaacgaagaccgggaccgaatttttcagtcagaccgaacgcccacccctacacacgcacactcgctcctgtcaactcacaccctactatataagcaccttcgagagactggaccgatatattttaaaattgacgatgtacattattatcggcggatacgtcgcttcctactgaaataataattactccctccgtccataatatagcgatcgaaccggatgaaatgaagagagtagctgtaaatgtgagcattcacatcatgtgggtagaaaattcgaccatgtgtctccatttgtaggcttcaatttttttttggcaggccgcttccatttttgttaagatatttggacggcagataatgtgtatactggtaaccagttctaatcgtttggttagtttagtgctcgaactcaaaccttgtcatcaagaattcggacttggggaagccggcaagtaaggttatactattaatttttggatgcactgttccattaacaagaggaaagtgaaagcgatgtgctactactacatccaacaaattaaagcaattataatgcggcgtgatgatataaatgatggcaaccatctacacaataactctttaagttttaaatttaaatatatttaaagctttgcttgtcactctctgcaggcgccttgcctccttttcatatgtttccttgaagcaatctcgccgcgtgtaacttttctcatcaaaagataagcagcttgatcatgctgatctccttaataaaacagagcctttcttcaaggacgccaggccggcctgatcctaccacctgattattttttaaaaaatttggatgtatcactgtatcatcgcgcacaatgattatattattgcgttaagttctcacatccaacacaaacaatgatggttaagtccaacgcgtgttcgtgtggcagctgtgtcgagtgtttaaaaaacaaaaaatcttcatgcaccttgcctgatgcctgctagtcccgtgatctctacgtgatttgtgacacgcttatagcatcaaggatcgcacaacaaattggcgtgtagcgcgatagcgtcgtccatcggcgagattttgtcggttcgagacctgatctcgtgtgagctaagattaccacgatttcatatcacggcgacgcaaacatgcaatatactgcaaactgcgtcccctcgatgcaaccgcgctagtgccggtttatgtgttccaactgacgcttcccatgttgccggtcgctgtcaacggcgttgttccgctggtgcatggtcggtccgatccgatcgcaaaaccgagtgcgccattcgcagacaaagccggccgggatcatctcccctctttggctccggtcgtggcttcgtcgtgggcgtccaaatgggggcgagtcgttgtgtcggctgctgccactggccaggctaaggcgcgcgagcggtcacttgcgcggcgcgcgtaggatggaatgattgccgcgacgtcacccggccgcacttgcgcttgcgcttgcgcccggtggtgcgtcgaggtgaaaggtgggtgaattggtggtggccctgtcgcgctcgcgtcgtccgtccgatcgacctgaggaggtgtggcaactgggcattggcaaatggcaataccacggcgcgagaccgaacgccgccggcgcgcgtacgcctcgttgcgttgaggtggtttggtacttggtgggggcgattgggcagccagtacgagtggcgctcggctctgcggttgattggcccccaggttgtgaaatatggctggaactgattagctatgtgccttttggtacggcgctgccttttacaaaaaaaaatgctcaagtttatagaaataacatcatatgataatagtagaaataacgtctaagatagctaaatgacaagtttatagaatttgtttttttatcgatcattggaaaaggctctaaatgtggtttatgataattcaaatagtatatagattgataatacaaaagtaaaaaaatagatggtgtgacttaatgagagaaaaaatgagataaataatttggactataaattaatcataaaaaaattagaagaggtggatgatgtgatttaatgagagaagataaaaaacattaactaagtttggaattcgttactaaaccccaatactaggtataacccacccccgaactaccaaactgtgtcaactttcatcccaagacagaatggctcagtgactccagtttcgtttgatgtgacgctttgactctggccaattgtatttaatcagcataagacccatgtgagcctaacatgtcagcaaccaactatttccttctttctctctcctctctcccctctcttccccatcctcaccagggggaggcaagccgtggatgacatggacaggggcgatgaccggcatccagtaggagaaggaggaaatggcaaagcgaggaggtggtgtcgttgtggcggtggcgggagggagatgagggaggtggcggtgctacaacagctaatcggtgaggtgcaggagctctagaacctctaaggtgctcacttcgttccccctccctaggcaagcaagcaacaagtcaacaaccatctctcctcttcccccattctctaactctcttgttcgtcatcagcctgcgatttcctcgctacgcttctccttcgcgtacttggtcaggcaccgacactaccacctgctgcccgtccgcgaacgcgcgcctcagtctgcccaccttccacacgggatgacactgctgccgatttccaaacctccttcgccaccacctcggcaatgattcgcacttcctcccgacgctggcgagtagcagacattagccgacgaggcctacaaccctgactgtctaccacccaccatcaccacctcctccctggcgcatctccgtctcgccgactctaccaccaccgccgtcgacgatgacgatgatgaaagggataaaagaggggaaagagggggcgacaagtgggtctcactgtattttttaattattaatcgaacacttactgataggtgggtctcatgtttttttttactttaagtgccatatcaaccccacgtaggcgtcatgtcagtcgaaactgtcgttcaaaccaccttggaatcttatttgcactggttttgggagttgagggacacatcatatctgttattgtggttcatgacgaatttcggactcggtgacaattttgagggacctaatgtgaacttattcctcccgggaaaaaaacgagcccaataggcgtgttacttggtccaggacaggcacgcgtatgaagcctgcagtaggcgggccaactaaacatataatagtcctcttaacgttcaggcccaatagctggagcaattggagaccagtttagggtaacaaggaattttctcgattaatgttatcgagaatatagagcggtattctcaaaaaaaaaagagaaaagaatatagagcggtaagcaggtgaatcacggtaaaaaaaacgtaattgtaggaccaaaccatccctaactttaataggaaaaaaatgactttgctagtttcaaccctctttgaaacatttcagtacaggatttacaaaaccgtacgattaccacacggttataatggttacaataattatcatgcacggttactttttcagtttttaaaatcacgatatgtctcgtggttatcgcgcggttttcacggtaaccaccttatcacggagtgcgatatccacgtcgaaaacggtagggaaacctgaccacgacacgtcgagacatgttcttttcctttccgcgcgcggcaacgcggctgtataaatactcacctacgcagctacgtccgcatatttgcctctgccacacacgtacgcgcaaacgtgtcatcgtgcgacacagacgcttggcccccgcggagacgcatgacggcaagagtcgcaatgcgctaagcaaacctctccttgtgcagtggagtcccatacagccgcgcgcgagtggtggtgcgcacctgcatggaggcaccactccacttcacggcgcgcaggtacccagcattttccgagaccttgaccgtaaaaacgcccgtcgcccccacacgcctggccacggcggcgtcacgccaagtgtcgtggcgctcggggtggaagctatagtgcccagacctttgcctcccttctcagatcactaggagtactccagatcagtctcagtagtcagtacagtcctcctccttgcttccctatataggcaggttcacttcaccggtgacacccactacccttgtctgttgtctttgttgccaaggaggaaagcaaacaggggccttgcaggagctatcaacaaaagccatggtctccatgaggaagaagaagaaggcctttgctgttgcagctgcaaccaccttgctttcccctcctcggtcctcctcctcctcctcctccacggcgtcctcctgcattgtgccgccgcgcactgagagcggcaagaagaagagtaagcacaggaagagggccaaggatggcaccggcggtgacgacgacgacgccgccgttgctgctgcgccgaggaagggatcctccatctacaagggcgtggcaaggtctgcgttttcgattcctttttcttgctctgatgatcagttcgcagttgtttgcgtgatctttgcttggtttctgatgaatgcgtcgtttgttgtgtgttgctggtgtgtaggcacaggggttcagggaagtacgaggcgcacctgtgggacaagcaaggctggaacccaaaccagacaaggaagagaggcaggcaaggtgagaaatacaaattctacgagcctcgggtctactatgttttctgcagctaatgggacaagttgattgccattttgtttttctttgttctctctttctttggttattgttaggtcattttgtattcctgctagcttatgtgctgatcttttttaatttgtgttgcaaatgcggtgtttccttctgcctcggaattcgtgtggtgatcgatgctcatccatgtctgatgtctcatcgcctccattagtctatctgggtgagtcaagatcctcttcacatcgtgggaaaagttcacaaactttttcttcgctatgattcacaaattatcactagcgtgtatggctccgaattccattgccgtcctagtaccatgcacatattctttcttcagaataactttgaatccgcagctactttgttctttctttcttggaaaagagagtaattctttctttcttggaaaagagagtaaagaagaaacacttttgggtaaagtggaaaagtactgcattttgcctgtccccatgcatgcgtcaagatacattttttacaacttcaacagaatcatcaagatcatgctctcactcgctaccagtacatttttttttatgtagaacatgctgaaaatacacggattaagccattagcattgtttctttgcaggagcttatgacacagaggaggctgcagctcgcacttatgatcttgcggcactcaagatctggggctcagaccatgtcctaaacttcccggtaaagttcagagtgtttcagcacctgtcatttcccagtagcactaattcgccgttactaattaaggaggagatgatgttaacttgttaagctcccatttgtgataaatgcagattgacacgtacaggaaggagcttgagaggatgcagcgaatgacaagggaggagtacctggctactctgaggcgcaagagcagtggcttctccaggggtgtctccaagtacaggggagtggcaaagtaagcatacattgtcatgcaatatcactgtactgtccaatcaagcactagctaagcattgtcctttgcatagcccagtagtactagtacctcttttccgtccaaaacccatttcttggttctccaaatggcatactgtgatactggcaaatctggcatgagaatacggtgtgctactagtactgtgaaaattgaaatgccaaaaaccgggttgaagttcttttgccttggctaagctctactagtaggagtagtctcaacatttgactgcaatgcccatgtttgtcaccgcaggcatcaccacaacggccggtgggaggccaggataggccgagctgtaggcaagaaatacctctacctgggaacattcggtaacgcgttcttggttttgttcaccggctacattctgttcctgacgccatgaaaactgcagtttgttaacaatggacaaccaatgcacatgtatcagtaccaccacatatgttcgtgtcgtatgttattcgctttcgtgattgttaatttgtcgtgtcatgcatgcaatgctgcctttctctttggcacaatgtgatgcttgaagaatgctactgctgcagtgctgcgtactgcacggctactgttacaaaggcccacagaatgtgccccctgaaagatggatgtttcttttgctctgtacgtgcagatacccaggaggaggcagccacggcctacgacctggcggcgatacagctccgcggccgcagcgcggtcaccaacttcgacgccagctgctacacctacacggaccacctgccgccgccgccgccgccgcagccaccgtccgtctgcaagaccgagccggagctggagccgccgcagccggcggcgcctccaggctcggagtcacttctccggcccaagatggagccctgcgacgactgggagccgccggcgatttgcccgtcgctccgtgacgcggacgacgcggaccacgccatcgccgagatcctgccggcgctctgcatggaccgcgccgacttcgaggccaggtaccctgcccgccgcgcccgcgacgccgccgccgacggctggtcgacgtcgtcggacgacgtcgccgccgcctccgtcgacgatgacgtgctgcgtagcctgccagacgacgtgggcttcgtcgacgacgtcgagagcctcttcctggacgcgcccggcccggccgccgccgccgccgccgccgcgatgccagacgacgtggaacgcgcggtgcagcgcgcgccttctgccgcgtctcgtcgggccaacgccgcggcggtctcctacgcgatcagctcgttggcgtccgggcgctggtggtattgacatcacgtactgacgtacgtgtcggtgtcacgccatgtcgcgcatgcatgcactgtgtttgcacagcttcgcaaagttggtgaaactgcagctagccagctatagttagggtgttgcgttttggtgggtatgatgtgaagtgaagtggagtagcttgagcttgacaagcgtggtccaatttttggcgagtaattgcgggcgatatgctagccaggagtatctgcgtggctgctcgatctcattgtagtacgtgaaagtggaagaaacaggagaaggctcacacttttgggtgtaactccactgtggtagcgagctggttttggtacttgcaccctgtcggattcgggtataattaagctgccgcttgtccgagttgaatgttggcgtgacaagttgacaactccacgtaagagtgtgacaatcatgttaggccattcacaatacatctacatggcatttggcctcaattgtccagctaagcagattgtatacgtggagaagaaaagaaggtgaggcccatatattcaccagctccgcgcgtcctcatttggctccgagagcctcgtcagaaaaacagcttttttaatcgtatttgcacatgagaaagcatgacacagagagagaagggggagaagctgacccaaaaaagtaaatttttgtggtggggcccacatgagaaacagtttggtggggtccacctaaagacacgcgtccacgccgcattgtggagaggggagcttcacgctgtttcttcgtacgtggctgtttaggctcctcagaaaaacacgacgcagtgctaatgcctttaggacttaggaccctttgcggcagtagtggtaaacagaagtcatgggtgatcattggtccgatgcttcaggcgaaaccaattcccgggcgaaaccaattccaggagtgtgatagggacagaaaaacggtttacaaaattatcatgtgcggtaatattatcggtttttaaaattactatgatatacctcgcagtaatcacatgatttcacagtaaacacaaagttactgcggtaacagcattattttcgcgtttctaaaactactgtatatctcgtagtaaccgattttcacgagaaagaaactcacggttaccgtgataaccgttaaactttgagtgatgataaactcatctaaaatatatagtttggtgtaccttgttcagtaaccgttaaatcgtagggtaacggtaaatatctaaagcagtttggttaaccctactagtagctactattactgcaacaagctagctacgtgtacatacgtgtcgcgtgtgagcagaatgtatagtattggttaggagtacttagtagtagttggtacagccgtatttggctactccaagctcttgttgatttgacaggagtgtatagttacgattccatcaatgcatgttggtggtgagtgttgcaccgacgaacatgcgtgacattaaaatcttgtcgcctgcagtgcaggctacaaaatgaacctgtctagagagatgcggcaggctgcaggctgatcgctgacgtctgtaccggaggaacagtagtgagtagtctctctcgtgtggatgttgagcagcgctctggagataaaaggagttctaaactttttcttgaaacttttaatttttctatcacatcaaaatttttttacacatataaacttttaacttttccatcacatcgtttcaattttaaccaaacttttaattttactgtgaactaaagacaccccttgggttatatctaaagccttccgttgtaagcaaggtctatatatgaaaaaggagcaaaatttggtcgtgttggggtcttgggggtggctagtcgctctcttaagatagctgcattgctaagcttcctccagctatatattgaaacattctgtttttggcgaacgtacgtgcgggaggagttcagccaacctgcatgcatgtatgtatgtatacctggttcgcgctaaataaattaattcttactcgtcgaataaacgtatatacgtataaagaaaagtaagatatcgatgcttcaccataaaggagctttgtgttgaagctaggcctctagaaaacagaatggtcttaaattctgtcaaactaaaattaatggtctgtctgaaagtggtggaatttcacttagaaaagtcctgttttaggcattactcaaattttataggaattaaataaattaatttctagagtctgtacatataaactgtgtgtataagcttaaaaaaggaaaccgcatggtgcacgcgcggtgggcatgcacatgaaataaattttgaataaaaactatatgctcttaaaccacatactaaataaatgtttataattaaaaatgagcatacgcatttttgaaagaaaaaaaatgagcattcatatcataaaaagaaaaccaacaaacagatgagaagtcaaacaagttcaacccaactgacctgttgggctgggccgggtcaaacctgtcaacctacaccatccaccagcccaaagcgaatcctatcccatcattccttcctggctcggggagaaatgccgcccagaatatcgatcgcatcgaatccagtcaacttgctcggtgtgatcccacggcggcagccgcaagccgaagcatcggacggacagaaacgactgcatccgtccacgcgtgcggctcgtgacgacggtggtggggctcgcgttctctcccccagctatattatctcacacgactcgtgccacaccgcaccgcaccgcacccgcaagcgcaagcccagccgcctcgtcgtgttcgcgttcgtcgcgcggctccgacctccaaagccgccgctacccttcccgtcttcgtcgtcgccgcgcacgcagatcgcgaaccagcccgcgcgccgcgcagcagcgccgcggagaggaaaggagagctccgccgcgcaccccccgccaccatcttggtgagttgcccgcgcgctctgctcgatccctctcgtcggagctcgcggatctgcccgctccggtggatttctgttgcgctctcttttttttttttctaaatgaaaattccgtgcgagtctgtggtcgattccgtggagagatgagtcgttttcgttgctgattcggtgatggaggcatgccgcgtagtctccacgctactattggcggggggaatctgttcgagccttttcgctttctgcttcgggtgttggcgaatctgattcgattccgcggctttgcgccccgtcgtttcatggatcgaacagcacgctatggggatgtgggtgtttagatctcccggatctcgtaccttgggctcatcaatttccgcttagttctgtgtgctgtcaagtgagcatgggcgcgtggggatcggcgcgaagtctgcggtgatctgtgttgctagctgagacttacctgtgctgctgaatttttgttttggagcagtagggagagatggggctcacgttcacgaagctgttcagccgcctcttcgcgaagaaagagatgaggattctcatggtcgggctcgatgcagccggtaagaccaccatcctctacaagctcaagcttggcgagatcgtcacgaccatccccaccatcggtaagcactctgttcatgtccttgttcttcttaatgagctgtcttagctgtaggaaggtactatgctgcacgtttatgtacaggaacgaacttttaattacatggagtgatggagtgagcactagttctgtttgtagaaacaaacttgaatttaaactctacatggagtgagcactagttctgttatgtagaaacaaacttgaatttaaactctagtaaggaggaatagttagcacgagcttgttcgtattataatcacatagcaaactttgatgttaaggtattggatatcactttggctacaaataaatttactacttgaaactttggttagaactaagccaagcatatgctactacacttctgtagctcttaatggaaacatctgtaattctctatacttgtgattattcttaatgatacatatgtatgcatctgttcatatggactccttttattgggtcattatgataatgtatttgtatttttgccatgtggcttcattgcattatagttttaataaatgaaactaccttattctggaaattttcaggatttaatgttgaaaccgtggaatacaagaacatcagcttcactgtttgggatgtcggtggccaggacaaggtaatagagtcagcttatagttagaaatcataactaccatttgttggctgttcctagcccttggggtaaaccggaattgaacttcttttatgcattgatgttgtcgtgctaagctgctaatgctgtcatgaactttcccaacttaattcttttattgatctataaatcaaaacagatcaggcccctgtggaggcactatttccagaacacacagggactcatctttgttgtggacagcaatgatagggagcgtgttgttgaggccagagacgagcttcacaggatgctgaacgaggtaatgatttttgttgtagacttgtagatatttggttgttccatagtgttcccagtctgcatatattgaatctatttacgaagcgcttattcgacattattgcagctacaaaattggaaaaaagtaagttgcttgtttggttcacaaaaatcttaggattttccatgaccttgtatgaaaatgctaagatagtagttgaaatgctatgaatcagtagtcatttttgttcaacctatttgtctgttgatttatttaaaacttactgttagaaataccagttccctaaattatcataaaccaattaattccatgttaataatgagagacccttctgtgtcgcaggatgagctgcgtgatgctgtgctgcttgtatttgcaaacaaacaagatcttcctaatgccatgaatgcagctgaaatcactgacaagcttggtttgcattccctgcgccagaggcactggtaaggaactccatatgaacaattcaaaagttatttaccttctaattgcttggtcagagttatgcagctctgctattctgcaaattatcagggtttacatattggacatgctgaaaacaacacaactagatctgtttgcaagagtatagtgcattttttaatgggttaattggatccatgccattacaacttcttcgattttgaaaaacaccattactattcgtctatttggagacatgtatgtgacacactctagatgtttttgatggtttatttagtcttgtggttggggttgaatgttacaaatgctatttgcatctgcattatggtttacacatctattgtgacactggttaccttttgaaatttatgaaatatgcatcatgtcattaaaatatttgtttcctggtgtcgcaggtacattcagagcacttgtgctacatctggtgaagggttgtatgagggtcttgactggctttccaacaacattgccagcaaggtatgttggcctattctaatgtcttagtctctgcttttgttgaaggcctattctggcctgaactttggcgtttaacttagggatagaagaaagctgaaccatgttactcgagcactgcctttatatacctcaataaaatcgctccgagtacttggccttaaaccttaagcatctgcagctgatgacatgcattttcattatttttgtgcaggcttgagcgttttggcagctggatatctgaacaattcactagtgccggtttacatattatataacatatacaccctaccacacatagtgtgggtgcctgtgaaggaaaaaactcctttgtggaggctagtaccagattgttccttttcgtgggcactataagtgcttatattttgtttggttttacaacatttactgtgctgtccatatgtacccgtttgttctgagatggtctagtaaattgatatgctttgtcacggacttggtgtgagcattgtattttagtttttctatgatctagtgccagtgtagatattattttcctcagcttcaaacttccgtttttggttgtcgacatcgttgttgcgtcacggatgcttgcggtgaggaaagtgatgaggtatatggttttctgactgcatatgcccattggtaattgtgacattgatacgccattgctgggttgccacaaaccaacaggcccgattgcccactgggtgcgaggtttctgtgagacagaatcacaataagatgacatcagtcaagaataatttgtaggtcatgtagtatgggtatatacactatatacgttgagtacaggaaacacgcattcattgggatgttgtaggccttgtgcaaaatcttacgaaacaaatgccaaattgaatatctgtgtgtcaagtggtattcagtactaccagttttctgtattgagtaatgactggcaaagataaaaggttgcctcagatcattacatgtctttgcttgacggaaagacaagcaaaagctaattcaaagcatcacctcttctgtttaagaaaggcagtcacgtcttatgcaagtcattcattcaagcaaatactaatgaatttgttacaccacgctttggggtgttgtacaaagtcgtcacggcagaatatgcagacaaaactgaacattgatacgaactgccgagctcgtcatgctccccaatcaaccgaagatagtcactgtgatgctgccgtgacagatatccatgtgtggtatactccatgagtttttggcctggaaagcatattaccaatgtaaaagatatttctcttttccaataataaagctatatgttctgaatcaagtaacagcatggacaaaatctaatgatgaacatgtattgatattcattttaccaa

SEQ ID NO: 9927 - DNA, 2241 bp, Oryza sativa
ggccaaatgactcaagaagaggtctacttacatatacatattttggggatcaatttcattaaatagattgatgtagaagcgcaacccatctggactgacatccctgcaaaggatacctgacaaagaagttggtattagtttatctttttatatatagtgttcatggcttgaattttttttgaatgggtaaccatctaataccaatgctttctgcatttagaagatgctccttcgctaaagcaggtgcaatcccaagtgtaaatgcagcatcgctggggcttattcccttctgaagggcatcctccttttgtgcaagtgatgagattctcgcaaatacctatgcatatcggcaaataatcagcatgtgcttctgcttaaaacgataatagtagcgttcaatctgaaggtaacagtgggcaggtgcccaccaacaaattaaatgaaatggaagataactaaacaattggaaggtccagagatatttagccacactctttgtgtgactgctaacttgggattgttatgtcgtgtgatgtgtggactgtttgacttgaatttatgatgaaatttaggcctattcttgccagtgcttacctcatcatcactatgcgtcttggtctggatcaccttcactccactgtcaaatttcctgagcatgactgggctgctcattacaaatcaacatctataagcaaaacatagaaccataattaatggctggcaacaaaccagctgaaaatactaaaaaacacattacaacatggggtacatacacgtcaaatttctcccaaagggaacaggcttgcagaagatcctctggtgagatcaactctacacaaaatataaggaaaaaaaacaatatcagaacatgtaacaaaggaattccatacagatacttagcagaaaagcacagacctgtccctcttgcacggttgtagagacaatagacatcaactagtgccatcataccacctgctttctctagtggtgttctaatatagtcagccaactgataatgaatacaaaaggttgaaaatagccttagtaagactgctctaaccgggaggactcagaagaagataaaaactcttcaaaacagtgacgagttatagaggcaaggacatttttggtgttcctgtcaattgtgtatgaaacagaacttgagtgtaaaatctgtggtctgtagttgaaataaaagaaaaccctctgaatgattcccaaatttgacccaactaatgtgtaagcactaagcagcgtgaaacaattcaggcatgaggcaaagaaatgaacagaaagtactgttcaatagaagtagaggctcttggttgatggaggaaaaggacacacaatttatcctgaagatcctatggcgataaaacctctcaagttgaagatttggtctagctggcatgatattatacaaagttcatgcattgccatcagcatcacaattgagcttcacagacagtgaaaactacttcacaatgaatgcagcaagaacacgagcaaagcatgtattacctggcgtgacagctgctggtggtacagagcaccagcggtttctttcgtcacaggggacacgattccaacactcaatagccaatcctgcatgtcttgcttagatcccatctcttcatcattggaattggattgggctgatgagttcgtcaatagcttttgcctcattttctccgctaactccatcatttccttagctttgctctaattacaagattgcagcaaaacacacacaaaaaaaaaaagctgcgttgtaaaaacatatttgttccaataccatatgactgcgttacaagaactaaatgtggaaattttacattttagctgcgttgtggagcatggtgttccagtaatccagtcaattacgattgcatcacaagaactaaatgtggacatggtatcaagtactacttggcaagagcagcagagaggaacgaaccatgagggcgttgagatcctggaaggcatcctgcagattctgccccgcgctctcccacgcctcctgctccatccgcaggatcccggacaccccaaccacgggcatcctgatggcgagatcctcctccgcgggggccccctgcgccgccgaggagccgcccgcgggggcagccgccacggcggcgaccacctcccacgccctcgcgcggacggcctcgagcagcctcccgtagaacacgtcggcctcccccttgctgacgacgacggcgacgacctccgatcgcg

SEQ ID NO: 9928 - DNA, 2829 bp, Oryza sativa
cctgcaccccctcagaattaagtttcgattaaaattttaaaggttaaacaatatatttggtcaaaattcagttaaaatttatcaaaaaccgtgatgtcaatgaggctcgaaatttagtggtcaaccggtaatgtaaaccctgagtcagtacacggcctgacgtcagcccgaaccgcgaagggcaacccctaaggctggattctaagttcactatcctaactttatcttcctccgttttctgcgcgcacgtttcttaaacggttaaacggtatatcttttataaaaaaatattttaaaaaaaatcatattaatacatttttcatttttatttagctagtacttttattaatcatgtcttaataagacatgcatacgtcattttgtgtgccaaaagctcttggattgtgcaaattccatatttccgccctaactcgaacacaaaaccatcttctcccttgatcttaatgtgtagcaacttatggtaaaattaaaatcatcttaaaactatgaatttggacatatcttgtctagattcacagtgctacatattgagacgaatgtagtatttatcttttgatatatttagagctccaaattttaaaaaccagtaaccaataaatacaacccattcagaatgaaatagaaaaacgaacatgtcaagaaatcacaagtccagacaaaaaaaacgtaaaaatataattttggtgcgctgcaaaaggttgtcctagtatctcgtgataatactatgattttatcaagtcgaaacgataccaatcctatctagtatcctactttttataatatctcgaccctcctattcatttctacacgattatatgaaatcttaagtattatctcgattctatgatccctaattccctatgatcctacaaaatattattcaaaataacgtggattgataataatataaataaatatgctcaagtttacatcgaaaccaattaaatttatcaaaatcattattatatgctttaatttatataatatattataattgctttgtaacttaacgtaagtctgacgtatcggaatacaaatcttaatacaagatcctaatagaagcctaaaaatctatagtaagtgaaataggaaaaccgaaatctagtgatgagctcgtattgatttgcgcaataccagcggggcaacaaagcgagagagagttaatatagcacaacaacacgaataagcatgcagacattggattctgcagataaagagtactccctccatactcatattagaagtcgtttaggacataattgtgcatactaaggagtgattaagtagagatattttttcatgtctgcccctaataaatagggatgtggatgcattctgtacgataagcaatcatagctcaaatggctagtgcagagatcactttctttttgcttgcaataactacgcatacgtgatgacgagcgcaacggacggcgagcgcagagccatacacgaccccgcgggcgaacgacgacatgtattgtgaaaacggaccaaaggccttagaacgacatctaatatgagtatggagggagtatacgattttcagttccgtcacatttctttattattcatagctcggctaccatgttcatatgcgttctgctgctgcctctgcacaacacatgaaccagagttcaatgtgtctaggcgagacaaagattccagcttttgtcaccgagaaatttcttgagcgatttggttggccaacgcgagagatcgattcactgcggagcaatcagcacgggatccttctttcccttgagaaagtccgagtaccaacgagcggagcgcctcgctcgccgcggccgcgcgccgtcgtcgaaatccacacggtacaggccggatcgcgactggtagccttccaggagctcgtacacgtccacaaatgaccaaacgaagtagcctctcacatcaaccccgttcctgcacaaagcagagatcaatcagaacagcatgaggcctcatgtttacgattatcagctaaaatctaaatttttaactttaaatttaaagttaaatttgggattatttttattgtatattatttttcagccttcgtttttacaccgttaagaacacatatataaaagttttattcgaggaataagccaaatgatggggctggaagatggattgaagtgaaactcatgtagtttgacacactgatactgatgtttggagatcacctgattgcatccaggacacctccaatgtagcccttgatgtaatccaccctatcagggtcgtcgagactgtcatttgtagatcccttccctgaagaaaaagaaaacaggcaagtgagaaagagtattgtgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatgaatttgatctcccgcgagaagaagaagacacacttt

SEQ ID NO: 9929 - DNA, 3797 bp, Oryza sativa
gttggctttgctgctgcactgaaaccgcatgcctttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgatgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagcaagggaaaggcaaagggagactgctttgtgtgtggcaagtctaggcattgggccaaggactgtcctgagcgcaaagacaggaagtctgccaacatgatcattagcgagggcggaggaacatcggggtacggtaaaatattacctacagttctctctgtttttcattcacttgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaagattatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaaataacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctaacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcttgatggtacaatcgaaaagtacaaggcaaggcttgtggccaagggttatacccaaaaggaaggcgaggacttcttcgacacatactcactagttgctcgcttgaccacgattcgagtactactcgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatgtcatgagaagtttgacaccacgcttacatctgcaggctttgttgtgaacgaagctgacaaatgtgtatgctatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaaggatcagctgagatactctcaaatcattggttcattgatgtacttggctagcgcaacgaggcctgacatctcatttgctgtaagcaagctgagccggtttgtctcaaatccgggagatgatcattggtaggctctggaaagagtaatgcgctatctaaagggtactatgagctatggaattcacaataccggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcattagatactgcgacagttgaggccgagtggcttcgtgaactcctgatggatttgccagtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatg

SEQ ID NO: 9930 - DNA, 10143 bp, Oryza sativa
  unsure (1)..(10143): unsure at all n locations
ctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatgaatttgatctcccgcgagaagaagaagacacattttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattatattcaccactatcactggatcaaatcctattgtaaatatcatgtttattatcttattattttggattaaaatatgccgaattatgaccaaatttccaacatattgtacttcctgttctgaatactctacttggaaactgtacttaccattctcctcgatgtaaaatgggaaatccccataggactctctcaggtactccaacgctagttgcaatccttttggatcatttggatactccgtaggttcatactgcactcaataaagagatgagatatatgtgtcactgccaacaggatgaggtacgtatatccaagagtatttcaattatgaaattatcgccgcaccaaaaaaaaattatgacaatgatcttcgagtttactttatttcttttatacgctttattgattgcatcacttaatgcaaaacattacgtgtctatcacaattcagtttttaatataagaaatgggataaccctatgagaattaggtggctttgtattaagaagaaaataggcatccaaattcgcttcgataaggacgggataacttgggtgatccaggcatacatccacaccatcgaccaactaagntaggctaagatcctatcacatttttaggaagtttttacaaaggtcgaaaatcaacaatgcttattatctcaaaagaaaaatcagagatgacaaaattaacttaccttctccgttggtggatccgttttataaactgcataacataaacatatagaactgataagctacagaatacttttactctagtaaaagtgattatgaaaaagaaaattttatcatcattaagaaagtaacttaagatacctaaatttgtactaaaatttttgttacctcgagatatacttagtacatgaagataccaaattttatacttaaaaaatatggtacctcacgtatcttctcaatgatggtaaaactacccatctgaaaatttgtagaatcattttcaggatcatcattggatgacttagtaaagtactccctccgtttcacaatgtaagtcattctaacattttctacattcatattgatgttaatgaatctaaacatatatatctagctagattcattaccattaatatgaatgtgggaaatgctagaatgacttgcattgtgaaacggaggaagtaactcgggatatgaaaatgtatttttattcttgtcatagaaatatgtcatgcattatcattttctgtgattttctttttgtctacatacgtcttcatacaccgtccttatatgaatgaatcaaactactcactcctagagctacaaatttatgaataaagcttctattatcttttttttcgaggaacaagcttctattatctaaaaaagagctaaaaaattatgttcatattaacagaaaatcagaaaattggctaacctctagcgcttactgatcgatcagcaacgtagtctcgaacaccttctaccaaagggcgatagttcacgtaggctgaatagtagtggtttattccaatgaaatctatagcacccttgattagttcagtttggacttggctgaaggatggaagacgagaatcgatagttttcttcattacttgtgggtaatctccaaataccaatgggtgcagtatcctgcaaacaagaagagttgtttatcctctaatgctgtgttcgctggagcctgttcccaaccagaacagtgcgcacggaaaacggaacaattcattagcgcgtgattaattaagtattagctattcttttttcaaaaatagatcaatatgattttttaagcaactttcgtatagaaaattttttttttaaaaaacgcaccgtttaacagtttgaaaatcatgcgcacggaaaacgagggagataagttgtgaaacctgggataagaacacagcgtaagttcaacggtgagcttatatatattcctgtctatgtcaaatatctattatccattacaaagagggagctaaaaggaaccactaggttcatttctaaaaattgctacgttaactgggaaaaaaagagaaagatgtgcaccgattgattttggtgggtttatattataatagtgttgctttatcaatacaattgtataaaaatacaggcatttatatatgaaaatggaagcaagagtcgtaaacttctataaaatctagctttgtgcaaaattgtgcagtccgctagtttcagtgtgaagataaaagagttgcaacattgatcataccatccgtacgagaaatccttgtatctttgagctgcttgcaaatccgcaatggagtttgttaatggataactcctaaggaaaacatgtttataccaacaatccccttttgtagagcctacatgaaagacagtttcagagcacttcgaggaattcacataagaggagtaacagcaagaaaataagaagggaatctggacatgcatgtagttatttttgtaaaaaaaaaatcatacactacatctttgaacataatctgtttaacttctatcagacctatgcaatgcttagtactgtccctagagaatataaatacattcaaaaaatacactactggtattcttaagcacatgattactcacttgatatttttctctgtacagtctaacaacagccgcatgtgttagtatcatattatgagctgttatatatggttccacggtggagttccccactgtacattcggtcaatccaaaaggatcagagcaatgtcctggagataatactcctgtgtcgtaacctccaagtgcagcgatattaggttcagccaaagtagtccaatgcaaaaccctgtccccaaactccctgaagcacacatctgcataagcagtgaaatcatccctgcattgtgccattgctactgatcagcagtctagagctcatcctatggaagctatcaccatactcctactatttttgtacttcatatagatggttattgaatcttacacaattctagggcttagccatccatcgtactcgtcttccagagcttgtgggagatctagatggcaaagcatgatatggggttgaattcctgaagaaagcagagcaatcaacatccatgaaagttctttcagttctttttcgctttgcaatatttatagtttgtaaaagggattcgcaagatttacctcgttttgctagctcatcaataacattattgtagtactttagcccttcttggttgacagctcccctcccatctgcatattaagtatacatattacactagtagtaactttattaacaagaatttagttttgagtagaaatagctatacttgggataagccttgaccaggagatggaaaacttgtaagcctctaggccagtttcagccatgagcttgacatcaccctgaaaaaggaaggcatgtaaagttcttacaagccgaagttttcaacttaggcattgtttagttcacgaaaagaaaatttttgggtgtcacatcggatgtttgactagaagtcagaaggggtttttggacacgaatgaaaaaactaatttcatagctcgcctggaaaccgcgagacgaatttattaaacctaattaatccgtcattagcatatgtgggttaccgtaatacttatgactaatcatagattaggctcaaaagattcatctcacaattttcgtgtgaactgtgcaattagttttttatctatatttaaagctccattagggtgttcaaggatttgatgtgatgtttttgagaaaaatttttgggaactaaattaggccttatgttttgatgaaggaaaggagaaaaaactaagatgataattctcatttcgatttggtgaagcattagggatggaacttaaggaaccatgtttctatctttagtcggttgtcaggaatagaactttgaagatacatgaatttgctacaatagtgaggcgcgttcacatgtctgtaagacatgaaacacatagagagacaatatgtggacaagccaatagcggcctgatggcctcatctttttgtttatacttatgcttatcagctaaattttaaaattttcaaccttaaaggctcctttgatttagaggaaagacatgggaattttggaggatttcttttttttttgcggggaaaattttggaggatttcgattctatagtaaaattttctataaagacctttgaaacaaatgattgaattttatgttatcgtttgaaattcctatggaacggataatcctatagagattttagagaaaatttagtaagagctccaaccttttgaaaatttatctttgagtctatctctctcatccaattcctacgtttttcttgcggtccaatcaaatggtccttcctgtgttttttctgtattttgtaattatctgttttgcacttacattcctattagaatcatgcatttttcctattcatctatttttgcattcttatgattcaaatgggccctaaatttggagttgtttttgcgttggcgaaaaataagttgatttgggttttttttatcgtagtttattttttaatctttgcttttaaatcgttaagaacacgtatataaaatttttattaacaaattattttttatttgcaaatatgacgtgctgctagtttctctctgagaaatttaaccgtgtaccttgtacttgtggtacccatctgcagcaacatcgcctgtacctttgtctttcgttttccctgattgcacaaacaaaaatggcaaaatttgctacaggacaccgaaagattgcggtctttgctatgagatacccgaagatcgtgtatttgctcatggacactaaaaaaagtggtaattaactgctggacacttcttccattattttattatttccgatcaaaatggagagagaaactttggttaaagacaagtttgcccatgggcccacttgtcaatctctttctttgtccttcttcttcctctctttgtctgttcttcttcatcgtgaggggatgtgatgggcagcggcgcacgggggcgggccggcggtcgacgcgcagggaggtggaagggatgggggagaggtgggcgccggcgtgcatcgcggagaggcgggccgtcgtggcgccggccggcagcaccttgaggacgacagcgtgaggccgcggcggcggtggtccaggcggagcaagctctctgccgctggggcgggggatggcggtcgcgacagcgagaaaggggaatgcgcgaggagtcagccgcccgggcgagctctgatcctccgagagattcccgcagtgacgacgatggtgggtagcgttgggaacggcctggtcgcatggaagcggagctcgcctggcggcggtcggctgaggcagagctcgtggtggctgaggaggatacggaccgagcgggcggcgacggaggcagcggccggcgccacgacggccgacctctccgccatggtcgccggcgcccgcctctcccccatcccctccacctccccgcgcgccgtcgtgcacgccgaccgccggcccgctgtcgccaccatctgaagcttcctgtccgccgcgccccctccgtgccgctcccgccgccgcctggagcgccctcccatccgcgcccgccgccgctcgccgtcgatcggttcccctccgctgccgtcgcgaggaagaatgggaaaagaaaagaagagagagagaggaagaacagtacgtgtccagggcattttggtacttacacagctctctctctccgttttgaccagaaataataaaataatgggagaagtgtcctgcagctagttaccacttttttgtagtgtccatgagcaaatacacgatcttcgggtgtctcacagcaaaggccgcaatctttcggtgtcctgtagcaaattttgccaataaaaatattgtcactattcacttattagtaccactggctctatctgtcaccaatgacatgtggccatcgaaggtcaaccacgtatgggtcaagaaggtaaattctcaatttttatctaaacgaagatcaaatttacactctttaaaaatctaaattcagataaataatattataatgtatcacatttcatactaggattattttttatggaatggatggagtatatgactatgagcatgaacagatgatgaatagcacaagttgcacaacagcaacccaaaaaaaaaaactgaccttcatgtgcgaacgtgtcccagatagtagggctcctgccatcctctgcagcagcgccgtcatactgcacacgcacaacaaaggcacgcactgttcagaaaaccgggtaagggaaattcggttcagacaaatcttcagttcgtcacctgatatgccgaggtggcggctccaaagacgaaatcccgaggaaaatcgcttctcgtgtagccacagcaccaccttgaacagagaggaacagcaggacgaagaagaagccagcagcagcagcagcgcccatgatgatcagcaagaaaaaaagaatgagaagcagattcgagcgacgattgtgtttctgcagagagatcagagatgtttgtgatccagcccgggaagacaatattaagacgtccataatactatcagttggtagttgcctagttggtgctagacgatggttggtccagcgcgattgcagcgatggcgaggcggtggcacggacgtctcaccgatttgcggcgatggcacgggcgtctcaccgaggtaaacgagcattgaaaaaagaacgtaaatattagggaagaatctaatatcaaataattagaaggggtgagatttcgaatccaaatcatctagcccactaccttttggagttagccgaaaaactcctgagcgtttctcaggtaaacgagcattgcgcaagctggtcgtgctccaagcacttgctgtgcacaggagggacaggccggtttacagccgaattactaagctttgattggtggctcatttcgttcctggatcgttgcaaattggtctgctggatggcagtgttcggtagggaaacacgtcctttacaatactaatcctctagttttaagctgttgatatatgagcttataaccaacagatctatatgtcaatgatccaagttgaagaatattactgtactgcagactcattcgatcggtagttgagcaaatttgttaaatctttgtctctggtgtgagtgaaattttggttcggttgtgtgtttaggcttcagctgttggttggatgatgatacggctgcacgttcgtttctgatacagtgatgacaactggagtagggattctgtctctattacctattgattggatgatagcgattacaacttaacttctgagttctgacacaatagtttttcgtttcgtagttccttttacacactagagctgtgtaattaattgaagaatcatcgtactaattaacgcttgtcattcagcatttcagcaccatgttttattttgagaaaattctccttgtacccttgtatccatgaattttactcattctctagttttagtttagattttttatcatatttttttcgttagttgaccgttaaatttctataaaaaaaccattttgtcctttggtgtaactcaaacatataaaattatagaatatattgttggagggtaaaaatttgttatataagactcttatatatgtgagtttgttgtgcgagatattatttatcataaaatttatttacagatatgacataaaaaataatattaatttatttgttatcaaattattttactgtagcgtataaatagattcaaatatgttgtactactatagaaaataagctacatatacaattttaaatattaaaaataaatataaatcttttatgtcatatctgaaaataatttttttataaataatatttcacattagaaactcatggatataaaagtctcatacaacaaatttctatactccaaaaatttatatatttttcataccataaggtacaatggattttttttcataagaattggtcaactattggaaatggtatggaaggatctaaattaaaattcaaatgtatacaagggaattagcaaaattcagtgacatagaaggaattagacaaagtttcagggatatatacgaaattttctcttattttagttgggcttctaagtgatattgaaagtcattgtatctattatgtgaactgaagcacacaagtaatgaatttgaccctttccttattaaaaaaaagtatgcaatatatgacatctttgccatacaatttgataaaaaattatataattattatttatttttttattaaatagacttaagatgtatttgatttgtagtcaagaatggatgggctatagctatttatatttttagggataaggtatggtggttaattttttgtttggttgaatggacagtataatccagtttcttatttgattagatggatgagcatggatagaataaaaacaacgaaaaattgtataaaccaccataattattatccttattttaagattatgcccataacctattttgtttttaaaaaaacccacccacctcaacatcgcttgtcaaaaattgcgccctccgcgtgtgttagtagctcattcagcccatttcatccgatatggatttgcaaccagccatatcagccaagttcaactcgttcttaagctatttctcaacttaagattgagtgaagggtttatttgctatgaactagtagaaaaaaacatcattctttaactgagaactagctcaaattagactcacccaatacaatatttagataatgagtaatactacttcctccatttcaggttataagatattttgactttggtcaaagtcaaactatttcaaatttaactaagtttatagacaaatataatca

SEQ ID NO: 9931 - DNA, 4210 bp, Oryza sativa
cagtttgattttgaccaaattcaaaacgcattataacctaaaacgaatggagtactaatgttttgtatcttcggattctataccataacacgcatgatcttcgagaaggctaacgcgcgatcaatcgcggccagcgatcgggtttttttttcttttcctcttttagtaaatctatacacctaaagtttataaagcaaatgtttataagtcaaaagtttatatacccaattcaaatttaaattcaaattcaaatattttatattttcctcttttagtaagtttatgcacctaaagtttacacatctaaagtttatccacctaaagtttgtagagcaaatatttataagtcaaaagtttatatacccgattcaaattcaaattcggattcaaatattttatatataaaatatttttatacataaagtttatgcgtgcaaagtttatggtataaagtctatgcacataaatgagactattagatttttttttctaattttttttactaactttgtgtttttttttaattttgtgatggaaggaaaaaaatagagaggtgtatagggggaggggtgggttgatcgctcccccattagatcccccgtgatcttagtgctcttatcaatgttaggcaaaacatgatttcctgtcaccgagcacgagcaatttcttgatcaaccaatccgtgcatcctcttttttttttgagatttggagggagacgtttctccaaacaacttttaaaaagaaattataaacgtgttgacgattaaacacaagacctcataattaaaaccatatccccttgccaccactagtgcatcctcctcaaagatcgcagcgacagcgagaccgttgcgtgaaacctcactgctgagcaatctgcagcggttgccgcttgctcttgaggaagtcacggtaccagcgagcagaacgcttcgctcgccgcggcagcgccgcgtcgtcgaaatccacgcggtagaggccgtatcgcgtctggtatccggacaagagctcgaacatgtccacgaagaaccaagcgaagtagcctctcgcattaaccccgttcctgcatatgcacgcacagcaaagcaaaatcaatcagaacatgtatcatcagacaataggtcttattcaagaatcaagatggtggattgagcatttgagctgaaccatccggcgtctgaaattttaattttcatgtggttttgggctctgagttttggatcacctggtcgcattcaggacgccctctatgtagccctttatgtaatccaccctgtcagtgtcgtcgagactgtcattgctagatgccttccctgaaaaaacaggaaggagatcgagctttaaccttgaaggcagcaaacttgctcacagcgaattattcattagtcaagagattcttaattagcaggtgatctactaggatgaattgactccataaaactaagtgagaaacagtatgtgctgctcgttctgattactctacgggaaacagaaactgtactttccattctcctggacataaattggcaagtcaccataggactctttcaggtgctgtagcattagttgtaatccgtgtggatcacccatagaccgcgttggggcttgctgcagccaataaagagaggagatatatgagtgatgagtcactgccaacaggacgaaccacataattccaagagtgtcttagtaatgatattcgaatttactttatttttgtccctcgctttatctttaaaagaataatggataagagcataaatagtggttttagaccgttactgtctaatttttttcatgtcagatttagatgacatatatatacaaccgatacaatgatgtttagttttctataatagatctgtataatcaattatttcaccctatagatgacatgtataataattatatagcattaatctctggcctcgttttgatgaagccatgtaaatatcaatctgtatttttttcaccctattctatccatatatacgaggcaaagtttttgccctcttttaaaaatatatatatatagcattaagccgtatattagacttaatcaacagacggcatacttctatatcttttccacgtcacaaaaagaaaaatcctatgtagcatcttctcctagaatgtgacgccaccattgtttgtgcaataaaccttaccccttgcaataaaccttaacctaccacctttcctgtttatcataaaccttaccccttgcaataaaccttaacctaaagtcaaaaggcaacaatgtatctcaataaccttactgatgaccaaattaacttacctgccccgacgatggatccgttttagaagctgcataagaaaacaccgagaaacaaatgataagctatacagtacatctaataacttgtagaatcatcttcagaatcatcattggatgactttacaaagttattcagcatatatgaaaaagataatctatcatcacatcataaaagatatgacgtgcattatcattttgttttgatttattttcttttgtctaccttcatcttcatgggccgtccctataaaggaatcaagctacacactcctaggctacaaatttatgtgcataattaaatagaaaactggccaacctctgcagcttactgatcgatcagcaatgaagtctcgaactccttttgccaaagggagatcgctcacatagagagaaaagtagtgatttactccaatgaaatctagagtacccttgactagttcagtttggactttgctgaaggatggaagacgagaaccgatagctttcttcattacttgtgggtaatctccaaataccaatgggtgcagtatcctacaaacaagagtagttgtttatcctctaagttcaacggtgagcttatattcatgtctatgtcaaatatctagtatccattacaaagagggagctaaaaggaaccactaggttcatttctagaaattgctacgttaacttgggaaaaaaaagagagaaaatctagcttcgtgtaaaattgtgcagtccgctagttcagtgtgaagataaagagttacaacatcgatcataccatccgtacgtgaaatccttgtatctttgagctgcttgcagatccgcagtggagtctgttaatggataactccacaaggaaagaacgtttataccaacaatccccttttgcagagtctacatgaaagaaagttgcaaaacactttgagaaatttagataagaggaataataggaagaaaataagaaaataagaggaataataaaataaatcctttcaacttttttaggattgcacttaatgacttaaaacacacacatactctcacaaatgcggccctttgaaaagctcacactagaggcaaatatctgacctcactaaaaatcgtattgatagcatacttgcttagtgtcttaggccccgttcgatctccagttttgaagatggatttttatggcacgcaaaacgagaaacctcgttagcacatgattaattaagtattgactattataaatttaaaaaatggatttatatggttttttaacaacttctatatagattttttttaaaaaaaaataacgcactaaccctaacaaatcctagattctcccttaacttctaggattggcttaccagaagattggccaataatgcacaatttaacaatttgaaaagcatgctaacgaaaaacgaggaagttgaagtttggagttgaagaatggaactgagccttggtattgattgcggagaatataagtgcggttagaaatacacactaccgataattttaagcacattattacttacttgatatttttctctgtacagtctaacaacagctgcatgtgttagtatcatattgtgagctgctacatatggttccacactggaattccccactgtacatttggtcactccaaaaggatcagagcaacgtcctggagcgaattctcctgtgtcataacctccaagtgcagcgacattaggttcagccaaaatagtccagtgcgaaactctatcaccaaattccctgaagcacacatccgcataagcagtaaaatcctccctgcattgtgccattgttactgatcagcagtccagaattgatctactccaactagttgtaagcttcaagtataatcactaccagtatagtcatatatatatatagatggttcctgaatcttacacaattctagggcttaacc

SEQ ID NO: 9932 - DNA, 3499 bp, Oryza sativa
caactaagcaacaaggaactacttctttgttaacaagagttaaattttgagtagaaatggctgtacttgggataagccttgaccaggagatggaaaacctatatgcctctaggccagtttcagtcatgagcttgacatcaccctaaaaaatcaggcaagcaaaattattacaagccaaagttctcaacttaggctgtgtttagttgtaaaatttttcttcaaacttccaacttttccatcacatcaaaactttcctacacacacaaacttctaaattttctgtcacatcgttccaattttaaccaaatttccaaatttggtgtgaactaaacacaaccttaagttctaccagaaagaagaaaaaggtgaaacattcaaagtggaactcgaggaaccttgttcctatgtttagttccttcttcaggaaaaatattgcaaaaacacaacattttgctacaatggcgagactcattcacatgtaagcaagacaaggaaaatatataaaagggcaatcttccgaagtcaaacctagcttctactccacctaagaaattaaatcgtgtaccttgtatttgtggtacccatctgaggcaacatcgcctgtacttttgtccttcattttccctgattgcacatatgaaaatactgtcactattcagttttagtgccactatttatttatgcttatcagccaaaatttgaattttcatccttaaatttgaagttgattttggggttttttcgttgaagtttatttttcagcatttgcttttagaatggtacgtgatcctggttagctcgattgtgtatttgtgtatgagcatgaagcagccatgaaaagatgatgaacaacaacagtgtcccacgcccgcgcgtgtgactgtgttcagcacttcagcttccagggagcaaaaacgactgacctgcatgagtgaacgtgtcccagatgctagcgcccctgccatcctctgcggcagcgccctcatactgccgcatgcacaacaaaaggcacagcgaaaaaaactcaaagctcgcagaaaaccaaccgagcaaagcaaaaattcagttgagatagaatcatagccgttacctggtacgccgaggtggcggctccaaagacgaaatcagcagggaaatcattcctcgtgtagccaccgagaacgccgtgctgcacggagatgaacagcagggcgcagaagaaggcagcagcagcggccatgggcaagagaaagaagagaagcaggggcagggctgctggttggttggttcgaactggattgtgtttttgtgcagagaaatccgtgtgatccagttggggaagacgataagacgtcctcagcaactggcacgcccaagttgggactaccagcgcatgttcacgtcgtcctgacgagtgaacaaccgactcgctgaggcagacgagcattcattctgcccctctgttctctatgtcgggggcagtggcacggacgccgatcgagctgccgttcgggttcggcagcgaaacctggtttcgtttcgagtttcagtgaaaaactcagagatttgcgcaatccgatcgtgcttactactactagtactgatttgctgtgactaaatgctttggtaaatcctcctttgaaaaaaaatgctttttaaaatttagggcacttaccatgtaagccactcctagcaatatcctcatgtgggtcatatgggctaaggcacccaatgaaaagtactccaaccagccctaccaaatctgaggcaacaaggtagagataatctagcccacaacggtcctatcctagcccacgaagccacatgtatgtttttcctcccctacccctagctattttctcagcccatccactgatcatccacttctcccctctttttttcttcgccgcccgtctctctctcacctacctctcgctcgtcgctctccctctgcccgtcgccatcgctgacttccccacctcgtgccgctgccgtccaccactccggcgatcagatctctccgctttgcgccgtctccagttccattccactacgatgctgctaactccgccccaccacggcgccgtcgactctaccccaccgctcctgccgccggacggctccgcccaaccgcgacgcctccatatccgccccatcgcgcccgccgccagctctgaccaccgcgactcccgcgcccacctccggctccgaccaccgcaatgccttcgattctgccccaccgcgcccactgctaactccgaccgccatgacacctctggttctaccttgcatccgtcgcctgctccgcctcaccatgccgaggtgagaggggcaagaagggaaaatatagagaaaggaggtgaggaacggggcaccactcgagccgtgtctcaaaagagtagtcgaggagccagaggggcgcgttcccctgttggggtcacgcgttccttcaggagcatgactcatagacggaacggtgacgctgtgagcgaagctactagctggagttacccattgcatatgctctcacaacgtagaggtgcggtcacagagacagtcacagccgacaatccgacatgcacaacgaggcagattcttgagaaaaaataatgagtacagtaagaagagagaagggcagaggaaaatgcggcatcagaccgttactcaatcgcagcaaatcaatccaccatccatccacgtcgcgacgcgtccaactccatccaactcgactcgacgccgacgccgacgacgaggaaagcaacaaccaaaagcttgccgttaaaaaactccaaagttaatccccaaaaaaagaaggaaaaaaaaaacacccgacccgtcggctcccaggcagccactaatcccaaacgccctttttttttcttttctgtttttttttcgcgtcgcctttccttctcccattcctcctctctccagagactcgccgtcgccgcagccattcccatttttgcccactcctcctcctcctctccagtaaaccctagcccacccaacctccaatccccccccaaccagcgcccgaatcgcagccccgcgaggccccaatcgagctagggttcaccgatttcgggggccgagccagcgaaggctctcagttttcgctgcgatttgtggggtgaaattttcggggggattttgatttctttctctcacggtgggggatggggagccggagggaggaggagaggaacgagaagatcatccgtgggctcatgaagctgccgcccaatcgcaagtgcatcaattgcaacagtgtggtaataatctcctccgcctcctgcttgcgtttgttgctgagaagcttgattggtggttcatttcgttcccggatcgttgcatggtagagcgtggaattggtctgctgggttgtagtgttctgcagttagcgcagatttatgaaatccatttgtctctggtgtgaacttttggttcgtccgtatgtttaagcttcaatgttggttggatgatgatagggcggctcgttcgtttctgatacagggat

SEQ ID NO: 9933 - DNA, 978 bp, Oryza sativa
tgatatctagtcgctaagttggctgaaatatgagccgctgaacttttaatactctactccctccatcccacaaaatttcaaaccctagcattccaagatgaaattaaggaggaaggcaaaataccaaaatgtccctaattaataggaaagttgtattgatggatgggtaggtgaggggtatttaaaggataaaatttcttgatttgcgaactggtggtaggtaagaagatagaaattggtttattttgggacaaaattcaaacatagaagttgatttatttggggacggagggagtacatgtcagcaagtgcctccgcaacagtgtggtaatactcccaagtgcctctgaaattgtttaacaattgtttgtgccctatttttgcaatggttcacaaaatatgaccagcggttcagcaccatgttttcttttagttgcacttctaagtgaactcagatgtcattgtatttattatgttaactgaagcacataattgttttgttgcaggggccacaatatgtatgtaccaatttctggaccttcatatgcttgtcatgcagtggaatacagtaagtattttgttccatttatcttgtcgtacatgccaatttctggtcctcagctgatttccttcttcgttctagtttagagttaatgaaggtctattcagcttttgctcatgcaagaaaatttgtgttcacttatctattgagcaatgatacttgcaagaagatgtgtgttgtggtatctgatgctaagaatgtatggcatggggaaatataaagcattatttatggtccatttcttacaaatagttcacaatctaatatcacagattcacagttgtttattcagctaatgtcactccatatatggaattttctatttcattatttgcgactccgtggcatgtttagctcaaggatttcgattatcctaggatgggttggcccatcataatgttaacccattccatagt

SEQ ID NO: 9934 - DNA, 6603 bp, Oryza sativa
  unsure (1)..(6603): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcggtgggagtgattggacggagcaagggatataagcttggcgggggcatgagcggaacaagaggagcaacgagggtatagtaggcagcgagcgccggaagggattcacgagagcagtagcgaaccttcttggtggagcggcggcagagcgaccttgatgacgagagcctttctctccccctctctcttttggtcatttttgttttatttttctacatttacccatcattaatacaccaaagttattgtacaggataaactcaaattgataattattttttttaaaaaaaactcgctgaatttagatgaattacttcgtaaactgctcgtaccatgaattttagatggattttcacagtgaaaaaaaatgataacaatgttaagcttatctaaatggaaggacatttcttccacaagttctagctggtaatcacctcaatcttaaaagagtaccatacgtaagatccatccaaataatcaaacaaaatctcttctaaactgttctccagtacaatcaatcaaaaaaaaaatcacatgttagctaggctgcgcccaatgcaaacaaccaaatatttgcacgcatatccttttaaacaggccaaactcaatctagatgtaagagacatactactatcagactagaatgtgagcaaccaaacacacatttagccctcgaccgagtaactttcatgcatgccgtatttcaaatttgcaacctattcattcaagtcgttttcatccggaaattaacgtgccaactcacttctcttctctccctcaacccatctttactccgctctcttttgttttaggactcgaaacacacgtgaaacgatgaatcaaatgatcattgtatataccgcatggagtactcgtatatactaccgcgtgaggttgtgaatctgtcagcatccgcggtacggggagtgctggtcgtggttgtcctgtgacctgaggcgcgcctgcatcctgccgctctctgtcgccgtgttgcaaacttgcaacgatctctggcatgcatgaccaatttgaccgtatacagacataatctctccgtccctaaaaaaaaaccctgagtttccgtgtctaatgtttgactgtcttttcgtgtctaacgtttgactgtctgtcttatatgaaatttttttataattagcatttttattattgttagatgataaaacatgattaatactttatacgtgacttgtctttttaattttttcataatttttttaaataagatggacggttaaatattggacacgaaaaattagggttttttttttttttgacagagtacagtaggactatatgccagtggccagaccgccggtaagcacaccggcaaaaccactaacccgccgctgatccgaccacagtaatgaggaggaatctggtggctgacctgacggctagattaccggtggtactttagggaaatctgaacatcggaagcgccaccaaccgcgtccaagtacagtacagtagtatagccgtatagtagtagcacgtgatccatccccatccaacaagctaaaatcgtggtagaaactcgatttttatttttaaaaggtttcaagtttcaaatggttagaccagaacttcagttaaacggctgcttcaatagagtacagcattctgtagttgctttcaggtagtactagtagatagtagagtgctcaatagtggtggccgcgacacaatttttagggggtgtttagatggggctaaaactttttagcgcatgtcacatcggatgtttaggcgctaatttaaagtattaaacatagactaataaaaaaactaatttcataaatgagagctaatccgcgagacgatttttttaagcctaattaatctataattatcaaaagtttactgtagcatcacattgttaaaatcatggcgtaattagactcaaaagattcgtctcgcgaattagtccaagtttatggaatgggttttgtaattagtgtatgtttaatactctaaattagtgtccaaacatccgatgtgacatggagttggaataaggccctgtttgtttcagcttaagattattgtaatctaaattattaaatcagattactctaaactggattataataagctgacatagaataagctgcgagctgtttgtttctctggattattgaaggcatctaagggtagtgggtctttagccacccaataatctgaaaaaagctccttcagaggagattattagattatagtaatctggcttatagattataataatctatcgtaataatctacttatttatttcagcttactcttaataatccagattataataatcttaagctgaattaaacaggcctaattccctgaaaaacaaacagcccctaatagacgaattccgagtccggtgtgaccggcgtgtgcgtttgctgacctcgcgatctccgctaccaccaccagactccccaacaaacacgcacgcgcgcacacactgtcgcacctacttcatccccgaccccgctgcctaaaatccacctccccatcctgcaccaaaccaaacccccgcgacccacacccaaacccgccaccgattccgagcgcgccgcggcgagcgagcgggagagaggggggtcgcaagcgcagcttcctccccggccatggatctcctgcacggggagagcgtccagaccacggtggccatcgccgtcgccgtcgtcgcggtcgccgcgggcggcgccttcctcctcctccggtccaggaagcccaagggtatgtattggctccgtgcatctgtcccctctgatagtccgatgttgtgagtttgtgatgtggcggctctcgcgcgtgatctgatctgcttctccggggttccagattagtcctggttggttctcatcatcactctctgtgtgtgtggtttgagttctgaatcgctttacgaatgcccatcttctggccttcctcgcaaccagactgacaaagattcaacggagcagcgaactgtaggctgccacactgtgctgtatcgttgctgtttcattgtctatagttatctttcagtagttgtttgtgcagttttggtattcatgctactttcctttattgatggttggtgccatttatttttccctcctcaggctgtttggatcctgagaacttcaagaagtttaaacttgtggaaaagaagcaaataagtcataacgtggccagattcaaatttgctcttccaactccaacctctgtattgggccttccaattggtcagcatatcagttgcaggtttggattccgccttatgcctttctttatgaagtttgctacccttttttttttacataaattggaaaaatgtatgtgctattcttttagaggacaagatgctacaggcgaagaagtaatcaaaccttatacccctactacattggattctgatctagggcattttgagcttgttattaaggtaaattgtattcagttctttatactgtatgaatgcttgtttgtcaatcctggaacatatcgttatgtgccacacaagcaggatttgccatttaacttttctcataatgcagatgtaccctcaaggaagaatgtcacaccatttccgtgaaatgaaagttggtgattatatgtctgtgaagggacctaaggttgttttctttctgttccaagcaacttgtgttaagtctataatgggtgtttattgactctgaaagagttttgtgttatctattatgctttagccagcatttatgtgcttacatttattgattaggtgacattcacaattgaattgggtgctcatttgtctttggtttatgagtttaacatggtttcttctctgttctagggtcgtttcagataccaagttgggcaagtgagagcttttggaatgctagctggtggatcaggcatcactcccatgttccaagtaacatatatgcctccaaagttctatgttgcagttaatgttgctgcaagcgggtcacttagtagttagtactgacaaacattttttttatgttctcacaggttgcaagggcaattcttgagaaccctaatgatatcacaaaagttcatttagtctatgcaaatgtcacgcatgacgacattcttctgaaggtggaatcacttctttgttatttgttaagactctctttttgctgcctctacaatatatctatgatacaattttgtggtctttctgactgttagcatcgccccatcagatttcagatttactgtgccatcatgtgatttaattgacttttgtgccatatattcactagtggacaccatgcacatacacatttcatttagttgccaatgacagctggtgaaatttcaagtattgtttatgataactgttaactggtttgtttcttcaaatgcaaaactcatgcaacttgtactgcatgaaagtggaataatttatacatagtactttgtagctgagatattttacaatttctttatgtaatgtcaaagcttctataaatgatatatgaatgggagagtcggaataatccagcacagctgcatgtgcttgagcaaagaatttattctattaatattgcaagaaagttctctattcattatacatgtcgaaatatttttgaggttgcaataatagtttatgccactatgcatgttatctgtaaccaattaggatgattggtgactgcatatgttctgctatttactgcagtcccaaatttatgtgtgttgaatctgtgcaggaagaactggacaacatggccaaaacctaccctgatcgctttaagatctactatgtcttgaatcaggtgaaccctatgcttctattattttacaagatttgtgtatcaacatcagtactctagatacatatcaatagctttgctggacacagtggtctccaggattccacgttcgccatttctcttgaatatttttgggagtcgttgctgaatttatgttatgaattgtctgattggaacaagggatgggttgtttatccattagccatagtaccctacaatggtgagataattgaaaaagatttcacataaaaatatttaaagattcctggatgatattaaaataattaaggagcgtttttttttctttggataagagcatgctcttagttgcatttgctttagtatttgtgttttttctgcttgaaataaaattatgctataaaatcgtagtcccaaatgtatattaggaattacgacatgcatggtacttgataaagacatttgcagcagattccaatgttgattttttgcttgtgcagcctcctgaagtctggaacggtggcgttgggtttgtgtcacaggacatgattaaagctcatttgccagcacctgccgaggacattcaagtaaaactcaaatcttcattttcggaacctcttgtttagaaagaagtttttgctttctgtatggtgtctcaacctggacacttacatataatatgtgtttaattgttccagatcttgaggtgtggtcctcctccgatgaacaaggcaatggctgcgcaccttgatgagctcgggtacaccaaggagatgcagttccagttctaagctctcctaatggcggagtaccagaataatggaccccatggcctacgctgtcttacgctctcttgtgtcatggagacgtcgtctgacctcttttgttagttgatagcaatacatgattagtcgtgacccaacaattcatgtatcactccatttttatgggcaaatgttatctgcaattggcagaagccctgtgactgccatctggtttacaaactgaacattggatgctgcaccgcggggaaactattcaatccctcgaggggatgttctctcgtttgctcaaaaaccatctaaacggttatgaaaaattctgaaaaaatttgacaacattcatacaacatatatatacaactccacaaaatcttaagtccaaacttaactcacacgtcgagatataaaaaagacaaattcagcgtatgaatagtagcgtactatttatatctaaatttgtcttttttgtttcttgatgtgtagatcgaatttgaacatgaattttggtggactagtaggtatcattatactctacattgttaatttttttcataatttttcacaactatttgcatcgaatttagaaaaaaaaggtatacgaggaaatatcccctcgaaggattagaatctacactcctgcaccgcgtactagtgcgtacacagggtatcaaatgtcaccatttgagaaagaactgta

SEQ ID NO: 9935 - DNA, 1622 bp, Oryza sativa
ctttgataacggattatatgaaaaatttagttgcaaatataaaagtacctcaaaactgtatggaattcttgtgttccaagcatttcgatttgctcctctcttctcttccgagctgctcgactttactagagctaatgaaggcatgccaaatttgacatcatggtgacatttagaacataaaatagattttacaaaaagtccaatttgaatttagatggtactccattagttacaaaatagtataagaatttttcatcacatccaaccaaaatcctttatattttgggacgggtagaaggagtgtaaagcatttctggaaggagggagtataagcatttctagaaattacaactggagtataaacatttcatgaaacttcgagtactactccctctatcctataatataaaggattttgaaacgatgtgatatattataatactataatgtgttatatttatctaaaattctttatattatggaacggaggcaagagggagtaccatctaggagtacaggtcatatcgggtaaattgcatctgcaagggctggatggccggagacccgatagcccattccccatttcccttatccggaaacagcctttgctttccccctccctaaaaccccccgcagcggcgcagcgccacctctcctcctcagccgaagcgtcggggccatggccatggcgatggcgtcgccgcccgcttgcccattcctcctctcgctctcggccggcgccaccgccatttccaccgtgtccgccgcctacggttccgtttccgccccgcgcgcgcctctcttcctcctcgcctccccgcgtcccgtcccgcctcgccgacccctcgccgcgggctcctcatctcccaaggccgcggcacccgccgccgtcgagatccccgaggagtacgtggacgatgttgatgcggtgaacattgcgcaggacgtcacccaggtgcatggccgcttccccatccacgcatatgctccatttttttgctttaacatgggaatgggtttccatctaaaacagtacagtgaaattggttaaggtcactaggatcatctcgtttagcttccagtattgtggtggttgagtctgtgaggtactggaattccatggtaaattttggtatttttctgtaagctcgcaatgggcatgggggataaatgataattggcttagatctcattttttgttctggctaggacaaactcacaatgggcatgaagtataattggttagatctcattttgttattctacccatgagcatgaccactcccacttctgatcaaacatttacttgttaatcagctgattgggaaaaccccaatggtgtatctgaataatgttgtcgacggatgtgttgctaatatcgctgcaaaacttgagtacatgggaccttgcaggagcgtcaaagacaggtatgtttttgtcatttgtgtattcttttctgccagtgccacctctcattcatgtcttttcaggattggattaagcatgattaatgatgctgaagagaaaggattaatttttccaaacaaggttagattatcctgatagtatttgcaatactaccatcatgaagattctaacttgtgcatatacttctacctatg

SEQ ID NO: 9936 - DNA, 2936 bp, Oryza sativa
tattgagaagccacttggtaattacagatccactttcaaaccacaggcccagaaatatgggaagacaccttgggtactgttgacatactagttgcaagcattggcacaggtggcaccattacaggcactgggcgttatctgaaaatgatgaacaaagatattaaggtccgtactcttgtcttcattaagctcttattctatctttgaagaaaactgggatatgttgtgtccaaatgacaagtgctgcaacttccattttcactaggtctgcatgaaataaagaatatgccattctcatccctagtaactttatcagaattttcggagatatttggagtggaaatggaatttgaaacacatgccgtttacacatgatacatgaccacaactgtgtcagaatgattatcttattttgttctaaactaagatatacttttccaccaaattcagtcattcagcgatgttgctttagaatttattctgttatcattgttactcactaactggttgatggtaccaattactccttaatttaactttggaagtgcttgtgtgctcttccaaaaagtgaaaaacacagcttctaaagaaatttatgtcttagttgcagaaactcaccacatgtgttaaatatctgtactattcaatgatttgaggacaacaaagcagggaaatcctttgatcttattataccttttttgtaaattacttgttggacaattggtttcctcaaccacagagatttccattaggttaatatcaatatatctttgttttaaattcacttatgtgtttggcactgccctttaattatcaggttattggggtagaacctgctgaaactagtgtaatctctggtgataatgctggtaagttcaataaccccattccaatttagcaatcaacatatttgggaattgagcatattaagagtatattccttggcattgacatccttttggttgatgtcaattaaaacaggttatattccaagcatattagatgttcagctgcttgatgaagttgtgaaggtccgcaatggcaactttaattgtccttttatttttgaaaaaaaatgttgacagttgacagttcctgcagtgacttaattatgattttgaaaaatgcaggttaccaccacagaggcagtcgatgttgcaagggaacttgcactaaaagagggcctgctggtgagctgctgcacattaaaccctgttattttcagctactttatcagattattgtcgccgattatttgctacaggcctctaaaaatacgttctctaaaaaagctttattctacatttctactgcattgcttatatcgcttgttctaagctatttgttaagtttatcatcaaaacatttaatttatatatctataattgtgtagataatccactacaataatccggtcaataatctatttcaaactgggcctaaatgtattaactttggagttattattgattcgatattatcttgatgtcagcatcttcctcaaattgccatatatgtgatacataacttgttatggggattattttacaggttggcatttcgtcaggtgctgccacagttgctgctattaacgtcgctaaaagacctgaaaatgctggaaaattgattgcggtgagagcttttatctattaaaagatgttgcagcttagtgaagtttgttcatttgtatcacaatgatcttattataatcaactcagatggttaataaataatgaatttgcaggttattttccccagctttggagaaagatatatctctagcattttattccgtccgatatatgactcggtccgaagaatgaggaagagataactaacttctgccactccaggaagaagaaggttgccagttcttaaacctaacatacttccacggcataacagattttgaagggtgaggttccaggtagattacaacgagtagtgcctgaaattttgaaacgccataggcactggtcagcctcacagaaggttgaaattgcgcacggttgctgacgagtagtttgcaagcctgcaatttggttccagggaatcgtgtccaaaactattcataactgtaaatcatctgcaccaaagcgtctggaaccagaccacatccacgatggaatatgtagaattagatattgcagctagcatagtaggatctttcttcaatagtttaggcttggtaatggaacagatctgtaatgtgatataccttttgagctgatcttgttgacttattgaacgaaactctacacagatttactacctgtcttaaaatatactccctccgtcctaaaaaaaggcaaaccctgggtttccgtgtctaactttgactgtccgtgttatatgaaatttttttataactcatatttctattgttgttagatgataaaacatgattaatattctatgcgtgacttgtctttttaatttttttcataattttttcaaataagatgacggttaaacgttgggcatgtaaaccaaggtttatctttttttaggatggagggagtacagagtaacaacttttaagtacaaatctgactattattttatagaggatatcaatagtttcttcaaattgtgagttaatctgggccaatatggcaaatatcaggtttcattgtctgcactatgctctagccaaataatctatgtggactctgggagtctggagtcgaccgtccaaactccaaactcaaagccgtccgtaaagcaacaaaaggctcagggcaagtagtataatgtacatatgttgcctctaagagtgccacattagattgaatgatgaggtggaggagagaagtgaggagagagaagataagccacctctaaatcaagaggtaacctctacacaaatttcaaaaagaatgtgagagtattatagatattggtgtttgtgtacgggtgatacgttgtatgagttg

SEQ ID NO: 9937 - DNA, 2816 bp, Oryza sativa
cagcagcagctccaccccaaatccgtctacaaaactaagtaagaactccctccctgtcccgattagctttcttctcgtgcgtgtgggggccggggtgaccggagttcttctgcaggttcgagaggcataaggtgcggatggcggaggcgaggcggcgggtggtgttcgaggcagagggccgcgtgttggcgtgccggaggcggctgacgcagctggaagagtcgttgcaggaggaaggggagaagatgaagaccgccgcgcaggagctggacaacctcgagagggtcaggtatgttttttttgtccaaaaccctatcttctcgtgtgccttatttgcttgatgctagagtacaacttagagaaagtagaatatgtaatacactatcctaaaaaaacatatttctgtgcatttgcgtagttcgtagtttggttctatgtgagcacataagaagatctatttctctgttttatttagataatggaattcattctggcctttgcttcaaacaagatgtattgcttttgcagcttgtccattaatctgttgattttcttgtttatgcaagagctggtctgagacctctacggtaaaaaaaaaagcagcccgtgttgtgtttttaaacggtagtaggtgaaccctgtttagttcatatgaattagttgttgcggttggtcatattaatccagttcaaaggcatttctgtctgattataaattcaaatcacttgcactgtcacattccagaacatagtaactcacacacaaaacaacatggctccaatctagagtcatccagggaatatttctttgtgcttcaacatggctgaagcatagctgctatagttaacttgggaatattcttggtgtttcaacatgctgaagcataactgctatagttattaggagtgtttctttgagcttcaacatggccgaagcataactgccaactgaaaggaaccgccccgaagttttataggagtacaggatagccaccaattgtgatgaatgataagaagtgtgttcaaacttgaatggttattatgttagataaattgagttacaggcgccaagtggcttttgagcaactgatcacaatctcacctgtaaaagaaccaccttttcttgtactttgcctccaatggaaagatggagtaaaacaatccagttgggccaatgggacaaatgactacctttgcatggaatccctccatcccagtggatggtacaccagtaacctgtacacaccttgcctgattagagaattttagcatttcttctattccagtctccagaatccagattacccacaggatacttgcataacatgaatgactacatacttttttttcttcattagtctatcaactggtttgttatattacagtatcatctttttccaagctctacagccattccttgattatgtgctatcatgggttctcgctactatattctcaattcattgtcatttgagttgtctacaggagagcttcagtggcattaaatgtatggcaaccacaagttgttcgtggacgtcaaaaacaattggttcaacagtgcacagttccagttgattcccgtcttagtgatgtaaacatggagctgaaagtttgtaagcaacaaatagcaacttataagaacatttatgtatgtgatcttggacttgactgcaattgtaatgattgacaatgctagccttactggaattgtgtttttgttgctattatcagaacaaggagaaggaaaaactgaatgagtatgaggaagcattgaagagagcaatatatcatccattgcagagtagccatacaagttcaattgccaatgagccacaagcaaagagaaagaaacgaaagtaagacatgcaagtttgcctgtgcaacctttcgtccgatcttcctttgtttgcaggtatctactaagaggcccaatcttgttaaaacggagcagtaatgtttttgcctgaattgctctcttgttttgttatttacatgcatatatacttattgttctattattgccatcattggagtggataacagttcataaggaagcatatgccaccttttctgaaagttcagttttgtgcttacatgatgcgattccaccgttccagattcgcacaacaaaggcaaagttctcctgatgtttttgtttctacgtgcaggtatgcatgccactgatataaccatggcaaatgcaaaaagactgaagagagaggaaaaaaggtcctctattggcctcttccttgccaggcaagttgataggaagctccattgatctttcccaaatgctgaaagaatctattctcatggtggtgtgtgtaccgtccagccgccagcggccagctgtttataccatagctgaatagtcagtgctgctggtgcctatctgtcattcacgaagctgtgggcggtcagctgttctagggcagcaggacgacatacatctgatcaaattgcttccgctgacctttgggttgaagagatatgcacatgaagcaaaccatgttccctttttttttaccttcagtttcaaaatgttagtatgcaattaattaagtacgtggaagcttgttttctgtaagctacttcgtatacaagtcaatcaactcttccgaattgtaccctccagcaaggttctgcctgtagaaatggaaggtcgtgattgttttgtacacataaaacataatttgcattgcaaactgaaatcttaaaagcaatgaaatctttaaagctgataagctccgtttatctccccatcatcagataacaacatcaagtctactttgcacacacgccagagacattgaattt

SEQ ID NO: 9938 - DNA, 7438 bp, Oryza sativa
gttttccctggaccaaaaatccatcctccaaaaaactcaccgcggccgacgtggcgccgagcgccttccgccttccgtgccgcaccctcctgctgcgcctttgacccggccatccgttctctctagccccactgcgaggtggccccacctgtcatcgaggcagcctattaatacacacctcccctcccccgcgtccgagtcccagtcgcatatcccgccgcgtactgggaccaaggggaacgtgggccccacctgtcaggtgggccgtatataacgaccgcctcctcaccccggcctctcgccaccccagaagccaatccgcgcgaggcctcgccgtgatctcaattctcccccaaattcgcaaatcctccgcgtttcgtcgtcgccgttgccgtcgccgccgagcagggcggattcaaggggaagctccggtgagatccatccgcgaagcgcgttccctcgcggaaccctcgctcgccgggccggccgatctggtttgtgcgggggtggttgtggttgtggttgtggttgttgtttggtcgccggaatccgacgagttggagatctccgagggataggaatccgtagcgttgcgagcgccaggcgaggttacgatgcctgcggtgctcgccgcgttcgccagcctccgcgcggccgccgccatcgcctccgcggactcctccccctgctcccatctcctgaagcccccctcctccccgtgttttagtagtagtagtaatatttttagtagtagtaattatctttaacgattgcttccccatcgtcgcgcgctcacgcccctcggtcctcacttcgcgccgttcgcgttctcgtgttcgatttggttgtgctcgatccgatctctccctttcctgcttccgatcagaagcagtcggccttgttggaggtggtgattgctggttcttcgaggaaagaggtattaaaacgatcccaatttattgccattcgctgttattgatgttatggtgtttatttcattgaaatgtgcttctatttcaaattttgatcattagaatatagatttatgttctcactatttattgccttgtaattcacagcatgccaatattatagggcatattcttatatttacccttgtatttgatgggcaaataaatcttgtgcttgattttttgtagagatagaacaggatagacatttaagcagttaaatgccctgtttgtctatacctgtttcctcaaattaaatgaacttgctatttaagtcaaatatacgtttgcagtcatgaaaatggtcttataaagctgtgttaactaaattagatagtgtttcttgtcattataaccgcataaacagactctcatctaacattctaacttcaacccgttttcttttcggcagaaaatcatctcctgaatttggaattaagcttgtggatgggcggatctttggtggactctagcgccgaaggtgttagcagcagcttatgtctctgccacagcacctctgaaaaggcaggctttgagcatagctcatgtgctagctctggagatggaaattgtgaagctggaatagattttgggcaagatgatttggttgtcaatgaaattggaatggctattgctgaagtgatgcatgtctgcagtgatcatgatgatgatgaagggacagattcgggtgaagactttgatgaaaatgagggtctactttctctggaatcagattccactgatgatgtagtggatattgataatgaattggtcatatcgcctaccttttctagttgcaatgcatctgaatcatcaatcaacaaatcagactctggaaattcttccattaatgtaagtatttgactgcagccttgttcaacctaacttgttcaatataccttgccagttgtatttgttttagttgtgatatctacgcacctaatttgcaatagctactcagtttcttttagcatttttttaataagcacattaaaatctcactgccttcttatatcatgttgtcacttctgctttaagaattggatagcatcactggatgaacagtttcagttgttgtgctgaactgctgatgccacttgtatcatgtcccatcaaaatctattccacttgattttgagtttatttgaaatcatcaatgaccataagatctcagtgggctgtatgtgtttttttcttcccataaaagatggggccaaattgtgctttctaacatcacatatatgttcatgtgcagggcactccaccgttggtttctgcaatgaaaggaagccgtgcaaagttgggaatcgtcacaagtttgagtgtttcatgggcccctgatgtatatgatcctcctgttacttctgggtctcacactgtgaaggggcatcaaagaagttcaaggaagagccactacaaatacaagccggccaagagcagtagcagccgcagcagcagtggaagcaaaaaggacaggaagcattctcgccacagtagcagcagcagcagcagcagtaaccacaaaagagacaggaaaccttcctaccgcaacaccgttggtggtgtaagcgtcggcagcagcagcagcagcagaaatactgatgctagtgctgctcaatatcgtgatctgtacagcagcagtggcggcaacagaatcgacattgctgttcctcaatacagcaagctatctccgttggtgccgtctgagagtgcaacatatcgtaatgtgtacaacagcactagcggcagcagaactgaccctaccgttcctcattgtagcaagctatctccgctggtgacatctgagagtgcatcacttgcagggaccgttcctgtgctgaagacattggagccgatcaaacgcagctccagctgctgcaaggagcagcctttgagctttctgtcacgccagtttgtggctgcaaagtacaaggggatgttctcactatggagtcacaaccagctagcttcttaatcatctgttgatacatccaactcgtaagctgttggttatcaacaaaatgcaaaacttttaccgcttatgcctttattattttgatttgtgaccacgtgtcttgttctttgttacactgtttgctccgtttgttgaacatccgaagagatgttatcgaaagttgtcgctcgaagtatgtatgcatactcgagctcattatcttcccttatttatttgttcaatcggcacggttctgtttgaggctttgaacatcatttcatcggttcaattctgtccagtttatttcgtttacatttgttcgggtaaaactggtatcctagatgtttcaacatcaatccttctagccagaaggatgaggttgcgaagcacattaacattactgaaagtgtcatgactgctctaattcagcccgtaataaagagcaactggaaaaaggcatcccctgttatcgtttttcctctcaatttacataaaaaaaatattttcagaattatctgccctgttgttcagaattctaactaactcttgacatcaagacactttctatttattgtaaagttaacatcagaactgtggaaagcctcttttcttggctttctggtgtcttaaaacaggctgtcttgatctccaattaacggaaaatctgtcttgctgtgctgtagacgccaacaattgacattgtagttgcattaccagttagagcgggcagccatgaaccatgcctgaaacaaaaaaagatatggtccaatacgtggataacgtaaatatgcatgacattccacagttccgacctctggctctgaggctctgaacgatctttttaccttttggatgcaccatgtggtccatgtctatgtgattagtggcaatgctatgttaatgttttgaactgctatgttaatgcttttgccgtgacgtctacttggcataaagcaacaaacaaacactaaccaaacaatgaattgcgtacgtatccaactaaattaagtgtttaaaatgaccaacttgcataagttgtgtaatgcataatgcaaccaatgttgctattaatgtatggacaacaaaccatgataggcacgttttaacaaacaatagcaggaaagtagccttctccttttaggttctgttggttgcatagaacatctactccatcactaatatgatttctttcccgttcatagcagcactaagacaacgaacattgcataaaaaacaaagtaaaatcaagtggagttcaataccttgagaggttgtatacttgtatcagggcaagagggtccagtcagttccaggattcctttttatctggataccaaattatgctcagtgatcagtagtcattattgtttggtgatggactccaaagagtttcaacgccacatccctcacccccagctgtgggacaatattcaatcggttgaggaatcaccaaaagtccttgcaagaacaacttccctcaacaaatctatggaaacgaacacggtccctaacaatgatttctctatcatatgacttgcttactatttttgctacttcatggcaatctggacagaatctcaaattctttaccacccgaatgacgtgaggcgcttttgtcttcaacaaaccatatgcaatggctaacctttcactgtgctcacaaagtgcaacttctttttcctcttcaccaacatcatgaagcacggctgcagtccaaggcttgtggccagcacgtaccacacggtcagctatttccctcagtaacagtcttatctcctttatttcagggtgtgaatcatcactcaccacaaacttgtgaaggtaaccattaatttcaatcgaactacagccagcaacaacattaacattgttttccttcatctttttcctcatatagcttactctatcccactgggaattcgatgcgtacaaatttgagagtagaacatagttttctggattgcaaggttctaactcaaggagcttctttgatgctgattgcactatatcaaatctatttgagttcttactggcaacaagaagagtcctccaaattactgaatttggagggatagccatgccagtaacaaatgaatatgcttcatccaaaaggctagaacgacagaaaaggtcaaccatgcaaccatagttctccattgaaggtttgatacccaattcttgcatagtagaccaatatcgtcggccttcattcactaacccactgtgagcacaggctgacaacacacctataaaggtgacattgttaggcctcacctgacatatttgcagtttacaagaatttaattagagctattagaatggttatagacttaccatatatttgtaaagactgcatgaattctaccattttgttggaaactaagttgaacatgtgaactaatacatagaggacaatgtagaaaccctccctatttttcgcgaatgcaaaaccctccctatttcaaaccttcatgtagcaatgtcactatcccagaagatatcatgtatggaaccaacaaattttgcacccatgagctaagttttatggtagcatggtacaaaagacaaaatatatgctaaacaaagaacatgaattttaaggaactacatcattgcgaatataaattagtttcttttgacacccatatttaatgggttttacattttcacgtccaagtaaatgtatatgaaaaaatcatcaccaaaaccaattaacagtcactacagatacatcagtaaaacgatctttttaccttaagctctagcattcttgagaaaagcttcaaggcaacctctacaagaccatgtatcgccaatccaacgatcattgcactccatgcctttgtatctctctccgccattgcatcaaacactccctttgcccgctctatcaacccacactttgcatacatatcaattaatgctgtgctcagctcaagatcgactgtgatacctttcctatcgataaaagcatgcacccatctccccaaatcaagcgcccctgccttggcgcatgccgaaatgacactaaccatggtgacctcatccgggttcacatctgctgcctgcatctctcggaacagccccaaagcctcgttaaccatcccgaccctggagtacccgccgatcatggcactccacgcggccaaattcttgtccccaaccatgccatcgaacactgtcctggcgagcgcaacctcctcgcacttggcatagaggttaagcagcccggtctgcacgtaggggctcggttcaagcccccggcggaaagcctgcgaatgcagctgccggccctccccgagagccggcacgacggagcacgccttgagcgcgaacgcgagcgtgaaggagttggggagcggggacccggcgcgcagcattcggcggtagaccaggacggtgtccgcggccggggcggcgccggcggcggaggagagcgcgcggatgagggagttgtagcagaaggcggtcggctcggggatttggtcgaacaggttgcgggcgtaggatggcgcggcgccgcaggaggaggaggaggaggaggaggaggaggcgaggagcttggagagcgcgaaggcggctgtgaggcgagggaggcggagcctgatgaggcgcgcgtgtgcggcgcggagcgcgaggaggcccgggcagcatcggcggacgagcgcgacgacgtgggcctcgaggaggtggcgcgggagcgaggcggcctcgcccggtttgagctgctggtggtgcatgcgctgcgcgtacgcgtggggatcggcacgcgcggcaaagtagacgacgccgcgacggctcggtagtagcagctacactaccaccgcggcgtgtgctcgtgccgtcgtgccgcgctgagagatgaatcaccgggcaccggcacaccgcgtccgttgggctcggtcggcctcggcggcggcatgcggcgaagaggagtgggccgcatgtttgcatggctgtggttgggggctgggatacgggccgtgggctgctgcgactgtggacgcgcgaggaagagtgacaacatcgtgggaataagtatccactgtacacccctcatcttttcatcgagtttacatagtatccataaaccgcactactgaaaatcttaaccctataacttacaaaatcgggttaaattagatcttattgcggtatgaattgatttcgctgatataacatcctaatcaacatgagatagatctacgtgaaagtggccacatcaaatttctacttcccctcatcgtcctcctcttcccaagtagctcgccgacggggtaaggggcggcggccggtgagcttatatcagtttttaaccccccatggtttttcactgtgattaccactgggtaacggtgatactcctattcatcaaaacggtaaaggaaacccggctaaaccggggctgatccgccactttgcgggaacacgatgctcccccacgtcgaaacagcgcgtccccaacccaacccaaaaaacaattccccccctccctgacatgcgtcctactcct

SEQ ID NO: 9939 - DNA, 668 bp, Oryza sativa
tttggggtgggtcttttattgcccttttcttaatatactagacgtggaaaatattttttttgtcaattttactaaattttctgttcatgttatccgactttctccatgtatgttaatttcttgaatgttggctttgacatataagactatactagtatttgatacatagctgaacgaggtaaagaaaggaagttccatgattcctctgtggtaaaaactgtcattgattttgtattcagatcagtgaatcatattttgctttgtagcttcaagttcacatctaatcaattctgtaacatttaaactttaaacagttttcaggaaattgttcctctcaatgctggcaatgtgcttgtaatagaagacaacgaaccagctgccagatggcttgttcttataaaccaagcattaaaccggccagctgaaaccaatgccaatgtctttcagaatgagccatctccctctgttgattctagtgtctctcgagcttcttcaagcctcgatacttcgttctctgacctagcaaaaacatcaagtagttccacaatcttccagaagtctaatctaaaatccattagaaaatccttcatgccagtccatcgaaaacggcttaaggcctgcaactgccctgtagagatggccaaatcatcctacagggatgcttgctt

SEQ ID NO: 9940 - DNA, 76817 bp, Oryza sativa
  unsure (1)..(76817): unsure at all n locations
cccattagtaccgcttgtcagtagtccatcacccttgacggatataaatgtctttcgcagggaatgagttcgagatatatatgcttgccattcatggctcaacctacaaagtacaaacatgtcccccaaattaataaaaggtattagcaacgccaaacaaagtcaggtacagcaattcattatagcagcaataaagatggggcaaatgtcatagacttgtagcatgatgaacaaatgaactaggaaactacaagagccccttggctgggagtgttgtgtgtgaatttgagggaggggattcatttacaacagagcatacctgcggcaattatgaatccgctgaacttgcacacgttcaccttcaacagcaggcaacgcagcaaaaagatgcaccattgttaggcaatcatccaagtcacgaagagcatcaacaaaagttggatatctgtaaagcaaaaatatggggatgatttatagaaacaaatacggtatggatgtcatcagcaaatcactttaaacctggtacctttcaagaataagcctgtcaagtttgtaagttggtggtcggttcaataatctgtctgcaagatctttatttttcttagcaaacgcctttttgaccttcttcctgtggaccttgatttctctgaagtcaaacaacaatgaaatgtcattaagagtggagacatcacaaaccaagaatagcatggtcttataactcacactttttaatgcaaagacaacatgcaccacactgtatcaactaaagttctaatgaaactctagattatatataaagcatgaattatgattcccttgtcaacgatcaagtaattgtgagcaactagtctatctgccattctgccaaccatcaaaatatcattgatgaagcaccgaggagaataattcacatggcctagctaatggctctctgaaaacctacattataattatttcctcaattgtattcagtaataaaatacaagtttctatcttgcttgccattttctccgctgcataaactgtgacagaaacaaattgcacaattgcagcaaacaaatcaaataacaagaacacaacacaaaccgatcactagcacaattaagatattttcatattgcctatctcagtggcctaataacaaataagaaaattgaaagcattgttatctcattaaaaattaaatatgtctgcagctaaattttgtgatagtgatacattatatgcccttaattgcacagagaaatgtgcaatcaaccaaaaaggcatgcaattcaaatgctcagtgagtgaatactgaatacttctgtagccgccaaaaaaaaacacagatggtagaccttttgcaagaaaacttaagtacctaaacttctcaatcaagggatcatgggccaggaaggcaatatccttcatgtggtagtaggtcttgtggttcccttccaccttcttctttggatcccggggaaagacgcccttgagaatgcatagcttcctgcaacggattgcaaaattttaagcagtcagaaaaaaaaaatcctacatcgcttgcagtataaaagctatacgtaacgcagagaatagtgaaggtaatcctaatggccaataggcgtatcgaacaaattaattagcttaatggagtgtacagcttaaagcttcagcgtaaaatgtgtaaaatttcccagacagctttgttagctccaacaaaaccaataaaaatagccacaactacactcgttaatagctccaaaatgacccaacatatcattagtcagtactcagtagtagcagctgggagattagaggatgacctgaaggttgcgaggctaatctgcaggtacttcaccgccttggtcctggtgatgtacttcgccgcgttcccctccttcttcttgccctagagcatccacgaaagcagcggtgagaggctccgcgtacaacaaggagaggggtattcggggggaggaggcgggaggaagacggggtgaattaccgcaggccggtagtgcttcggcatggcggcggcggcggcggcggcgtggctcctcggggaaggggagcgggggaaaggagaggccgaagaggggaggtgggtttttagggttttggtttatattgcggcggatggctttggggccttgggttgggctgaaaggctggaacccggcgcggcgctcactgagaagaggtgaagactggagacttgggaggtgggagccggcctgtcagcgtctgcttaacgcttagtacatattcttctcgtaaaaggggattgttcagtcgattttagagagagatgtactccctccgtctctataaaaaaacagacacgctaaaaaagttacgacagtttttcccttaaaaatatatcggtttgtggtgcattgaattgacgttaagattagtgctaaaataatagtatgctaaggccgggagttcagcatagcaaacatcttttcttgaaaaaaaaagagacacttctcatatatttatacaaatttacatagtagttacatcccacttacacaccacttacatatataattttagaatttacatatgtaattttaggacttacatatgtaattttgagacttacattgtaaatacactaaaatttcatatgcaattttagggacttataatgtaaacacataccgactattttttcatgaaaaatatggcgccataaatatagctactctcaaaaaaaaaaacctataactatatgtaacatcctacctccgtcccaaaatgtaagcatatagaatctggacacatatgtgtccagattgctatattttggggcggatggagtattctagtatgaatatatgcatacctttgtctatattcattgtactggaatatggcagatctaattctaagtttatttttgtgggacaaagatagtaagagtttgtatcactattttgcaggtaacgtggagtagattttcggtcattcagaagtacattttctctaagcttgtagatttcggtcatctaactcttttataccatgaaggtgacgtgatataccaacaagatcagtgtactttaataccatatcgccgttttcttgaatttgcccttgaagtaatccttacatgagctttttaaaaccatatatgcatatttttgtctatctcgaaccgctagtaacaactagaaaccaaattacgataatatagtcactgctttaaccagttgctacttgtttgttgcaacgaatgaaccagtcacattatgcgggcaactctgtaacgagcaactaacaaccccataagaaacaaacacaaacacctccttgttcgagtaatagactgctttgttatctccgaaattacgtgagaaaaagaacctcggatttattctatgttatagtttttttactcggagttatcaagctccgaccagtaatatattatatacgatctagtatcaataattaacaataaaaaaccataaactgggcatattcggctgcaaggtacagcgttgccttgcagccaaaccgcggcatattctttgtttgttgtatggtgtaacagatggctagttatatagtagcactgtacttggcagccgaacaagtgttggtcgaccaacttctgttggtcaaaaccaacaagtgtttatagaccgaggagtcaccacagcaaagaatggcttacgtcaaaatacgtactctatccggatgtttttaatacatgacgtcattgacttttagttttatatttgatcatctgtcgtattcaatatatttcaaataggataaaatacaaagtcatgaatataatacacaatacatctaataacaaaataatcacaaaaaaaaaacgataacacagtttttttagaaacatggtatgaacgcagcactcacgacattcacccactcactcgtatgagcaccttctaaacgttggacgacatatattgagattaaccaagtcaccacaaacgtttttaccatcgatgataaaaaaaagcaatatatatttcaataatacgaatctcatatgtacaccaaaaaaaatggtgtcataaaaaaactgaagaaggtacatctttttacatgctatctactcaagaaggtacatctttttgacatgctatttactccctctgttttcaggtcataagtcaaactgtttcaaatttaactaaatttatagacaaaatagtaatatttactataggtgtgtttagttcacgctaaaattggaagtttggttgaaattagaacgatgtgatggaaaagttggaagtttgtgtatgtagaaaagttttgatatgatggaaaagttggaagtttaaagaaaaagtttgaaactaaacccagcctatactaaattagtttcatcaaatcaataattaaatatattttcataataaatttgtcttgtgttgaaaattttactattactttttttctacaaacttaattaactttaaagtagtttaactttttctaaagttaaaatgtcttataacctgaaacggagggagtagtacatttgtattcaaggtaatacaatacgaaggtaatattaaaaggtttgaaaatgataaagaaaagaagggggaaaaaaggtttctcttgggttggacaaggccttatcaaacccggcctgaactatactaccgcacaacacacaaaacgtcgacgactaatgacgtcatcatccgggaccccacctgccagcgagctaactaaaaatccaaggaagcaaaacgaaaccgcgcgccgccaaccttttcgcggcttcactttgtttttcttttgtcttcgtttttttcccgcggcgcgattacgaaaagagctcttcccgccggcgccaccgcccgccgaccaaaactcctccataaacccctctctccccgccattccccacctctctctcccctcccctcccctcccttcgcgcctcctcatccgcctctctctctcctccccctccgatggcgacgcggccgcggtcctccccgtcgttcttcggcggcctccgggcacgcgagctcggcggcggcagggtgccactgccacgcgcctccgcggcgcggctcccctacctcgcggacctctcctcctaccccggcggccgcgggagcggggtcatcgccgtcgagcacgccggcgaccccgccatacctttcgccatctccttctgcaaggtgagcgagcctgggatcttttgtccccccttcgttttcatgcgttttttttcccgattccgacatcgaaagggttaagatttgatgggaactgattgttcgatgaaccctcgcatttttttttcatttcaggcggagcagatctctcaccttctggcggtagctgatgaggacgggtatgttggcatctacgacacccgccggcgcctcccatccagctcatcgtcattggggaaatcaggttcgattggatcccccctctttgatctagttttcgcactgttcgattcagttcgtggatgtctggggccacgcactgggtgtcatgttcgattcgttccggtctgaaaccgtgacattctcgcagctgaaacgaagatgtccgattgggttgcccacaacaatgccatctttgatgtgtgctggatcaaggtaacacctgttactctcaatcattgaaacatgttagagttagtggtataaaagccaatcctcactcacttgtatcatcttctttttggcgttgtttatttaggacggttcccaattactgactgcatcaggcgatcagactgtaagtatcgcaataagatcatttttcagaagtagaatagaattgtttgtttgttctgcattacaattcatattaatgtgatggtggactgccttttgatcattgggattgtttgttctgtatcaggtgaaaatatggtctgtggaaaacaagaaatgccttggtgttctgtcagggcacaccgggagtgtgaagtcgctgtcatgccattcttcaaacccaggttggtgttatgttgggaaacaaaaaatcaattcttcgtatatttgtgcctgtaaaatttgccaggaacttgtattcaagaacttattcactgcagagctcattgttactggatcaagggatggttcttttgctctttgggatctaagaatcgacccaaaaacccctaatggtcaccgtgaagcttgtctcatgtatgttgccttggctgttgcaatctaaatttcccctttcaactacagtgatacagaaataacaaattactatatttataactctgtttggaatgtgacacatgctaggtcttcccttgttgtcaaacaagcacacagtcccacacaaagaaatcgaacaaggtctagagcaaaggtattgaatttgcatggatttgctattgctgggtatgatcatacatcctactgtggtcaacttgctgacgctggtaatttttaggctgcttcgacgagtatcacatctgttctttatttgaaggatgatatctccattgctacttctggggctgcagacaagtatgtcattccccattcatttcattcttatagttcaaaaggcatgatgtgttgtctgtggtattacatttgaatacgaacatgatcactttgaatacaatttacctcatttttgtgtaactctgtccaaatattaatgttccactttcaataatgtctgccagcattgtgaagatatgggatacgcgaaatatcaaattgtctctctccaacagaagctctcaagcagcaatgcaacctttggtaagcagctaacaatcactacgcaatatgtttgtagcccaatttcaagacttaccgatcatttgtgcaggagggtgtgaaacatgggatctcttgcttgtctcaagactcgtatggtgcctatattgctgcgtcatgcatggataacaggtataaccgcaatcaaccacactgcctcagacttaatatgccatttgtgaaggctgcctttgactttataagcctttcaggatctatttgtacagtgctcttcatatggataaaggcccaattaaggcttacactggcagcaaaattgaatctttttttgtcaaggtcagtgagtgaacaagctgagttgatttccatttttcaaaccgcatgcctgcttgttcttaggtagttttatctgctatgttttataacacctgatatgttggtcaaatgcagtctgctatcagccctgatggaactcacattcttggtggttcgagtgatggcaacgtgtacttatggcaggtagttgttggatcatgttatcatttcgcacacgcattagctgctcttttactttctattcatgccactactttttcactgacataggtggatcagcctgaaagaggtcctataattttggaaggccatgaaggtgaagctacttcagttgactggtatgttctacatacaattgtagtttttttttgtgtaaatcttatcaaccatccaatgttcagatttcagtacgattttttcacaattttcaggtgtgcatcagaggtcgggaagatcgcaacgtcatctgacgattccaaggtgagtatgtgattaaccttgcaaattttgttcattcaactttcatgaatcttatgagaatgagatccttttctttttctattacacacctacatgttgcaagcgaatttaaatgcctgttttggtatgtagaaaggggagctgctgatattcagtattttttttaagaaaaccactgataacaacactttatgatgtgtatctatcaggttcgcgtatggaatactgagagaagggtgttcccaaacacaagttccccaacggtcatccgcaagagaataaccgcaccaaacactggaagccggtctgctagccatgagctagctactacctcaagagatgtaggagtagcagcctgcaccagtgcagatggtgaattgccaactggttcacgctctccccttcagcccagagtactggagtttggcacaccggagtcagcgaagaagagagcctttaggttgtttcaggaggactcattggacataaggaaaagcccagaggctcaaatgaacagcccttcttcggttctaagccccccacattcactgaagaggagaacaattcgggactactttgctagtagctcatcttgtgagcacaccaagcatgtccatgaccttgcactcttggctcactcgtcaactgtgaagaacctcaaaaatgctcaatatagctacaggtgcctgaaaaaataactttaaagttttgaacatcgatttcactaaacaacaattattatctccctctgaaatgttgctacctaagatgatagtttagaactctagaatcattgtcggcggagaaagtaaattattttccccaaatttccagctatgaaaaaaccctcaccaaacaccatcaaacaagagttcaccaaaccgcccatgcggccatgctgtcacgcaacgcaccgcattgcctgatggccgctcgatgcatgcatgcttccccgtgcacatatccgacagacgcgccgtgtcagcgagctcctcgaccgacctgtgtagcccatgcaagcatccaccccctccacgtacaccccctcctcctccctacgtgtcaccgctctctccacctatatatgcccacctggcccctctcctcccatctccacttcacccgatcgcttcttcttcttcttcttcgttgcattcatcttgctagctagcttagcaatggcggatcgcgaccgcgccgggcagtactaccagcagcagagagggcaggtgggggagacggtgaaggggatcctgccggagaaggcgccgtcggcgtcgcaggcgctgacggtggcgacgctgttcccgctgggtgggctgctgctcgtgctgtccgggctggcgctggcggcgtccgtggtggggctcgccgtcgccacgccggtgttcctgatcttcagcccggtgctcgtcccggccgcgctgctcatcgggctcgccgtcgccggcttcctcacctccggcgcgctgggcctcggcgggctgtcgtcgctcaccttcctcgccaacacggcgcgccaggcgttccagcgcacgcccgactacgtcgagcaggcgcggcgcaggatggccgaggccgccgcgcacgccggccacaagacggcgcaggccggccacgccatccagggcagggccgaccaggccggcaccggcgccggcgccggcggtggcgccggcaccaagacatcctcgtaagcacgcgccgcgcgcgcgagtggctcgcgtcgcgtacgggctgggtttagcctgctgggtttcgcttcgcttcgtagtagtctcgcccccgaccgaccgagtcaagagtgtgtcccgaacgtgaccgtgcctacgtgtcgtgtgatcctaaagtctaatgttgtaccagctgctgcgtactactgctactaggtaagatcgatgtagttttcgatttagagttgtgaatgataataagcgaggtcggggggagcaagcgatctggggagtttgtgcttgatttgagttgatgatgaacatatgtatgcattccgtgttcctctgtaagaaaagaattggtgaatgaacccatgtctctttgctcaaatgtcagtacttgaatgctacattacagcctagcaatctgctgattgccgttttattatctccaaaatggcttcccagattagtacatgttctctctgaaaacagttgaacgtttttcacagcgaatgcaaacgaatctgtctaatgacatattgtaaagccattttgtttaggacacatggccgcctactcgtcacgtggacattttcaacgagtgatgtgtcttggttaggccacgtcggcctgattgtcggccgtcgtgagtgctgaccgttctaggctagctattgttgaggaagttgggctttgtcccataaaggccagcccaaaacaattaggaggttaaagaactggaataagttggtgtttgaatctcctaatctcctaatggtgtttcacgcataataagatggtaatgcgtgagaataagattggtgtttgaatctcctaaagtgtttcacgcaaaacgagatggtaataatatatgattaattgtgttttgattattaccatctaagtcatctaagttttcgcacgaaacgtaccaagttttcgcacgaaacgtaccgtttaacagtttgtgtttcacgcaaaacaagatgataataatgtatgattaattgagttttgattattaccatctaagttttcgcacgaaacgtaccgtttagcagtttgttttcgcacagaacgtaccgtatacaatttgaaatacgtactatttttatccaaaaatttattcaacttttgtttagaaaaaagaaaagaacagggcctcatcttacttgaatagttataggaggttaaagaacttgaatacgaacctgtctccttcgttttactttctcctcctttatatattgtgtcttcattctattttatacatcgtgtcttcgttttaccctgttctctttatatattgtgtcttcatttttctctatacctacataacctttcgaactactatacatagtagagggttatctttcactctgctctcttatatattgtgtcttcattttactctatactcacgtaatcttctgaactactatacatagtagaggggttatcttcagtctctattttactgtcaccatatcttgtgtctccatttcactctgttctcctcatatcttgtatctttatttttctacttatgtgttacgtaatatctataactttatcaaaagttatcaaggtgtacactagcaactatcttttttaggatgtacatgtcaataaaataataattttataactaataatgggaaaaactttccatttatacccgaatgaccgcgatgcacctaggctagccagagttgttggtggttcaagcagctacgaataccctagtggtaaccatatatcttcaatccaattcgcccgaaaaatgacggttgagaaggcgaagtagtatactgtagtatatattctcggtctaattcatatttttctttaagataatagaatatctcacattttcattaaacaataaaaatgaaatatccggcctctgcaataaggatacacacaaaccataaagaaaacaatcataaaaagggaaataaatagacatcgtgaatataccatgttgtgctcccgcattttgcacagctagaatattgacatgtacgctagctgaacttgattagtcgctaccaagtaccaattgacacggtatttaactatattgattatactccacagtattgaactctattgctataggcgaaatgtcttccacttcttttgcctggtaaagtgaggtgctctttataaaaacatctcagcaataaactagtatgtctacatgggtatatatagctctctaattcattgtctcgtttttctctatagactatctctagattaatagataattttgctctctctcttcatttaatctttttcaagtagaaaaatatgttgacataaaactcttataaagagtttttaaataactattggggtgccctaacgttgttcaagccctcgggccggcggccggcacatactaccaagcagggtctgctggccctttggtcgatccgacattggaattcgttattgtaccattattagaaaaagaactaccattggaatgtaattgttgtaattttttttaaaaaagtaacaaatttataaatgcccctttaatcaacagaggtatccagctaataagcttctcgtatgttccgaacggccacattacagttgctctagcggcaagtggatgacaggcaattaaagaaaaaaaaaagatcttcagatgtcgatgtgagaatcacattctcttttctcatccgccacccagttccccgtctgtttggcaaaatcaggcaactagagagtcctcctctccctggtatatgcacgcgcccgcgttcgtgccgacgcgtgtgaaacggccgaggtcgtgacagcagcggcgcgtgttgttttttcaagtgacggaaaaactgacgatgtcccgcgccaccggccaccgcgcaaagagcgggcgagggccccacaccaaaaattccatcacaccaaatatacacatacatgagacattaaatatggataaaaaaccaatggataaaaaaccaattatacagtttgcatgtaaattacgagacgaatcttttaaacctaattacgccataatttgataatatagtgctacaataaacatatgctaataacggattaattagacttaatatattcgtcttttaatatattcatctcacagtttatagtttatagacagaatatataatttattttattattagtctatttaatactttaaatgtattttcatatatgttaaaatattttttttccaaacaactaaacacggccacacacaccccctccaacacgggccccaccaacttggggccccacgatccagtggctgacacgcggggtcgtgggccacgtcaattcgaagtagagaaagcaaaaaaagaaaaaaaaaagggaaagcgaaacgaacgaaagcccaacagatccatcgaccgaggagaaggcgagagcgagccgagccgagagcgcaacaaaaggaaagcagggaaacctcgccgtcctctctctccatccatgccctagcacgcgccgcgcagcctacgagcgggagccacacctcgaggtaaccaccaccaccatcgccaccctcctcctcctcctcctcctcttctcccctcgatcccgtccgatcaaaaccctagcaccctccgcgcggcgctggcggcggcggcggccgatccgtacggttgcggcgcccgcgtcggtgggagggcgatctgaattctgggtcggcgagtcgggcggtttttgcgtgtgtggtgtgttgtgttggtagggaggggatcgtccggtgccgtgatcgttgggtttgctcgttccgctgtggggagggcgtcttttggtttgaccatcggcggcgcggggcggggtgcgtgtacagatctgttcggaagtgcgtgggaggtggggggattgggaatcgcggccggattttgctggtattttggaggagttgtgatgggatctgtatgtgcgggcagattcagttgtaaaggctgccgttgagtttcatttcataggttgttttttttttccttttgtggggattgttaggtgttattccaagccgttaagtgatctgtttgtgctttttgggtttggggttggtcattggcgatgttgacttgggttaggcctctgaaagagcgcggttatattgttgcgatacattatgaactattatgctgttgcgatacaggatgaaccacgtttctattgttagacgaattgtcccgatgaacccctgttcatctctaaatggctgccatgtctttaatacactgaaaatgccttcagaagctttgaacacagcttagatttactactactggtgttgcctgacatatcatttttacaggtcttcatctgttgcactcatgatttagcaccagctgaagtgacctctgagactgcgcggtgacgtagcctgttgctaggataaaaatctcagtagttaagcatggcggattctatggtgtcaagtttctgggggcctgttacttcaacaactgagctctgcgaggaaaattatgcacactcgtcatatattgcagaattctacaatactgtttctaatgttccatgtgttcttctggcacttgttggacttgtgaatgctcttcgccaaggttttgagaaacgattcagtgtcctgcacatatccaatatgatacttgctatcggcagtatgatcttccatgccaccttacagcacgtgtaagtttttctccccctaaactcatcagtattgatattgcaataacatcactgaccttcaatgctattaatggtgctgctctccaagaatactattttttctcttatgtgcttcaatatgatggaacaatatgttacatttgtgtgttaacatgcaagccatttgatgaaaacaccatgacctttttttgttattttctatggttttgcacataaacattatggttaactttggtgctatatgtttcctataaaaaaatattcatttgcatagggcccttttttccctacttctagtcgttttgtatagagaacttaacaaaaatgagtgatgtccttttcttgtaagaacaaatttggcatcaagttatggggatcagataactcttgatttgcccctttaccaagggcatattcttttgtaccctttgttattttttttgtctacagtgggcatttgttaacttctcaaaggatttagctcttgttcaatgaccattagcaactaagtgaacagattaagatttttgggctaactaattccgcagaggctaatggctgattaatcaccacataatatatgcattctgattaataacctatgtaaacttgtacacttccagattagaaagttaaaaacatgaggtctattggccactataatattattgaaattggcaacaccttgtttattattcgacacttttgaagctgtgcacttgaacaccgaacttgtaacactaacatgtttcacattattaacgttatatgaaaattaattcattactctataaaaaaggaatacttctataatatgaaaaaaatatttatatccaccagggtcatatctgggattgtgaaaggtcaaatgcttaactaaaagtgaatggatcagcagagggagtacgtattaataacttaatgtattgtgtttttcataaatattacttaggaggcttgcttttcctttagataacaagtcaatgtggtgctccttgagccagtaaatatggaatctgtttcatgtttagaagaaagagtaagactgtggattgcactctgctagtaagaatcctatgatataaatttatccttttgatttacagcataagcataccctagttactgttgcttaaaaatttgaacggttagtactcaacgactcactgcacaaattgtgccacaaattgtccagttattgcacatgataacagttagcttccaatgcctcatgcttctatgtgtcagtgtatcttaaagtagcattgttctgtaatacgactgcggactgccacattttggttctttgacatattgaataccatgaaatccacttgatattttgcaactgtttgttatgcaaatcttttgcagaagtaattcccacagttctgttttagttatctgtggcgatccagtttatatgccttagtgtcaaataaagcacattccttttagttgccattttgcagattagaggattgcgggctgtaaatcatctcccaataaattaggtcagccatttattgatgtgctgccaattgcatcacattgttagcttgctcaaaagctatagcctattttataccagcaacatgtagcccttttgactaattgggggcagctagtattcatcttctaattccagcatgtttccttagtatgcacaatatgcagtgctaattcttttggtcatgtattgttttccagtttacagcagagcgatgagactccaatggtgtgggagattctcctatatctttatgtactttattcaccagactggcattaccggagcactatgcctactttccttttcctatacggtgctgcttttgcagtagtccatttcctggtgcgattccaagtggtattcaagttgcattacgttggcctctgtctcctatgcatcccacggatgtacaagtactacatacaaactaaagacatggctgccaagcgtctagcaaagctgtgggttcttacgttgagcttggcgactctttgctggctatttgatcgaatgttctgtaagaagctttcacattggtacgtcaacccacaagggcacgcatggtggcatattctcatgggatttaactcatactttgcaaacacattcttaatgttttgccgagctcaacagcgtgggtgggagcccaaaattacccaccttttcgggttcttgccttatgtcaagattcagaaaccccaaaagagggaatgagttctctatttgtcagtgctgttctccaggaccttaaagccaacgccctcatgtgcttagacaagaagcagaggcattttttttgtatatgggcttccaagtgattacggactacagtgttatgatgcctcactagattttgttaacttttaactaacgcctgttttgtaccatacttaattgttgctcagagattagttggagtgttgtctcatagttttggtcattattttttgtttctctacatttgattttccgttctaataggactgaattttatttgttttttgtttgtcttgaatgttgtcgaacagttttagtcaagttactgcttcatatggccatagattgatcttctgatggttcaattaattctttttctgctgttgtgatttttgctcgacttgaaagctatgattatgtacaattcgatttatgtacgttcatttaacagcaactatacgtgcttcttgcagaagcactgttatccgtttctggtggtaatcaatatttaccattacttccaatttaacattggtctgcctcgagatgggtgttgatactcgtgtggtagcccatgctatagggtttttgtgatgttgggcaggtatggggttcttttgtggcgctggtaatctgaatgggcatccatactacgactgacgaaaaattaagaaatgcgacatatggtgatatgtagaatgcgcgctggtaatctgaatgggcatccatactacgactgacgaaaaattaagaaatgcgacagtaccgttatgctgattgtttccttgcattttattagggtgtggctaatgggcgatcgatccccacgccccctatacacacctctccttccttactcctcccctttttctcttcctactacactataaattaaaaaaaaataaaaaaataaagttggaaaaaattatgtatagatatactatatataaaaaatatttgaattcaaatttaaatttgaatcgggtataaaaacttttggcttataaactttgggtgaataaactttgggtgtataaactttagatgtatagaaatactatatatataaaatatttgaattcaaattcaaatttgaatcagatataattcaaatttgaatcgggcatgtaaacttttgagttataaactttaggtctataaactttaggtgtataaactttagatgcataaaaatattatatatagaaaatatttgaattcaaattcaaatttgaaacgggtatgtaaacttttgacttataaactttaggtgtataaactttagatgtatagaaatactatatataaaaagatttgaattcaaatttaaatttgaatgtatagaaatactatatataaaaaaatttgaatttaaattcaaatttgaatcgggtatataaacttttgacgtataaactttgggtctctaaactttagatgtataaatttgaggtgtataaactttaggtacataaatttactaaataggaaagtaatgcgatgctaaaaaaaggaaaccaggtggagggagggggagacccgatccgatcgcccctggcggcccctggcgatcaatcgcccaataggagtttcgattttattatggatcgtttagctgaccacatggagatcatcagaaacttcgtgcagtatatttgtaggttgagcttatttaaagctagcactagtatttatatggacgtgactagacagctagtggtagctggtttgtctaaatcagctaccactccatatataagagaccctatccacctatacttcaaataaaattttctcttaaactacttatccaatctacgatccgattacaccattgtgttcgtaacaattaaatctttataacaagatctcacatgattatattttgatgaaaaattataaattacttttataatatatctaaattacttttagatttcactgaattacttcttcgacatataaaagtaaattcaataaagcttaaaagtaatttatatatattatagaagtaacttataacaaaaggaaagtaactttaatttatgccttttttttcattggacgtgactacacaactagtggtagctggtttatactccatctagtgtttcctttcaacttgaaaaatgcaatagtatgtttccgttttgttttaagatacttttataatatatgtaaattacttttagactttattgaatttacttttatatgtctaagaagtaacttagtcaaatctaaaagtaacttatatatattataaaagtaacttatgtatatatcaaaaataatttacaaatataaatattttttcatcgtaatataatcatgtaagatcttgttgtgaaaatttaattgtaacaaacacaatggtgtaattggattgtagatcggataagtaatttgagagaaaaaaatataagaaggaagaaaaagacatgcatgtctaagaggaaaaacaagcatgcacgtcagcacgtgtagcagtccttctggttaacgctaaaccgagaagcttctcggtttagatttttcctatttatatatattgttcttacaaaaaaaaatacactaaatttgccatcaatcctacgtgttctgaacttctatgaggggaaaaaaaagagagcagacatggaaactaaaatatcctatctttcgaaaatcgaagtccataccatttcctaaattaatgactttatagaaaccatgtttctgttagaaggatgtattaaagaatacaaggaatcatgccactgatacgcgtccacaaaatactggtaagaattcgaatcaagatctgtgggataaacaaggataagattccaatctcacagcagcaccgcctaatattcgccgcatcatccaatctcacgctcacaattgtcaaaatactcaaatagaaatagaaatgctcaacaactgaacaccaccatgtacatccactaggccactaacactaactagattgtggtgcgacgtcacgcgcgtgcgcaggttaagccacctgccacctaccttagcacaccatgcagcctagtttctgctgagtggctgctgactttgctgagtgctgagcagacagcagctgccactaaccatttgcctcagtattcatctcaagaacacatttatcaaaagcacaggtggaaacaattctgatgagcgagatttgcgattgcaaaacaatagcaatgtaagttcaatgacaatattacattattacaaatccaaggattatacaggcctcaagatctgaccaaaacaaggccatagtatgatcctcgacaaatggtgaaagggagaaaaagaatactttgggacttgatataccactatagcatgcctggtaaccaaccttatacccatcagtacatcaagtatcaatatcataataaacaaaataaacaccgctaaggtaaagaaaagaattccgaaacaccaaacgagtcttcttttttaacggggttaattaacaaaacagggaaatatttttgaccgatgaattgaagctgccggggtgcgattctacctgggtcggtcttgaaacgaccccaatcaaggtacttcaatctttcaacctactggaacctcaataatgtatatgatttacctcaataaagtaaagaaaaccaatctctgaatcaccaccatcagctatccatccttttgcttgctgaccatcttaatgaacaggaaaaaaattactccaaattcattaactaagaataataactccttgcactttccaggctcattcagcgcttatgttgctagactaccaatatgctgatcaagctgcatctgttcaagcaatgctccaataacagcagcttggtcatgcccatccagcggggcattcagactaggaccttcaccgttgcttacactgggaggcatcagtggtgaaggtccaacagagtttatggattcagcagtagtgacttgcttctctggtggagattccttaaccagtgtgtgtacccaagagagatctggatcatcaccaccagatctcagctcaaacgatgatgaccggcgaagcttgcccaattcttcaccattaacaccccagtcaggtgtccctgaaggtgatccccactttgaccatgatgagcttagaggggagccaacaacacctgatgctcttgcagcactcggcccaagatcacgagaactgagacttctcattgtctgctgttgcttctcacgctgagcaagagcagcagcaagatgagagttcataggggacccagattcaacacatcgaggagacatgcggccaggggaggatataccaagtgatgcttgcaacagagatgagtgtgaaggcaactgctggttgtccacagacttcggggagaagactgtgttgattggtgaaagaagtgcctgctgctgttgctggaactgattaaggaaagcagccttgtgagatggtgaaaacataccaccctgatcagcattactatacctcggggaagagaccatctcagcagagaagagatcatccaagtttgacggatttagggacttggtccgagacgtgtggtttcctgttgatgaaccaatacgtgaatagcacaaatcatttataagctgtgaatcaatatcctgcatcagggagtaatcatcagcaggcatatcccttgcactaagtgaggtacggagccggctcgactgaaggctgctgcctggaaggtgtagtgtcggaacatttggctgctgccagcccaatgaagggggcatcccattgcctgaaggggacattggtggtgtaaatggggacatgactgctgaaactgatgatggagaaccaggcatcaagcccattgctgcagccatctccattgtagctgttgccgaggctcttggggatggtactgcagatccagtggaaacatatagtggtcggagctcatcagttgtatgcgcaaagaaacagacacggcgattacagcttgtgccatccttgcaaaggcgagtacggtactgtgctggatggagccaacactcgaacacgccatgagcatattcacacatgtcaccacgccggcaaactccctttctaaagtcggggcatggcacacagctgtagtgatacttgcgagggtcccgacgccgtgcgttctcccctgggtgaacaaacgggcactcagtccaatcatgtgagtacgcccgcgagcatggcctgatcttaaatgagtacatgcggaactcatcggaagcatagatgctgttcttgatatcgggaagggacggatccactggatattctttcttttccgatgtcacaacccttggaagatctgcaaactttgtcgtcatcatcacagcagctgatggagatcgtgcatcttctgctgtaggggatgatacaggtgacaacatagagtttgcggcccttgtcaccacccggagaacgccatgcccagcctttgggcatccaagaagatcttggagggcaatcttggcgtcaaacatctttggaggaacagagatcacatcagctggacgatatccggaagcatccgtggcatcagcatcagccccagcagcaagcagcagcttgacggcctccacacaagacggcgagccaccagacgccgcacagtggagggcggtggtgccgtcggagccacagcggcgattgacatcgacggacgggagggacagcagcaggcgaagcaccgcgaggctgccataggtggccgcgaccatcagcggcgtgcggtgctcgaggaccttgcggcggccgtaccagaggcccgcctcgtccgcggcggcgggcggggcgcgctccagcgcgcggcgcaggccctccgcgtcgtcgtccgcggcgagctcgaggagccccgcgaaggcgtcgtccgtgtcgacggtgagggttttcgccatctcggcgacggcggccgccgcggcggcactcttcttggtcgcggccgccagcgccaccgccgcgccgactccgtcgacgccggccgcggcggacgcggagatcggcgtgccgttcatcggggcttgtcggatcggaagaactgaagccatcagcaaaaacatcagtcaagaaaccagtcaagggagtccaaaaacagcacaagaaatggactagaaaccaaccgaatcggatgcacataaccagaaccgacgctacaaaaatggaagcgtaaacacgcaaacaaatccccccaaaaccccaccaaaaatctcctccccaaaaccccaaatcttccccttagatcatgagacctccaccgagccaagaaacgcaaagcaaaaaaaacaccacccgctagatcggagggagcagaaaagggaaagccccaaactgaccttaataacctcgcagcagcagcagcagctcgcgatgcggcaaaccatctcaccacgccagcatcgaccgaatcggcccgaagatctccgcagcccccatggcgaggcaaatcgggggggggggggggggagaaagcaccaaagatcccgctataaaaacaaataaaagaatcccacaaacctcccaaccaagaacggcgcgcgcctctcgcttgccgaggcgttcgggggagaaggcaaagaccgcgcgccctgatctagcctgcttctcgcgattgctgggggaggagaagcatggggcgcggaagcgagagagagcgagagggggtgggggaagaaggggggcagtaaaaaaaggggaaagtgatgagagagaaagcgagtggtgggtgtggagactttcggagttcccgcagtacgcactctctttctccctctatctctatccgcagcaattataaccggcgggtgtgggactgtggttaaacagggagtgaaaaaacaaaaaacgggttaacagtgctaggcacatagaatatccttaattaattaattaattagttagttaccaaagtttttctagtatgagtactagaaatatgaagaaagtttggtagtagtactacattttgtaggaagaggttattatcacctattcgctttttaaaggggttgggtacaaccttgtcgtttacagcaattgaacgtattattgcacagtgttgatagccattttaatttgggatatgaagaatgctatatgtattatttttttttcttacaaaactcttattaaacacagatgttgcctgtggatatgttgtatgagttgactagacgagaagagtaaagatttggttaaaaacttaaaagtgtattattaattcttatggtatcgattaagtgaacaccaaaactaaaagtctatttttcatacagaaacttcccgtttatatttaatatcaaagataaatttgattcatatatatactattatagaaattaaagatgcttttaccagtattttggtacgtcatccgcatttgagttggtttttaagttcgttcacttttgaaaatacatgtatgtgtttgagttggattttatgctcgtttgtttttggaaatacaaaaggagtcgtataacaaatcattttttttaaaaaaaaactcatgctaactttagatgaaatacggactactaattgcagctcacgatttcctaaaaaaatattcaagcgaattctcactgtgaattttacctaactaaaccttataacaattataaaattaaaatagcatttatccgttgcaacgcacggatattttttctaggaactataaatttactgtattagaaaaatatcactactattcgctaaacatgttgtgtgccagtgaaaactcctaaaatttgaattatcgttgtcacgtttccaggcatcttctcctccaaactatagagaggaaaaaaaaaacatcaatggtgctgcgacgagcttgccaccgttcggagacctcgttagcacattgatgagctcaacggcaccggtaaatatgcttgtgctgtggtaaaaaccgttgccggacttgccatctccgagatttggccaccgccatgtcgagctcgctgtcgttgcacatcctcccccttctacgtcggccgccactgttgcatgctcgttgtactatcgatattgagcagcagttgtatcctcctccttcccgctacagttttcgttaatagtaatgatttttttttctagtaggacggattttgtaatgatatggattaattttacgctatatcaaagggaacacaaatctttgaaaaaggcagtttctatatttgaagttaggcatgggaaaccgaatcattcctcaaaaaagttgagagtcagttgattcatttgcgcattaatttccatgacagcagaaattaggcacagatctttgatgtccttcacaaaggatgtttaagcagatctgaccatttttctcaaagaaaatgtcaaataaacctcttttccagcagaaaatgtaccggcaggcgtgttgtcaaatcaagtacactcctcgagccaccatagttttctcttctttctcagacaaacagtagcatctcatctactccggtgaagctcgtgccgcttgagttgagaagctgtcaaaaggaagtacttccagctagaccacccatatacacacacacataacaaaatatccataaatctctcactaataaagtaccatatcagtttaccaaaccttacccaagcttagtagttttacatggcaaaaggttaaccactccggcacaaagaagcgtatcgcgcgaacgatctacgctagtggggaaaatctgatagcgaccccgtccaggcatcgcaccagtgcccggtcggcgaccacgacgacgactactggagtacgtaaaaaaccgtagcaacaaaccggcccacacaagcccccccaccgccgcttcccgaggcgactccacgactcgaccacggcctctgccgccgcgtgcagatcggtccgagccaagccaaagccgccggcgcaacaccacgagaccgatcgctcctaccacccatgacatgagatgatgagaggagacgccatgagtgcgcgtccctttcgcggcggggtctcgtccgctctcgctctcgctcgacttctcgaaatttccgacgcggacgcatctgtcgcgtgtccgcatccgcgtccccggtgttttttcaccgcaagggggaagggggtggcgccacggttggtttggcgcgagccggggtgtgtgtgtgtttgtgtcggcgtggggcgcgcgtacggcgcacgtaaaaacgcgcgtggtccagcgggggatttgggcgcgatcggcaaactcctgtagcgtgggcgtggacaggcgccccgcgcgcccggcaggcggtggccgtgtggtgtggtgtggcggttcatccatcctggcgcgcggtgcgaaattccgtcgcgcgcgcgatggcggccgaggatatcacggtctccgggggtccgcgagctgctgctgctgcgtttggggttggcacgcacacatgcagcgattggtgccgagcaaaagccgaacctgctcgaaattcggttggcaattgattggggagtttgcctgctcggtttgctttgcttcgctttactatttgcttgtgcgagtgcgacactggcctaccacgagagcgtggcccggccgctggcctgcctatcccagggaagagcggagctgccgtgcgtggcaggcaggcagggccggccgtgctacttgaggagttgaggtcatcatgtcctgcccgcacccagacagcggcactgtgttgacacaaaactctcacaaactgcgggctactgctggctggagtaggagagtactaatattcttcttgatcaggtgcgccagatagccagtggtgttgtatgctgcgaacagtctctctgcctttctgttagattagattagttagagattagcggaagagatgctgatagcgtaggattgagacaataacccaagacccatggcagcgcacgtgtttccgcaacggtatagctaagccagccacaacggggtcatgtgcgcaggctagagatttcggttatcctgagcgaccggtgacacggataattttgtttataatcacagggcaatttgctattgcaactcggctactaatcctagttggatggactaggtagcaaggtgaaaaacaaccccccaccaatgctgctctccaatcagtttctctggcaggtctcttttaatcatcaacatttcagaaacatgcatgccctaccaatgcaagcaaagaccccaagctagtaccatatgaatcatagcctcagggatcttctagcagctacatcttcttccaaaatcaaaagttttctcaattagcctagttttccgtctatatccacaaaataaactaaaacctaaaatctaggaaattcagctattttagattcttagaagttgtctaccaactatcaactcctcggaattttaagctactcaaatagagtgtttctttagagagagataggtattggagttaggcaccacaatcagaagagcaaccaacttggttgtgtggagtaaacatcatatgcccggcaagttcggcaaggacatggtggtcttgcccctcatcgaatcctttccgcttctgacgtgatgtagtacatataactatcattccctagcgcatcatgctgattccagggatttgggctggattggtggcggcccagatcagcttatctgttgtagctaaaagttgaaatttaaaaaatattttataaataattttatcataatttattggtctttaagtcactaaggttgtgttcgttcacgcagatcaactgaccttttaaatagtgcggaaaccagagcaattaattaacttatgattaattaattattataagcttaaaatagatttatttgaacttttaaaaaactttcatataaaaggtttttaaaaagggttaattgtattcataccactgcaaatatgccaacttaaaaaataccactactattcagcatatcggttatgtgccactggaatatgggaaaattggaaccatgccactcccgtccagttttctatcacctccgtcatctctttcccacttcattcgcttctccgccatggacgccggcgagccctccacctcggactcgctggtccttgccactgccaccaacgatcgagcatcttgtgtcggactcgtaggtgcacttctcctttgtttccgatcgagcttcttgtgtctcatctcatgccttgttttcttcctgctcgcaggttgagttgctctctgaaaaccctgctgcgcttgccaggtaccctgtgggcactgagtacgattgggaaggtatacaaagattgagagatgacgaacaaatgaactagatcctattaaaaccatgggtgccaccaatcccgccgcggagggcgcgtggaggggaacacgacgtgatgccaccctgcgccgcagccgccaccgcgatggcgcagtcgccacgcagcctccacacgctaaccagcttcggccgcggcgccgatgacgtcgagatgaggtcacgcccgcgtccgacgtcggtgacgcggagggtgccgggtccgacttcgacctcgacttcgcgttcgcgccgccggtatcagcggccaagttggtgccggccgacgacatcttcgcgcacggccgcatcgtgcctgcgtacccggtgttcgaccgcaacttcctcgacctctcacctggcgatgtggcagagcctgcctccacggcagcgccctccaccgacacctactgcgcgtggacgccgcgctcggcgccgagctcgcccagcctcgacatcgcagcgagatcaacgagggggaattgcaactccgagacgacggcgaagggtgttcctgctgcatctacagtggtggagagagaggggaaggggaaagagaagagaggggaggaaggtggggcccatgtgcggttggggctaattgggatttttgacggaaaatgtgatggagtggcatggttctaatttctcccgttttgagtggcacatagccaatatgctaaatagtactggcatttttttaattggcatatttgcagtggtatggatccaattaaccattttaaaaacacacaccgttttaacattttaacgctaaaaaaatagaaagctatagtttagaacgagagaacacttcaagaacaacataagatgcaatctaaatattatgaatagctaattaagcgtaaaagaatggttgcgatttaagtggtagatctaatcaaccgataaatcaatacaccaactattagaggttgtgttgaaataattctccgtcacaagatttaatgacggttctataaataatgtgctaagagcctgcagaagtctctatgatgaatgaaaagtaaccaggaagtttattgtgagatgtaaaaaacaataaaaaacaaaatagcaaatgttccaggatcagttcataatatatgcacgcttaatatattagtctgtttgggccgaacacacatactaaaacatacacactcaacagtttcgttttccttctgctttatttgatcaatactcgtgcacttatactgtttgcatggcgatgaacatgcttgcttgtagtatcatcgataagtttccctttaattttcttctttacatctgtttaatttgttcaattttattttattacagctaatattttaagcgtaatggaatcattctttgttcgatggaggtatggttattggtttatcacacaccaaatctttctaacaaaaagtcatgacttgtaatcttatagtctctaaactatctatatgatgttctaaatgtatacggtaagaaattatgcagggaatgatgttttattgatcatttaagtgagtaccacaagcagtatgtttattctacttgtttattttattttatataaaacatgtttactctattaactaacactcccttctcttttaatttcactattctcttctaatttcactaggtcatgagcaaccgttacaacagatacttcaccctatatatgaatttaacaccggcataagtttttgttttatcataattgttgtgttttctagaagttaaaagatttatatattatttgcctatttattttataatataagaaaaaaataaatatatttatgaaatggtttatgtcatttagtttttctatctattatttttagtttctcgaaacatatgatatgtggtaacgatacttgtcccaaataatttgtaaagaattttacaaaaaaaaattcatctttttaatttttcttttctcctttttatgtgtttgcattggtccgatcacgcactgttggattgtggtgccgtgtggcccatctacacacggaggagcttttttctctctctctttttttttacaattcaccatagtaacttgcgtgcttgccatttttatagagagagagtttcttaccatttttatagagagagagagagtttcttacctggtgctctttccaccgattgtatctcgcctctttccaccgattgtatctcgccacgtgtcgctcaactaatggatggtgagggtagccaatcagctgacattaaaccagccaatatgagatagatagatagatgcaaagcgaaaagatattttgggaagtctctagaacatggatggtgtgcattttgtttgcttctcggtttttttatggatattctagatttatatcaaagatgatagataattgggtagtctataggatttatgtttttctttcttttggctatttttcatgtatagtttttctagatttatctcaaaatttatcaccaccatgtggtctaatgagatgctcaagatgagccagctttcgaaagatagatgggtctaagaaaataaataaaaaattttacttacaatttataatcggttgcatgtgaaccgatgagactgcatatagcctgccagaactaaccgatccaaggaaaagcaacgtcaagaagagctgcgtattggaaccaaatagatacagattttggttccaacacctgaaggatgtaacgctcgtataatgtagagagattcttgagaagcagaattttatttagtcattagggcctgagatacattccaggattacaacagcttttagggggctactacaggcatcactggttacatgcatatacagacggtaacacccaataataacctgaactcctgaaggaagatgataggatattaggtcatctaggacaacaattacgctggggttgctctgaatggaagcaaatccccgggtaactaagaccaacaaacacttgggttatttacatggattacatggataaggcttgagcatgtcgagttgtgcttcatacgtcgtccacgtcgcttcccccaacatgagcatcatgtgtaacaaagtagtggctgccatcaggaccagacaccttatacctgcttagcgaaaaaaggggatatggttttgaattccagagtaatacaagggcaagcggcttgatgcataactctttaatgttaaattgtagagcttgttgaaacacagcaaagcaatatatgaggttaagaggattacctctctaaaataaatttcccttccttgtacctctggctcttctcatgtgcagcttcctagagtaggggcaccataaaacttagatgctacgcaatacaacatatatgacaacataaaataatcacaaatcttacatatttccatccaacaatggatccgcagccaacacagaagatatcagacacagtatgcattccggttatcatcatgcgatcctcttttactccagaagtcacattgacactgcccacaaccaacatgacttaatcaaaagagtataatacatgggcggtccgtaaacttggaccagagtatcatctatgtctgtaaacttgtaaaatgcacatctagattgatccccaatcttggtttaatctatcacccaaggtccaaaatgcagatgacgcagcttcgatgctgatgtgattatccacacctccacggtagctagacttttccatttaaacccctttgctataatagcccccaaatcgacttccactacccacaaatcaacaaacatgtatttcctggtattctggagattcatagtataagttatgcaccaaaagatttaactgggagcagcgggagccaatttagaggcatactgtggtagaggggcctaaatgcaaattctcaccaccgtggacaaccatatcagtgcctgagttgcaccatctatactttgaactttgaatgggcctaaatgtgcattttacaacttcatggatctgtacgacaccccgatccaagtttaaggaccggctgcatattttactcttataaaaacttttggttcgtagaatgctctagagttatatcatgcaactttgtatttgtaccaaatagtgagatatatttcaaccaaggacattaatttgctagggctaccaaatactccatttgtttcatattataagtcgtttaactttttcctagtcaaacttctttaagcttgactaaatttatagaaaaatgtactaacatgtttcaatacaaaacaaacatattatcaaaatatattcaatgttgaaaattgctaattttttctattaacttagtcaaacctaaagaactttaactaagaaaaagtcaaatgacttctaatatggaacggagggagtactacatttattgatctgaatgatggtgaactttacataacaccgtaaaactgttatcttcctgtaatggtaaagaaccacaaatttattttgctgcagctgaattctacagcaacactggtaccttccggtactggactacaaatggcagtctatggagacatgtatatagaaaattacagtggtggttagtctgctcttagtagtaagcttctattaaagtctatccaggacagctggtgtacattaccagagatcttgactggctgttcaatagtccaaatctaacttcaagaaaagcaagttttcaatattgaataagagttcaataataggaaagggaatggatgctttttccatatgtggataatgtgcccatctatcattcctttttccaataatgaacttaggcatcagattggtggtgaagcaattagggaagttgtcacatacctttactcattaataaatagaatcataactacagaagttccacatacaattattcttagtactgtgttgtatgcaagtagctttagctgcaagggatgcagttcgatatcaacttcacacatgccaaactttgacttataacgcaacttcttctaataggggttgtattattgcataggagatcaatttcaagcatattgagcgtcattctatgcaagtaagtggtgtaactttagctattaacaaagcgcaggcaagggataggtcttgtgtccatccatccagcatctctaacatagcgcatatccaccactcctcgaaaagagtagaataacaagagagtaaattatcacaaatccttgtctattggactctttactttttttccaaagagaattcgggtttctgttttggccattgcctatttattggtcaccgtaatatacgcccagcgatctcctgtgcacaatccagtgcaattacaatttagaggattccctgtctgcttggtttaccatcttccttatcctaatagcggtttcaagttacttgtactaccaaagaaggcagtcaaatcttaaaacagattcgtaattctcaaatttttcattgtgttaggaaggaattggctaggctacccgcgtctgaacccaaacaaggtgtggccgcagtacaaatcgctttcaatctcgccttgtaaaacgtataattagtggcctgacgaaccaggactcaagaaaagaaagcacagtgcatttcccattttcccccaaattccacacatatctcccggcgtacgctacctaaagtttgacgagcgaacaaaaattcgagggcaagatgaggcccgggaaggagaggccacttacaccttattgaagaggtacgccttcccgtgcttgcaatggaaggactgcaagaaatggaaagcagcaaccatgaaacaatcgctcccacatccgccgtgctcgccgaatcaaacaaagctagccaacaacaacaacaacaacgagaagaagaagaaaggagggggctgaagaggcgaaccttggagatgatgtcggaggagaggcccaggtgcgtgtggcagtgcttgcagctgtacaccttcccttccaggtgcatcacgaacagccgccccatcgcctccgtctcctcctccctccccctcgattccacaccccgatcccccagagcgccgccgcgatcggtgtccacccgactccaatcgcgatcgccgctagtccccctccctcgccgccgctcgttcgcctcgaatccgagattaggattgcttttgtttgtggggggagcagtctacgcgaggaagggggtggcttgtctgcagcactgaccgggtgaccgaagcaaaagcagcaactggggttggggatggggattgggttgatatggggggtggaggccgcgtgcgtgggaatggacgggggaggagaggaatggtaattagtatagccaactaaacatatatagccaatttaatagctaattcatacaatagttatttactataatattaatatctggtccatctgtcatacacatatttcgtcttgaagttcgtgctgcagttggctacagatctgtagccaactactcttctctcttctcgtttatttctttaaaatatgtttatagttggtttatgatatgctattatatctgctataaaggtcctttgaatcgtaggaatgggaaaacggaggaataggaaaaatgtaggattctgactggaatacaagtgtaaaacagaggattgcaaaacacagaaaaaacacaggagtttccgtttgattgtaccacagaaaaaacgcaggaattagagaaaagatgaagactcataggaaagtttccatgaggtagaacctcatgctagatttcttccaaaacttacatggcattagacattacatagaaattttataggattttatagaatttatttcttcgattcaaagggctgtatagaaaaaatttaaaatccttgagaattcctgtgaatcaaggggcctaaaagggatcgcgggggatgcgatgcggtgcggtgctgtgtccgattgcgtgggatggcctgggttgcacacgacggcacgagctaatttgtgcggggggaacaagtacaactgctgccgtgctggatctggtctgcccacctgtggattttcgttcctggatgcagcaacctcctctcgtttttcctttttccacgtaaactcattaaggctgtgttcgttactagttggttggaaactcatctcctcgcacagaaaacagagcagtctattagcgcttgattaattaagtattagttaattttttatttaaaaatagattaatttgatttttttaagcaacttttgtatagaaactttttttttaaaaaaatgcaccgtttaatagtttgaaaagcgtgggcgcggaaaatgaaagagtaaggatgggaaccgaaagttccgaacacagcctaaaggaaggaaagaaaatgtagtactcgaggagtgtttagttctgccaaacttttcaatttgccctctcttttaagataagaaccactccttccgcccctaaatacaaagaattattagtggatgtgatatatcctaaaattataaatctggacagggagtatatctagattcatactcgtagaatacggagtagtatcttttatcgaaactatcaactctatacgaaataaatcaaaggccatattacgtatgatatattagagcacgcgataaataattcaccattctatatgcaccaaaactaaagttaagcttatgcatatagagtaataaaaaaaaattagacatataattaataggcaaatcggatctatgccattttaaatgtgtggtggagagacaaccgaagagtgtcatttcttataaaaggccatgattatgacttcctttcataatctacttcctctatgttatcaagtggagtatttgctttaaacatatatatcctcctttctaaagaacattataatacataccctatacaacgagtaattctacatcgctacatcctatataaagccaactaatatagcataaacaaacgcctttagactctcgaatggaaaaataatattttgattttcaactctcgttgtctaaaattattttagccattacatacttaaaaaactatcatatcctatacatttgaactgaacttttctatggtaaaaacaagtataaatgtcttggaaatatactcattactcccactgtgacatagatccatcctcataaaaaagtagagtgctaagaacgagctagccatcaatggtttttaataaaagtagatgaattttaactcgaccaatggcagagctactaacgtatacaaacctacacaataaagaacattttgttaattgtcatcaacttgtatgtccatcctcaaactccaccattccaagagttaactctgttataaatccagcataaaaattagctgtgaagaattgaatacgggttaaagcaataagtctttgcctcacatgagcataaagttctcaaataagatgaaaaaaatgtactagtccaatttgatgaactaatgaacattagtccaagcgttttcttcagaaatggaggataaaaagtatttaatgtctctgttactcaattatttttggaaaaataaccttgacaaaggatagtggagtacaaaattatagggccactctggcaaatgtgtttgaaaaatgatatccacccaccaaaggatatatcccaatactatctattcattttcatattctaatcccacttttcataacctatagtattcgccagacatgtcctacaggtaaaaacaatattatagcctggtaataaaggagttaccatgtgttcttgctagccaaagttcaagttcccccaaggcctcaaccgttactttttgctcaaaatgttttctctcttatcattaatgctaagtttctccttaatatcccacttttccttttctaaaaaaaatgctaagtttctccatagtatccccaattttcctttttttttttaaaaaaaagcatgtcccacagttcaaactaataaacgacgtttgacaactcttatagaaaaaaagagtcacaaacacaattgccgccacatccaattggtgatgtccgtacaaacggacggatcgcgcgaacgcacgatttccgtccgcggagcaggaccccaagccaaaactgtgaactgcccaactcgtcagagacccatcgctcgaaccatcttgcggcggaagaaaggaagcaaagctgtgagacaccaaaccacagggaggcgaatcgcccggagtccggagaccccggaaccagccacggccatgtggcggcgggcggcgacggcggcgctggccctgggcgcgggcgccggcggggccgccatcgcctactccgacgacccctccgccaccctcaagatctgcgcgcacctgcccccgcgcctcctccgcgacgccgccaccgccgccaccatcgccttcgactaccagtactccctctggggcctcgacccgggcaccccggcctgggtcagcgccaagcacgacgcccacctccgctccgcaaaccgcctccaggagctctgcttccgcaacggcggcatctacatcaagctcggccagcacatcgcccagctggttcgtgctacgggaaatcgggctcctccctttgattcgtgtgacgtctttgctgaaattttggttgctgcgtggagttgaggtcgagctggttgtttgtttgtttgtttgttccaggagtatgttgtgccggaggagtacgtgcagacgatgagggcgtcgatgctgaagagatgcccggtgtcatcatacgagcaagtttgccgagtgtttgggaaagatatgggagaatcaccggaaactgttagttccttgccatcctcctccttgcattactgtctgaataccacttctatacctttgctgtgggaatgtaggctgctgctcaagcgcataacgatcgttgaattcacaattcacatgacaacttggtccaattctggcacagactattgatgcttaaacagattagtgggtttatgggctggattatgcacgggcttgtcaatttggaagcaaatctgacgattttttttctctttgtcctgatgtgtaggtttttgtagaattcgatcctgttccacttgcaagtgcttctctcgctcaagttcatgcggcaagaacacatgatgggcaaaaagttgcagtgaaggttgcaatctagagaaacactgttatttgtctcgagtacactctcatattttatttgggactcttacattagcactatagagtttgaattttgtccagcatgctgtcttcctttaacatgttccattcctatcttaatctcaggttcaacatgatcacttgacagatacttctgttatagatattgccaccgtgggtttgatagtgaacactcttcattatattttcccttcgtttgactacaggtacccctcctaatttggttgtattgtttcctttttattgacatgcatgctacctcaaaaacttatggttagatccagtttagctcctctttatgggaactatatgattatgcattggtaggaaactgctagccaacaaagtcccacatctttatgggtttactgttgcaaattttgtttctgcaatccttgtctgttcatgataattcctggctcactgcttttttttggtgatttattgggaagcggcatgcctatgcaaaaatcatcaatgggttggtcaaacacaataaaaggatattatcatcttggatagttacacaagatgtttggcatagttggtgtatcagctcaagattaaggattagaattatcgattttgatctttcaactcccttgttatttagttagggcgcttaggaaggatgagtttgatgctatccatacaattccaaaatttaaaagttgctataagcaatgcaaatatagtttcttaatgataaacatgtctacattctacagtatgtgagttgaataatatatttttattactgtctagtaagttaaaaatagtgccccattacattggaattatggttcttactttgattggatcgttttttttttccttgggaagcttatgttacaacaaaaatcatagactggcatcaaaataaatgaaatattttctcttggcaatgttggatcaacggtttttcaaatatgaaaccaacaaaaggactgtgattactttgaatcaagtcaacagcagttccttggcatgcaaagagccccataactactttagggatttgcattgaaagatgcagtcccttccacttcttcagagatttttttttatggtgctgtataactgcaaatggtcatgacacatgttatgatgatttccatttagtgtaaatgaggcaaatacacacaatcctttgcattgttggacagttgaattgagctcctcacaagtggcacgtttgtgtaattatgcatttgcagtacacaattatgttgatgtgaccatagttctttcattgaaaattagtgaatctacttttccacggaaatcctgttttgcatcaaagtttatgccattaaaattggttccttgcaggtggttagtcgatgaaatccgtgaaagtgcacctaaggtacctttctaatatttcttggcaatttaacattactgctgttaacttttcttttcaatatgttctgctaccatttctttttgttaattagtaaatgcatctctggcctttacgagttgtcatcttataactttatagtccattttatggtcatggactcatggcctgttgtcagtaggatctctcgtgtttatcctgaattttatgctcagcagcatattttccagttgggtgtcttcatgttgatcttgacttttatttttttctatacaattataatatactcaagtgtaaaggaacatatttacacaatttggattggtactgatttcctctcttggtttcaggaattagatttcttgaatgaagctaaaaacagtgaaaaatgcgtgcaaaactttagaagattgtctccgcacattgcagggagtatttatgtccccaaggtctattggactctaagctcatctagaattctcacaatggagtttatggatgccaaggaggtaactgatgttaaaggaattaaagaacttgggattcgcccagtcgatgtttcaaatctagtaagtaccacagtacagtttcttgaaaaaaaataaagtgctaataacttctttacagactctcacttgacagttgtgtaggtcagtaaagcattttctgagatgattttcaagcatggttttgttcattgcgaccctcatgctgcaaacatgatgatccgacccttgccacaagatagcaaaaaaacttttggtgagaatcttgccatctagcatcagaaaagtttttatcttcgctgaagtgtatctgggactgagatctcttgtccagtaataatgcttctatgataatcttaataatgcatactggcagtattttgtcatgttattgcctcattggatgagcagatgagtttttaaatgcatggtggggtagctttttttttcttgaacacgcatggtggggtagcttcaccatgtgatgatcttcattgcagtaatatatatgttaagtgagatgtggcatgtgtatttttttgtgagaaaatgagaatatgattgttttcttaagatcctaggtggaaacaatgcatattgcagcttatatttgttggataggtcagttattgcatttgtttattacgcttatatgattttttttacttgaacgtaggatggagaaggccacaattgattcttcttgatcatggtctttacaaagaacttgattatgccactaggataagctatgcttctctttggaaggtgacaaattgacaatgttatcgcagttttttctatgatcacaactgagtagtcattactaactttatgaaatttgttgatgcaggcacttgtttttgctgatgaaaaatcaattaaagagaacagtgtcaaactaggtgctggggaggatcttcatgcactttttgctggtgttctcacaatgaggccatggaaaagtgtgattgacccggctgtcgatcatcttgttctagatggcagtagtaatgatcgttctgaacttcaggtgatttatattatgcattattaatgttctccatgactccatgaacactgacagtatatgtaactgtgcaacttcagtaataaccaatagtaccagtaactctagggtaatccatgtatcacctcctacttgaaatggaattcaatcatttctcacttttttattttgttcattgttgctcaaagtaacactgctccaaatcttttgatctttccaatagtaggaaaaaaggccaccgaagtaatatggaattgctgattatcagcccagcttgctctaaagagatcggggaccaatttagctgttttttaatctgcaatctaaaacctatttaccatatatatgatggttttaagttttcatgttttcctagtatgtttggaaactttgttatctattgccatgcttgtataacattacatcttttttttttgttcattttcaattcccgtcctcattcttcttatgatatttttctccttgcaccttcaattcatgagatgattgaactgggacatgttagtcaaggttttctttttgggctagctgtggaaaatcatgtactttgaggtccttacgtgatatgtttttctttgtcacagatgtatgcttccttatattttccacaaatctcagagcttctaaggagactgccaagggtcatcttgttgatgcttaaaacaaatgattgtttacgttccgtcaatcatgccctggtaagtgaaaaggaatcatgaccataaatatgtaggctgtcacatagtaatatcttctttcttgcatttgtcacttcccttgatgcttttgataatcaagacgtaagttgtactgcaaaagaaaataattgatataacaaggaagcatgggatagctacggggttttatcatagttgttgcactggcttgaattgtttaatatcctatgcggttataagcaatgaaccccacgaagccattataaagtaggtattatttcttttaggcttcattccctctttatccgtgttcttctctgtagaaggtcaatgcagcatcgtataaggggcactctagcaagttgtacaaaaattcgagaattaattataggtccttttttggctctgtttacacgtatgatgctttgtcaggttggaggttcttcaatggaatcatttgtaatcattggacgaatctcttctgaggctgttttggaagctaaaaggatgagtagtagatcaattctgaataaactaatgatatggctagaggaaattttactggaagctcgattctttagtttgaagttgctgttgtgttttatgcagcttaagaagttattggcctgttaagcagcagatcagcataccaactattcttggactagtgtaaaatattagaagctgtcattttagtttttctttttgagagagaaaagtggcatttagttgaaaaattctttttctctttttggtatacaccattctttttggttaaccattttgctaccaggcttttcattttgattagccacttccaaacagaagatgatgccactatgacatcgtatgtttattctaatagatggatagaattgtagaaaatcccatcactgcacagtgtatatatataactctagttccatggatccagcaaatgttggcccgatgaatatgctgtgccaattgcgttatacaagatgtaagagtaaaattgctactggaaagagagtcactctgacatttgccagagcaaatttcgtttggtcaaatttgtgttcatcgtgatgtcgatctccattttctttaccccctacttttctgctagcattttatcgttgtgctgatgttctgcacttctggttcatccttttgagttgccgctcctactgtcacgttgacacgttctatactttgtcctagaacatatcatagaccactagaaatataaagcacttaaatctgaaatacaatatggcttgtagtagttaaccacttaacgatgcagtgtgtaactaacacggtatttttcttgaaaaaaatgtttattttgaaattcagtagctcaaaaaactgccacagattgccgcagattccccaagcatttgttgcaaaatctgccacatctttgtttccgcatatttctgaagaatttggaggtaattggattatggagatcaactacgatcggaacgtatgcatcggtgacagttttactgagccgagtgaaacccagcgattgccaccgctctctgcaagcaaacatcgtcgccgatcagccgaacagtttgggctcccccgtccgccaccgttgcagttgcaggcccctcgccgccgttggccgccggtcgcgtccgccggtgcttgctcatgtgcccgccaagcgcctgccccgtgaggcacaccttgccgcactcgtcgcacttgtgctgcacgatcttcatcttgcccacgtcgctatcgccgtcgtggcttgatgcaacgacgacgccggcgatcttgtcgttctcctcgccgtcaccatgggcgaccttgttgttgcccgcgtccccgccggcatcaatggcagaggccgactcggccttaccgtgaccgcggctttcgtcgacgtccgcgtcatggcatgctgcaacgtcgtcaacgacgacggggctcttctcctcgtcgtcgtcgtagcggctgccctcggcgccatcgcatccacgctcgtcttgtccgttgatgtcggcggcgaagaagctttgcctttggcttgctggagccacggcctccgtgaccgccgtcgtcgtggcgtcgcgcgctgcggcggcaatggcggcgttcttggctttcttcttgtggccgaggacatgcccgccaagcgcctggtggctgccgaagcacctcccgcatatgctgcagacgaagcgcttggaagctctctccgccgcctctgccgccgccgccgccgccgccgccgaagccgtttgcaaaccctcgctcgcctcgaggtcagggcctctgcttctcttgccgcgcaccggcggctgcggctgcggctcctgctcctcgccaccgtcgacgaacctgcggcgcttcctgttcttcgcctgcaccaccaccgcgatcttcttgggacacacgccgcgcggaggtggcggcgccgccttatccgaaccatccagctcggccggcaacaatggcgatctgatcaggtcgacgagtcgagccttcttgcgtgataccttcccgaccccgcggccgcggccgccgcctcctgcctccccacgcggcgccattgcgtcatcatcatcagagctcccctcgtcgtcctcctcctcctccgccgcttggccgccgctgccatccagcaacgccggctggcgcggcgagaaaccgtcatcatcgtcgtcgtcgtcgacgacgcgcctcttccgtttgcaacaacccgttccttccgccccggcgtcggcttcggcatcgtcgcggtccaccggcggcgcgggctggcgtgcaaggaacacgtagcggtcgacgtcgtcgtcgtcgtcggaatccgagtcagagcagtaggggtagtcctcgccgacgacggccacaccctcctcgtcgtcgtctccgtggtgcccgcgcgcgcgcgcgcgatcgccggagttgacggccatctctctgcacgtgctctccggctgcgccgcgcggctgttgctaacgccgaaacgtgccagtaggtagcgtgcgtgcgtgcgtgcgagccctagataccgtgggtccgtggctgcagtgcacacacgaggttattatgactaataactgtggaagaacgaaaacctacagcgtttttgttacggacacgggacacggcaacgccaactttctacatctctgtccttttttactgaaccaaaatgttcagtctaattagcatagagttttgtttgtgtatatttatacttctttcttgaagcatttttgcgcttgtactagctgctgatgttgtttttgagacctaatattccatccataacaaaattacaagaccagtgccttttcatttcgccacatcggtacaaattaataatatagatgaagatgacatatgcaaggtttctagtgatctactacccccgtcccataatataagagattttaagtttttgcttacattgtttgaccactcgtcttattcaaaaaatttgtgcaaatataaagaacgaaaagttgtgcttaaagtactttggataataaagtaatttaaaaaaaataaataataattccaaaattttttgaataagacgagtgatcaaacagtgcaagtaaaaactcaaaatctcttatattataggacggagggagtagtagatatattgttcgactccatgactcatgactgcgtataggtattacagagaatactcctgtgttagtactactccagtctaatcttgttagcagcacgggaattcaagaactctgcacactcgacatcccaactggcatcaaaacagacgcaatcctcctcacatatatccacagcatcatgaagatactcgcaacgagagataacatcttcagttgtcgtgccacttgatttatcgcgagccatttccagaaagtcagtgcggccattgtacttctctagatctggatggacaatcttagccccttcacactcacaatgataacaacgaccttttaacaaaaataaacaagggaaaaaatggcaatcagttatcgtaatagaggaagaaaaaaaaatactatatcatagcttgcagaagataaggatacatcagtgacagcagcatttagcaaagcagtaaaggtatacacatgtaaagataaggataaatgttttgaatgtggatgaagctaactaactttgttattagaggaaatgatcaatggaaattgtgctgtatttcacaatgttttttatatgacaatgatgttaaggagacaaggactgagtatgaattagttagtgccatcgttggaaactgtcaaggcgatacagtcatggagttgctcatcatggtcaatctgtagttctgtactgacaccattgttagcactaaatgatcaagcaaattgatttatatcacctcagacaatgtctgagattaaacatagattcacgttttagttgttactaacattttggagcaaacagcagaattctacttccaaaaacattgcttggtttgaacaattctaggcatgaccccaccaaacaatcttggaagtttgattgaattaatttctgtggcatctcttttaattaaaaaaaagaaaccatgcaaatcaacacatgtatgtcctttttgttcttttcaagtcaagttctgcagcgtaatgaaaatcttttcagtcgatttcacaacgccatggtgaaactcaacacatagaataaagaaacatctgtaacacgctaacatcatatgatgtagcaatactcaaatggaaggagagtgtaccaggatgccccatgactggacagcaggtcagttcatcgatcacgccttccttgttgcagcactcagcaaaaaaaagtatggggactgtctgagaagaatgcaaatctcttgggctcgccaaaaagttgacgtgagaatactgagatttggatcgatgccggctatatccaggtccataatgtcggccaaacatagtataattaactatgtgtgaattcaagccacagataacatgtagctcatactcaagtccctatgattcagaagtttatacaagtgaattagataatcttgatattgacatttttggtaatggtcgaaaactgaaggggtgaacggacataccctagtcctctggttgtatttcttcagtgcatcattaaccttcccacaaataaaactttgctcagccttgaactcttcctgaatgcacgacaaagtcatggaggccctctcagagagtacaggaactgtctgaactgaaccacaggaagaggggcagaatcgcatcagattgtgcacgaggagctgcacatttaaaatcccaccagtttgaaacataaatggatctgtctgcaggggaaggggcttcatggaaaaggttgacatgaaaaacttcactagtgcatcaggatcaggatgatgtgctgcggtggctgcaaccatgcaagcaaggtctaggcccaacatgtttctctcagcatggcattcttgccttgccatttcaaccgctccccaaagattggcgcccgtcaagaacaggtaacgcatagcctgctgttcagagattgtgcaaaagcaagcgcggaggtatgcaacaagagcattgagggagcggcacgcgacacgaacaaggcttcttgagcatgtcatctgcactgaaacctcctcttgtggtggaaacatggtctcataccaaactgtgttgaggacaatgttgtgcacagggttctcaaaggggccatagcagtggccggccttgaggagccccctgtggtagcgcattcgcaagccatccatcggcaggcaggcaataacatcaaggtacaatccatagatcttgtcaagcaggatgctcttcaatgatttcatccgcacaaacggcggctgcttctccttaatctcaagtgaccgaggaagaaaggtagctccaacaaggtccactggttcttgttgctggtgcttcaccaatctgctgatgttcttgacggctctgcacgagaggcaaccttccatgcttaggagattggaagcctccccaatctgagaagcgatggaatacaacctctcgacaagggatttggggtttgggtgccacccagcaatggcggcgcaagtgagggctgtctcggtggtcagcgaggcgaagctgaaggcgtcagagctgcggtcctgctcgatgagccgcacggcgacggagaggtcggcgtcggccagccggagatactccagcgcctcacaggtgtggaggtaggggaagtagttggtgaggaaggcgacgagcgcctggagcgaccgcgcggcgacgcccatgtcgcggaggaggcggtggctcggaccgcagccgccgacgttgctggtgtcggcgacgatccgggagagcgccttccgccgccgccgccgcgtcgggatcgccgccgacttgccgtcgggatcgccgccggcgaccaccgggacgcgcttcttgtaggtgatggtgttgacgacgatgttggagacggggtccaggaagccgacgcagaggccggccttgaggaggcgcgggagcagcgccggcatcgcctccacgggaagccggtccagcgccgccgcgtagaagccattgatggcgcccagtagcttcgatcggtttcgtctcatgcggcccggtccgtcgcattcgaggagagaatttttttcattttttagatttttttaatatttaccgaaataatctatcggcaaaaaatttttgcaaaaatagaccctgccgccccagtggtgggcggcaagctgacgtggcagacggcggatcgaccgcgccgtctaccgccgtcggccaaaattgcaattatccccaatgggcggcaatgggctaattgcaatttttgccgcccataaagaggttgtgctcgtactttttgcatttgggcccaagggacccagatgcaaaaagtacggccaaacgatttttctatgttatgttaataataaataaagaagtatttattggtaaaagttgttaatattgttataaaaatgtattgaagttggttgtttcgcaatttcatatgttaagtaaggtattattttgtaacttattcgacgtattagtactcggataataattaataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaaccgctacgtgaggatccctctcctctctcaaaacgcgctttagtaaccctgtattgctctggtagttcaagctgcacgacacggctaggtggagttagaatccttctggtgtctatccattctttgtattgacatctccttggtggttcctaagaggaaagaatagatgtaaagcgagcaaagttagtaaatgttgtgagaaaataaggattcatgtaatcaaaatattcttaccatgaaatcgtcgtcaagaatatttggacaaacaaagaacgttcgacccaatgttgtaggctttatggaacgaagaacctgataacgatcaccacacctgcatcttggacgggcttcccatggagggagtgccgtagttagcacccgccagtcgctctgttgttcacgacattgtcgttcataagccgcttttctccgtaagtattgctcagtactttcggatgcgaaataccagcgaccttcttgtaaacaagtggttaggtcgagaacgggattttctgtatcgacccactcgatgtatgcgcaagctgtagtgcgggtctgccgaatagagtagtgttacgaagaataaagcgattgcccatacggaatgaataagcatatacatataataaaatacctcatggtcatagttagggcacctaaaaaagcgccttcctcgaatatcaggattcctcgaagccattagttggcatcgatcaccgcataggcagagaggacgctggcaccaaggtggtagtaggtatacacaagtatcgctacgccagttcggatcctcaacacctcggcgtgaacgtggcggggcatagtgggtacgcctaattggcgccgaaagttacatgcctgatcggcgccgaatgttacattggtcgtatgcggcaaatggcgggcaaatacttgtatcgcacgcgaataaaggaggctgcatcggtgcggcagaaagtagtcgtgcatgcgctgaaaggtatcgtgcatgcgccgaaaggtatcgtgcacatataacaacaacgtagtcattatacaagcatacaatactggaaagtgaagcaaataaacaaagagaagactgctctactggccctgccctacgccgcgaccacgcttggtcctccgggcctgtgctcgcacgtggtcctgggagtaggtgaaacgatccggtggcacagcacgggtagcacgagtgtctggcggcggagtggcctgcgcctggtcctgtgtctgcaccagcggtgcgcctcccagctgtgaggggccgatgacatcctctgtcgagcctgaagcgaagtcgaagtcagtgatgtcgaagagcaaggtggaaggcagcaagcggtccgacgaggtcccagcatggtccagtggtggaccctgactcgacgtgccggctgcctatgacgaagtcccggtgtactgccagaactgcgctgagtgcgaggtcgacgcagctgcctgagacgctgaccctgcagcctgggagaagtgggcggcctgcgtcatagcgaactgggcgaaacctacacatcgacaacgggacccttgtaagctaagacataaaatgcatataaattgattgtcgaagtaatgttgttatttttaggtacctatggggggcacaacagaaggcctagccgaggaaggcagggtgctgaacggtgcacgaaaccctgaagcaatcggcaagtgaaacggctcacatatatgtgcgaggcatgtatagaaaaatccttaaaaatacttacctccgtgcggagggggagtcggcctaggaacgtgcgcagttggacggggaccagtcggtacgggtggccgctgtacagctgcgtctgcccgagtaacgttgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaatgacgacccggttgatgtcgtcgacctgcatggttaattttttcgtacatattcgtaaaatttgacgaagagaaagatatgaaaacataaaggaatggtgcgatgcatggtactcacagcacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgagcaaccagtcctcaacaaaagtcgctaacttggcgggccagtcgccagctgactgctgacccttgcgtgagtaactgcgaattaatgtgtcatattagtgtgaatcgacagatgttgcaaattattgcggacaggtagattttaatgcaacaactgaaagcgtagtgaaagatcttaccggtgaacagcagctgggacggtcgtcggaaacggtactggaaagggctgacggaagccgaactgccgcatcacgcggaaaggtgcgtgaggctcaacgcagatgtcgtagaccatcggaaccgtagtcatccagtacgcctggtccctggtgcagagtgtggacagacccaacggcgcctggggctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgagaagatcgatgcaacgtatccgacgatggcaccacagagtacccatcgtagggtagtcgacctctggtcgctccgcgtacagtgacacctcatacgcgtgctggtccacctcagggcggccgatcgcaatcctctcagctgcccagatagaaagaaagagagggcacccaccaaaggtcgcgctgggatccgtcttcgtgcaagcctcacaaaggccacggtacagagccgccaacaacgcggaaccccagctccactgaggcacctcgcctaccgcggcgtcggcgatgctcctggcgtagtgcacgagtcccttatcgaccgcgtgcccgtgaccgccacagaacatcacccagccaaaaagccagagcaagtacgcctccaaacagcggctgtaggagtactcgtcggcctccgcctgtagctgctcaatctgcaagtgttcgataaaatgttaggcaccttaactgtggacaaaatatgtagtacgcttgtcatttcggtacaaaaacactcacggagaactgaagcagccacctcttcataggtccggtgttgcggtggtgtgccaacggctcgagcgggagatgcggtgcgcgctgtactagtgcgaaacgtgctgtcagatcgtcctgccagtccacacccgtggtcactggcccaacatcgtctcccgcgagtggtagccccaacaagtacgatacgtcctgtaggataggggctacctcaccgcacggcaagtgaaaagtgtgcgtctctggtctccatcggtcgaccaaagctgctaggagggaccggtccacagtccatcgtctggccgggtccgcatcgccggcggcagcctccaccagccgacacatcggtaggaggccggcctcacgcagcctgcaataacaaattaatatgtcaatataaaaattattacaacgcaactaatttatagtaatacacttttcgtacctctcgacaaaggagtcgtgaaccataagtagctcaccgcacgtccgtgcccggaacgtcccaagctgagccccctgcaccgcagtaaggtgagactggtgtcggtgatctatcgccgggtccaacaattgaggtgtatcctgacgtgccatctctgaaaaatataatgtttcgtgttagaacaattcaaaaagtagtaatgtcaaacaaaagataacttgtaaaattataaaatagtaataaaatcatgagaataattatggaggctatttaaatatagcaaacgttactaagggtacataacgatgacgtgcaatttaacatatatgtagagttcgataatataacataacataacataacattacgtgtcgaagtccgacattacatcagcatacctaaagacactaggtgccttagtctaacgttacatcacgagacctaaagacatgacatgtcgaagtctgacattacacgacgaaacataaacacatcgataagttcgaaacaaattacaagcaaagccacatgccaacatagaacataagaactacaccacgtagctagacgtggcacgacgatgcctaggacgttgtcgagtggaggtagtgccttcacccgtagggcgagctccatctgctgctgatcctaatagtcctgcctctgccacacttggtttctccttgtctttaggacaatgcttgtaggtgtgcccacgttcatcgcatttgctgcaatgcttcaccctgccagcctccgactcgtccatatcgttgcggatgcgacgagtcttcctccttccagccttgcctcggagcttcgatgggtcagaaatattgagtacttcatcgttagtctctatgaactccccagctatgccgaacccataaatctcgccgctccatgtatgatatattgcttgcttactgaagtactgtgaaacatatactgcatctggtatgccacactccgctgcggcagcaatgacatgggtgcatggcctgtggagcagcttcggctttgcataagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagttccaaacaaaatgctgttgttcggcatagagggaagaactgcctggaaccgatccctaaaatacctgcatgtcccatgtaaaataaactccactatgccaactagtggcagtccatggacaccgcgcatcacccagttgtaaacttctgccaaatttgttgtcattatttcatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcatcggtggtcgatggagccgctgcacgctgatcactgcatttggctatcaactcatctaatcttttccaaagctcattgaattttttctcctggttctgattgcatagcctcttaaacatgttcatgagctccttgttcttgaattgcttgaagaaattagctcccatatgacgcatgcaccacctgctctgtacatcttcccactcaccagggtatcctcgttccatactcccaaactgcaactcttctatcgctcgcagaatgccagcgtgcctatgatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggcctcgatactttcctgtcatgaatgtcccatcaatgcagagaacaggacgacagttcacgaatgccatcttgcatgcatgtagagctaagaacgccctttgcagcacactcttgccaggatgttcaattgaggggaatttcttcactttgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggacaaccatctttttccttaacacaccggttggacttggcaacccaaaactctctatgaagtgacactgcaaaatgttttaccgcctccttcatatcttctgctctactataaatcgctccctgaataatctcattttctttgtactcccatctcacactatcctcttcagagacgaccagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacacccccgtcctctcgtgcgttgacctcctccacagaagtctcatttacttcagcacttggtccctcgccatcatccatgttcatctgtacacatggatccttcgggtgaacaaacggaaccatagctagaggccacccacgttgcaatgcattttccacataccatctccatactcgagagttttgaactggcattagttcccaataaaaacccttagttgcccgacttactataacattgattgttatgtcacttgtctgtggatcaactctcaagcccctcattaaccatccttttattgaaggtacactcctctcagccggtctatcaattcccctttctgatacaataaaatttgacagatctaccccagttggcccgtaacggacgtttcctgggccatggtaaacttggaatatttgtttgtttgacatatctgtcaacgaaataactagatcatattactctttcatgcaataaacatctacaacgcaatatcttcttgtgtatgccaatgcaacggtaaagtattaattccaaactagcagatctacgtagttaccgatatctacaatacgcacttctagattagtacaactaaaaccctaaaaatataatgtatttattcaaacaaagttttaaaaaatacacactatttaactcaatagtcacatataggatctatgaatattacctgaaatcggcgtctgaatccggcagggcttcgccccttcttctcttctcctcccctttcttctttttttttcactggatttgagggggaggaatgagggctgggggctgggcagcaggccttttataggcagcgaggcctgccgcccggccagagggcggcaaggggccgcctgcaaaatggccggccccgactggcttttttgcattcgggcccctggcggcaagggctttactgcaaaaaaccctccctccgtcaccgcccgtccctcccccgtttgccacgtcagcttgctgccccagaggtgggcggtagggtctatttttgcaatttttttggccgatagattatttctgtaaatatttttaaaaaaatctaaaaatgaaaaaaattctcgaggagatggccggggcgggctggccgccggtgaggtttgccggccatgatcggaggaagaagggctcacagattgggaatgatcgccgttagggaacgagagagatcgtgggccgtggggatctctactcggctcgttcggatgggccaaaaatctagcacatccacgtctgtgggctgggccctggaagaaaacctaaacgcgattccatggacttcaatgctcttacatatgtatttgacatggtctttggcaatgtttatgggaggtgttggcggtatggcatgagacccttcgaccaaaatctgccgaaggttatgcgaggggtggggatccaagcccgagacgtcaaagttagtcggggcgaagccccccccccccatggcgaagactatggaacaaggacggcgagaggcgaaggatcgtgcgggtactctactaagccggaggcctcttgggcgaaggatgtagggcgaagagtatatgtcaaagggagacgacttcgccaaagcaagcttgcccccgcgagggccgaagaagcctttcccggcccatcaagcctaggggccattgggccgacgatcgcctaacggcccatcaggagtccatgaacctctattacactatgtacccatgtaaatgtccctttcataagggtaaccatgtaaattcccctgtataaccaaaaccctagtagtaagaacctgtaataggggctataaatagtctcatagggccatgtaatagggggatccaagaaaaattctctaatcaatacactttactttcaaccactgttgagtaaccacgtctttcgacgtatgcagttgtcgtttcgacaacagctggcgccgaccatggggatctccgagcgaaaccactgagagcgaatgccaccgaagaaggtcgtaaaggagaaggttacaaggcgaaaggaaagcgacgctggggcggatatggccgctgaagagggagcagagccttcggcgcctgtcgccgaagatggaggagcaccatctacttccgcacctgcgccatcactaccgccttcggcccctgctacctctgtgcaggtgccgaacgcggctgacatggcgaaggcggctgcggcggcgagggcactccagaccagggcggagatcctttcgacaagtcaactgctggtgccccaagccgctccgtcgcagccggcagcggcccaaactgcgcttgccgctatgcaagcccaagtcaaccctgaccccgagacacaaaccgaagccgacatggaagccatgcgacagaacatgacacgactccaagacatgcttcgccaaatgcaagaacagcagcaagcgtacgaggcggcaaggcggtctaaggtcgcttcggcaccaatcctccagtattcggcaggctatgtcccaccccaagtctatccacaagtgccgacccagccccttccgccacaagtcacgcaagcgccaatgtacttcgtcgggcagccattgaccgcagcagcgcatccagcccctcatgtgcaactgcaagctcaaccggtcgctacccaagtacatcctcaaccgcctggccaagtgccacaaacaatggtagaaggggcttcggctctgcaggcgcagctccaagctttccttcagcagctcagccaacctcacaacatttcaagtacagccccttcggcctgcccggaggggaatacaagtcaaggtgcgcctagttagttgccttcgaatcagccaggtctgggggcttcgccgtggagtcaaggaccacagttcgactctatcaatgctgctcaggcgccaaccgttcggccgcaagcaccaacgccaggcttcggagcaaaccaagcaccaaaccagatcgccatgacatggtcacagccaactttcgacccattcatggcggctcatcaagcatcaccaatcggggccgggcagccgaatgccatggcccaacctcatgcgcaagccgtgatttcgcccttcgccacgccgtacccgcagcaaggtgccatgaacagggcagggggcgaaaaggggctaccgctgagtgggggaatcaagacccgtccaatcccaccccagttcaagttcccacccgtcccacgctactcaggcgaaactgacccaaaggaattcctctccatttatgaatccgcaatcgaagcggctcatggcgacgaaaataccaaggcaaaggtaatacatctcaccctagacggtatcgcccgctcttgttatttcaatttgacagccaatagcatttactcatgggagcaattgcacgatgtctttgtccttaactttcgaggaacctatgaggagccgaagacgcagcagcatctactcggcattcgctagaggccgggggagtcgataagggagtacatgcgtcgcttctcgcaagcccggtgccaagttcaagacataactgaggcatcagtcataaacgccgcttcggccggtttactcgagggcgaactcacaagaaaaattgccaacaaggagccgcagacgcttgaacacctacttcgcatcattgacgggttcacaaggggcgaagatgattccaagcgacggcaagcaatacaagctgagtacgataaggcttccgtcaccgctgcttaagcccaacaacaagttcaagttgccgaaccacctcctctcgttgttcgccagccccagccggcgatccaagcacaaccgccaaggcaaggtcaagcccccatgacctggagaaagttcagaaccgaccgtgcaggcaaggctgtgatggctgtcgaagaagtgcaagccctccgcaaggagttcgacgcttagcaagcaagcaaccatcagcagcctttccacaagaaggtccgaaaagacctctactgcgccttccacggacgctcttcgcacaccacggagcaatgccgaaacattcggcaacgtggcaacgcgcaagatccaaggacgcagcagggagcagcggccgaagcaactcgtgaagtagctcaagaacaagcaccccccggccgaacagcgccaagatgcgcaatgccagagtgatccaagtgattacaatggccgacccgccgatccaactgtcgaagcgacagaagaagatgcagctgtgaacggtccacaatatcacttcggcaggcgaaggggctccgcaatatctgaaccagcaaatcttttttgggccagaagatgccgaaggagtaatgttctcgcatcaagatcctctggtgatctcagccgagatagctggttttgaggtccggtgaatcctggtcgacggaggaagttcggccgatgtcatctttgccgaagcgtatgccaagatggggttgactacccaagcccttaccctagcaccgacatcgctccgaggattcggcggagaagcagttcaagttcttggccaagcacagttgatagtagccttcggcacgggggaaaacagacgcgaagagcaagtattgtttgacgttgtcgacatcccacacaactacaatgccatcttcggccatgcaaccttgaataagttcgaagccatttcccatcacaattatctcaagttcaagatgctcggcccggcaggagtgatcgtggtcaaggggcttcagccttcggctgtttcaaaaggcgatttggccataatcaacagagcagtgcacaatgttgaggccgaaccgcatgaccgggcgaagcacgcgccaaagcccgcccctcacggcaagatagtcaagatgcagattgatgatgccgaccccacaaagctcgtatcactaggggcgacatgggcgaagaagaagctaagaacatcctagaggtactaaaaaagaacattgatatctttgcctggggccctgatgaagtgggaggtgtttcggcagatctcatcatgcatcacctggcagtcaagccagatgccaagccaaggaaacagaagctacacaagatgtccgctaatcgccaggaggcagcaaaagccgaagtcaaaaaattgctcaaggcaggggtcattcaagagatcgatcatcctgagtggctggcgaatccagtgctggtgcgtaagtcaaatggcaaatggcgcatgtgtgtcgatttcacagacttaaacaaagcatgtccgaaggatgatttccccttgccacggatcgaccagctcgtggattcgacagtcggctgcgaactcatgagcttcttagatgcatattccggctatcatcagattcgcatgaacccggccgacatccccaagacagcattcatcacaccgttcggcaccttttgtcacctcaggatgcctttcggtctgaagaatgccggagcaaccttcgccaggctggtgtacaaggtcctttacaagcaattggggcgaaacgtggaagcttatgtcgatgacatcgtcgtaaaaagccgcaaggctttcgaccacgcgtccgacctacaggagacttttgacaacttgtgcgcagcgggtatgaaactgaatcctgagaagtgtgttttcggcgttcgcacaggcaagctgttgggtttccttgtttctgaaagaggcatcgaggcgaatcccgagaaaatcgatgccattcagcaaatgaagcctccgtcgagcgtacgtgaagtacaaaagctcacgggccgaattgcggtactcagtcgattcctctcaaaggcagccgaaagaggtttgcccttcttcaaaaccctccggggcgcgggaaaattcaactggactcccgaatgccaagcagtgtttgacgagctaaagcaatacctgcaaagcccgccagctctgatcagcccagcatcaggaagcgaactgctactatacctggcagcttcgccagtggcagtcagtgctgctctcgtccaagaaacggattcaggccaaaaaccggtctatttcgtctccgaagcattgcaaggagcgaagacaagatacattgaaatggaaaagctcgcttacgccctggtgatggcttcactcaagcttaagcattactttcaggcccacaaagtcatagtgccatcacagtaccctttgggcgaaatactccggggtaaagaagttactggccggcttagcaagtgggcagcagagctatcccctttcgacttacattttgttgcccgcactgctgtcaagtcctaagtgctagccgactttgtggccgaatggacaccggcattcgcccctgaacccgagcccattgaacagccctgggtgatgtactccgacggttcgtggtcgcacaagggggcgggcgttgcggcagtactcacttcgccaaatggtgtgccaatttggtatgctgcaaggttacagttcgacacaaccaacaatgcggcagaatacgaagccattattttgggcctaagaaaggcgaaagcattggggattcggcgcctgctaatccgaaccgactccaagctggtggtgggccatgtcgacaagtcttttgaggcaaaagaagaagggatgaaaaggtatttggatgccgttcggtctatagaaaagtgcttcagcggcataacggtcgaacatttacctagaggccagaacgaggaagcaaatgccctggcgaaatctgccgcttgtggtggtccacattcgcctggcatcctttttgaggtcctgtatgcaccaagcgtgcccatggacagcttggaggtcctggcaatcgaccaggtcaaattggtcgaagacccatacgactagtgaaccccgtttgtgaagcaccttgaaactggctggcttccgatagacgaagcagaggcaaagcgcttgcaattcagagccacgaagtataagatggtctcgggccagttctatcgctccgggatacttcaacccttgcttcgctgtatttctttcgccgaaggcgaggaaatggcgaaggaaatacagcaggggctatgtggcgcgcaccaagccgcaagaatagttgccttcaaagtatttagacaaggagtttactggcccactgtgttaaaagtatgtgttgagcaaatcaagaagtgcgaaagttgccagcatcatggccgaagccaaaccacgccccagtatgagttgcagcccatcacaccaatctggcccttcgccagatggggactggacattattaggccgttcctggcggcgcgaaacgggcacaagttcgcaattgtggccgttgaatacttctctcgatggattgaggccgaaccccttggtgtgatcacttcggcaacagtacagaagtttgtatggaaaagcattgttagtcgtttcggagtgccaaaagagttcatcactgacaacggcaagtagtttgactctgacaagttcagagaaatgtgcgaagggcttaacctggaaatcaggttcacatcggtcacgcacccgcactcaaacggagcggccgaatgtataaatggtaaaattctagaagcactaaagaaaaggcttgagggggcagcgaagggcgaatggccagaggaaatgctatctgttctctgggtccttcggacgacccccacaagaccaaccaagttcagcccgttcatgcttctctatggcgatgaggcaatgaccccaacagagctaggggctaactcaccaagggtgacgttctttaggggcgaagaggggcgcgagttgttgctcgaactcttggagggggtaagagtcgaagcactcgagcacatgcaaaagtatgccacaggcacttcggcaacttacaacaaaaaagttcgaccgacggagttgttgcctggtcatcttgtcctaaggaaaaaggcgaaccctatagccgttggcaagcttgaatcgaagtgggaaggaccgtacctcatcaagcacaaatccaggacgggatcctttcgactggcgacactggaaggctaagatttcgaccattcctggaacgctgcctctctcaagcgtttctatgtctagaacgggtggcacccaaatcgccaacttgtaaaaatgtatatatcgttatgtaagcccttcggcactatgtaagcctttcggcaagaaaaaaaagagaaaaaaaagaggaaaaaaaagggaaaaaaagaggaaaatggaaaaagacaaaaaaactagatgtagggctattatccaccacggaggcccgaacgagtataaaatctttgtgtcctctgccttctttttatttgtttgtgcgattgataatttgcggaaaaaccccaaggcaaatgcctgatcagtgaaaaaggccagggggcgaaacgaatcggccgaagcatcgctcgccgaacgattgaaaccgcaacagcttgtttcggagaacaattagccgaacaccgttacactcgatcgaaaggaaagcacgagtgcttcctataacgtagaacaaaacggatcgaaaacggaagccgaaagctgaaaagtcaaaacctatttcgctaatatatgcaaaggggccgacacgttccgacccaacaaaaagcacgtgaagtgacaatgcaaaaatagcgaaaaggaaataagacgcacctttatggattttaaataaaaatgtatcgaagaatacatcacaatggtacaaatgaagagaaaggagcaatggcgttacagcccggcttacagataaattacatcttcgccctcacgatctctctctctctaaggagtgatcgaacgaactaggttcgtcatcactactaatatcatacacaaccctaagaggagaagggggtgaaatacagactagactgtaacgacgttgagagatcgcctcctgccgatcagtcttctgatggtttcgccaaaagcgagccatgtcctccaaacgtcttgaatgaacaagatcgtagtcttctaaggttcgcccagggtgcgcccgaagccacccggcaaccttaaaaaccttatagctgcgtccgtttatcaccatttcacgataaacaggccgaaatgggcatcacacctttggcaaatcctttaatgccacaaatttcttgttttggtttcgccaactcccagaagggggccgaatgcacaactttcggcgaacaccctggtagacaatgcaaaaagggcaaaaggcgaattgcatagtaagaataggcgaaaaaagaaaaaaatattgcataatgtgaaatgggcgtaatcataaatacgccaaagacatcgaccatcaaaaagtggctaagagtgagtcatatatattcaaaatatccaagggcccctttttcggctacaataagaagggttagcggcagcccgccgaatacacatcgtttgccactcctggcgaacacaaaaagaagaaggaaaactacaaaaatctaaggaaagggcggagggcctcacacctgtgggtaatcctgggcatcgcctcgacccccttcagccgtcgcgtcctcttcttcgcaaaggtctgccgcctctgccttcgctagttgctccaaaaggcgctccttggcggtggaccggccgtccttctgccagaactgtttccgccacgcacgaagtgcgggcgaaatgtcctgcgcgctaatctcccagtcccccttcgcatagttagggaactcggcgacgtgctcgcagccgaactgttgcaggagacccatagtaaaggccgctgatacacgcgcacaacaatcgccgtacgcagttgggcagtccgaaaccgaaccaccagctttctgggtccactcggagaagtcgaaggccgaggcatcttcggcagggacccctcgcacttttgcacccatgtcagtaagggtgaggcgaagcgtttggcacgccgttcttgcagattcggtagttttcgccatctcccgcgaaaaccgctgcgactcctccgcggcgctcgcttcggccttgctgacctctaggtgaagagcctccatcttcggctcagtaaggttataataatccatcagcacggcggaatgggccttttctttccttaattcggcctggaggcgatcaacctcagctatggcttctctcgctttctccagatcagccttgaggcgatcgacctcgggcctagcctctctttctttctccaacttggattggagccgcttgttttccgctttcgccttttcagggtgttggcgagggcctccatctccaagttcttgcggcctatttcgtcatccttggcccgaagacggttcttaaacccgtcaagacgagcccgcacggttcgctctgtcgaacagtgagctgcaagaatctggatgcaaaataggaacggcgaagatagcaaatgttaattatgggacatgtaaaaaagaagaggaaaactaggaatagataaaaagcatacccgaaccgtcaagcttttaatagcagaacacccctcatcgaactcattcagttcggtgaacaggctcggggtgctggcatgtaagacaagattgcttactccctccacaaagggaataaggtctgcccgggtctcgaaatcgccatgggcgaaatgaggcgccacaagggaatactccgaagcagatgtttcgacggccgcacccttccccttcgccttgactagcggcgaaacaaccggctgacgcagagggctaccgaagaccctcgccccagctgtcaggacccgttccgcggaggctgaagccccggcggcggcgctacctcctgctccatcagcaccaagtaaaagaacgggggcagtcgaaaggtccaggctgcggccagcgggtgaagtcagagtctcgtcagaagactcgtcgtcgctgaagacgcgagcgacatcgacgagtcctttcttcttggatatctttttgaccggacctcccttcgccgccttgcctgccgaaaacgcaattagcgccttcgccccatccaactcctttcgacgaaggggggagctgtttgattccaccccggtctcattgtgacccgggccatggaggtgacgaccatcgccatctccgtttgagtcaaggtcacctctatctttttcgcgtttccatctctccacacaatgccgaaccacttctctgttgaccacctcccgttttgtgcatcacagccaccggaacgtgaccacgccaacgacgccctggagcacgcaccggagcgccgccgcttcaaccatcgtcatcgtccgaccattctcgtccacctcggagcaagccgctgcgccatcatcatcgcctcaacctcctcttcaatacgcctcaagaaccccagccggagatgtgaaggacttggagaacgcaacttttcttcaccggcaccgatctagaatcgcctccgccgtcatcatcgattactgctgcctcggtgagccattgttcgattcctcgcgcatacaccatctccttgacctcacaaccctcgtgcatgcttgcttgtagcagctcatcgtcccatttgagccgtcgtcgttcacccaaggaggagcgccgtcgccgagccgttccacaagtcatcgctgccgccaagacctcgacaaccttaactcgacccacggtaagcatcctgaaggctagaagaccacatgcatgcatccttttcgttcggaatcgacttccatgcacacatgcactttcaccccatgaaccaccgccgctcacaccactgtcacgattgtttccgacaacctctgaccttgagttaaccatgggtagatgcgcgaggagcttaggaatgttttctcttttggtggcaccgcaagaacggccgctgtccattgccggcaccgacgagaagctcgtcgagtcgccgctgctctgctgctgcccttgccctcttgctgagagcctgagacactgaccagcggaccccacatcattaggcgctgagaattccgcttagagagagtttaaatcttgcaaggtctaaattgtaaaatatgttagaatgacatgtggaaccaaggactaattagtaatgaatgaaaagaatctgaggactcttaatgattttggttcatcacatactttggactgcgggttgattcctagaaatctcaagggcctttctgcatattggtccctcactgacacgtggaccccatccttaaaaaatctgaagaataattaataaaatgcccaaacaaatatatgtttagcagaaaaatgcacaaagttgtaaaatccatataaaatcaaatgaaactcattttgagatgattccagttgctgtagattcttaaagttatgaactctattttagaaatataaaacttgacactcactgtacaaataatgtctctaaaatttatctaagataggtcatacataaaacatgtacaagcttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagttttagataagctaaactttagaaattcatgtagaacacaatttagcttcaatttgagtaaacttaagttctgtaggatcaccaaaacatgtatttccatgttatgatataagattatatacttactgtgtagtaaaagtctctaaatattcatataaggatttactaacatagagcagccattaatttgtaaaacttgtagaaaattcatttttaatccaaatgaaatgaacaaagtttctatagaaccagcaaatagttatcttcaacatagtaaaataaaatttggcaccttttgtagagaacatagatcaaaaccttaacttagtgaaataagaatttaaacacatagtgttgtttaagtaatacataaacatgtatcagtatatatacactttaggtctaattaaacctaaataaaaacttgattgaccagtgaagccatagttccatcctcatccactaaaacttagaagaacttagctcatataacaatttctaggttaatataatatattgctagtctagattagagcatatctagtttataaaatatgaaccatagtagtaaagatcataaacatgtgaactaaaaatgttttagttaaccaaattattccttttattcaacttaaacatgaagtagcaagttctgaacctacaacttgagagtcatgcacatataaaacactatatgcctaaaacacgttgtaacttgtaaaatctataagaaaatcattataactccaaaaattgtgaaaccaaatgtattagtcttagaaaacacacctctacacctctgtgaagtctaatataataaaaatcactttacaaaagtatttcataacactacctaagactatactactataaaccgataaaacttctaaaattcataactcccaaatccaaatggaataagataaaataggaattatttcacctaaattcattttagaccagtacctaatcactgtgcataaatcatgcattttagagcattttggatttttagctctttcggtgtttaattgcatatcgtgtcctttatctagataattgcataattggtgaagaagtggattaggtgctaacatttctctgatcaaggcaagttttctcctcccatcctttgaacacatttaatcccataatttgaggaatgaaaatatttgtttgcaaagttgcatgtgaatttagactatatcggtatttaaaattgggttaaggtagttatgacctatttgctgcataccccaccttgaataattgatcctcttactgtttgaacccttagaaatggttagagtacactctttgtgctcaaatgggtttatatatgctctatgtgcaactacttgcttagccatgcttagaaatatgcaaatgctcattccatctgtaattaaaatgtgaattttgatacatgaacccttgctggaataaaattaatatgatgggtatttgcgaactaaaatgtataaaatgtgattttatacttgggcggcaagtggtgtgcatatggtgctagttgcataccgatagggggagtgtttgcccaagtccataaggaccgaacttgtgtcacccatttaaagttattcgtatatccacatgtgctagtatgggatggcctaagctaattaatctatttaggactagccttgcattctagtaggccggtgtgtatgagttagtcgataattctgaggaattagtcgatgattcagagaaactttctatttgccccgacgtggtagtttaggtgactaagtctatccaatacaacggtattgtgccacgtgggtgggttcccgttgtgtccgccaccacggcgttaagtttaaggcgtgggcccgccacttaacggttctaggcatattccaagtatgcctaggatggaggaacacgtatcgtgttggtgcaaggctaggttctaagttgtgtaaaggcttcgttatgacctctagatcacattcgacatgaagagtgtgatggagtcttgcaaactcaaaacaaactagagagttcatatcatgtgggtaaagctgtacaaactctgcagagttctttaaactaatcgattagccgtactcacggtcatgaacgctttggtgatgtgtcatgagtatagactttatgttttaaaatgtgatcatgtgacattggtttgaaattgataaatgtgttgagttgtgtgtgtgaggtgatatattatgatttgttgtcaaaggatgacaaccagagattgattacgatggaattatgatgaacttaatattgtaacttaaaattttgttttgttaattgaagcatcaactcctttacaaaagaattgcgaaacaaaacttgctttatgctgaaattgaactacatattgccttcctttgaatatttgccttcctttgaatatatgccttacatgtagtatggtaggattgacttgtgcttgccagtacattaacttgtttaatgtacggactcttgctgttgatataaccttttgtctgcaggtttagatttagtctttgagtgatgcgggttccgattgctgttgatataacccctagtcggtgtgcttgtgatcgggtagtcaagcttctgctgttctctgataagtttatttggccggtcagcctatgtaattattaagatgttgtaagtcttaagtttctttcatcttagttgtgtttgctatgtataatcatgcttaagatgaaagtgtggatctagggcacatcctgggaactagattcatatgagtatgagttaggaatatttgagaggttgtagatctttagctatttttgtcaagtctcctgaatgtgtaacacatctagtcaccgccttcgagtggtttgacgggcacatctcaggctgaagttgactgacaggctaagggcccagcaatgtctccaatattcctctctcgaggcgtcggatgtttcattatgcttgtttaatgacttgaattattcacttcatctctcaaatataatggaaggtccggagagcctatggagagcctatgacaatagcgccgtccacggcgatcttgggctttcggttcggcgcaatcgccctgcgccggcaccgaagggcttgtgcggaatcagaaccagcctcgaaggggatggtgtggtaaaaccacctcgccatccaatggcggtcccacttcgacatggcggcgttcaccggctagagatcggaccgctcggggcgaacattaaagtttacgctcccgaacactgtcttcttcgttccaactggggtaatcaccgtcttcgaattcacggtggcgaagaatatggcgccgaagagttcgtcgcttggctcaaacccggaagtccggcacgcccagtcgaagatagcgatccggaccagcgccgacgggctcaactgcgggagctccacctggaaaaggcgaagaatctccggcaacgagttgcacggaaaccggagccccgcctcaaaaaacacggcgaagaccactgtccggttgtcgacgggcttcggtacaacggctttccccggggcgaaagcctgtccctcgactaacgccctagagctgaccaactttgccagctcactatcgtttatgagagaaattcctaaataggcggtggtgtcatcgtcaatccggccggggtcgggccccttcgccgaagaggggttaggcttgcggggagccatgacgaaggacgtatgaagtggcgaagtgtgtgtgcagtggcgaacaaggggagtgagtgagaaatctaaagggccaaggggtgccgtgagagcaagaacggagaaagagagtgcgagcggtgaaaatggcaagtctggcggtgaaaagataacggggaagcatatatagcccaacaaggcgacgattcgcctacccaccagtaataaagcgccacgtgtcgtgagggtaggcgaaacggtaaattcccatcgaccgagctacacagtaaaaagcccacaaagggaaggcccattactgttcctttcggtccggtaaaaataaaaaatatatatcaccgtccgcaggaggcgaagagcggcaagtcaataccagccgcacagacaacaaactttatttgcaggaacaatgtaggtttcggcaggagcatcggttgaaagggggcgccacataccataccacataccacatggtttgcatggtctcggccgaagctccaatctcacccttgcccatgaggggcttgttggcggtatggcatgaggcccttcgaccaaaatctgctgaaggctatgcgaggagtggggatccaagcccgaaacgtcaaagttagtcggggctaagccccccccatggcgaagactatggaacaaggacggtgagaggcgaaggatcgtgcgggtactctgccaagccggaggcctcttgggcgaaggatgcagggcgaagagtatatgccgaagggagacgacttcgccaaagcaagcttgcccccgcgagggccgaagaagccttttccggcccatcaagcctaagggccattgggccgacgatcgcctaacggcccatcaggagtccatgaacctctattacactatgtatccatgtaaatgtccctttcataagggtaaccatgtaaattcccctgtataaccaaaaccctagtagtaagaacctgtaataggggctataaatagtctcatagggccatgaatagggggatccaagaaaaattctctaatcaatacactttactttcaaccactgttaagtaaccacgtcttttgacgtatgcagttgtcgtttcgacaataggaggttatgattttaaaatcagctggttgatagttggcttataagaatctggagaagctgctaaacccgaattttgacatctagcttattttctgaattatgtaattattgttttatatagattctatgtgaaaaactagactatttaaagaagcttttgatttcgagagaagttaccgccaccagaagcttctcaaacttgctttttgtgttatgtgttgtatcttgctacttccgcaacaacttcaaccaaaataaatcccccccaaaaaaaacctcctatgcctctccaccatagagacttggtctaaatatttatcattgagaaatttgatgatttggtaaattttagacctgccacccgtgataatgacacctggatcaggatgacaaaacatcaaattcacaatccacagaatggcagatccacaaatcccaagagtatgcaatgtatatatgacatcttggatggttgtccaaaactatgaaatatcaaaagcaatgcctttgttcaagcatcctagcatgggcattcaagaaatttgcgcactttacatccctacggaaatcaaagtagatgcaatcctcttgtgatatgcctactgaataagtgacactctcgccagaactgactaaatcttcattgacgataccatttgaatggcttttacacgccatttcctcaaagtcaatgtcacggccgtgatatttctggctttcaggatgcacaaccttcacaccttcatattcgcaatggaaacaacgaccttaggaaaggaacatcagttatagcaataaataaaggattaacgcgacgaaaagatcaaaaaaaggaaaaccaatgtcttttcttagaggagaaaccaatatgcaaggctacatcaactaggcagtttctattccaagggaaaatttacaatatgaaaagtggatccattttacttatcttacctttttctaaaagcatggacattataggacaacactaaaaaaaatccaaaataattatcagtacaaaagcatttttttggtgtacgtccaatggacggaatgcattgcaaattaaaactaataagtaaataatagatagacacattattctctttctttttagcaagcatgacctattaatttggctaaacagacatcttgctttttttatggttctattttcttttttcctagccctaggtgatatcctaatctctagtaatcatcaagcacggtcaacacaggccttcaagaagcagctggattgtcagaatattttaattttaaccaaaacatgaaaccctgtttggtcggatgcattttgaatttctgatgccttttcttctaaggcatgtaattatgcagaatagtctatcatatagttacacaaaccatcgcaacatgctgtatatgtaatgcaacggctgcaactggcatgcttctagctccatgatctagtgttgtagaaatatgcatatagagagaagagagcataccaggatgtcccatgattggccagcacaatggttcatcggttatatcattgtcgttgcaacactcagcaaagaagagtgttggaattactgtgtcagaagaatgtgatcctcttgggctcgccaaaaagttgacatgagaatacttggatttgtaccggatcttgcatgaactatcaccataatggagaggagaaacaccagacttgataacatatggattcaagccgcagataacatgaagatcatattccggtccctatataacagggcaaataagaatcatatgcacttattatttatttatctttttttaaaaaaaaatctataaagggtaaaaggggaaggaaacaacttatagaccttagttcgttgtgtgtatttcttcagtgcagcattcaccttgctgcaaatgaaattctgctcagcctcgaaatcttgctttatgttcgacaataacctggatgcaccctcggtaagtaccggaactgtctcaaaagaacaatggggagaagtggatggttcttgtgataacatcagcgagagcagctgcacatcaaagctaccacaagctttcagtggcaatggcccgaagaaagctgacaggtaaaaattcaccagcgcatcacgatccggatgatgcgcagcggtggccgcggccttaaatccaatgcccctgtcgaacttgtccttcatggcgtggccttcttgccctgccatttcgattgctctctgtagattcacctctgccaagagcaggtatcgaatggcttgctgtctggagaccgtaggaaagcaggcgcggagataagcaacaaggccaaggagagatctgcaagcagtagaaacaagggttcttgagcagatcatggccacttcagagtactcttcctctgcaggaaacattgtgtcataccaaacggtgttgagaacgatgttgtgagcagggttcatgaaggggccatagcagtggccagccttgaggagtcccctgtggtagcgccgctgcaagaactccctcggcatcttggcaagaacttggaggtacagtccatagatcttgtcgacgacgatgttcttcagagattttgtgcgcacgaatggtggctgcttgaccttgttctggaggaattggggagcagtaactccggcgaggcctggagatcttggtcggtggttcgtgagcaatccatggaggttgacaacgtcggtgcaggagaggcggccttctttggctaggatcccggagacctgctccatccgagcggcgagggagaacgacctgttgacgaacgctctgggcttgggttgccacgccgcgactgcgcgcatctgagcgcggtcttggtggtccgggacgcgaggatgaaggccttggtgttacgatcctcctcgacgagccgcgcggcggcgaggaggtcggcgttggccaggcggaggtattgcagcgcctcccaggtcgggaggtaggggaagcaggcgacgaggaaggcgacgagcgcttcgagtgaccgcagcggcatcctcatgtcgcggaggcggctgtggttgggcgagtgccaggtgacgtcgctggtgtcggcgacgatccgggagagcgcgctccgccgtctcctcgccgctgtcttgccgtcgacgggacggccaagaaccatgggcttgcgctccgggaggcgcttgtaggagagggtgttgacgacgatgttggagacgggatccgagaagccggcgcagaggccggccttgaggaggcgcgggatcagcgccggcatctcctccaccggcagccggtccagcgccgccgcgtagtgcccgttgatggcatccagcagcgccgatctgttccgaacgatacgatcctcgtggtcgtatctgtaggggcgctccgcgagggggtctctagcggcgccgctccggcgacgtttgccggccatgatcggagaagcggcagagcggttcgctcaggtttgcccttgctcaattaatcaaaatcgattccttttagaaacttaaaatccacagagcgccagtgactgccgctacctcgttgccgatctgcagcgaccccgccaccgacgtgcgccgcctcgctcctgttgctcgcggctcgttgcgatgcctcacgcgccgatccggtttattccggtgggcactctcccggcttgaagcccaagcgtacgtcccgagtcccgacgaccgcccactctgatgggcatgggcctagaggttttaggaaaggaaaaggtacaccgaaggtccctcaacttgtcatcgagttacaaaatcattcctcaaccacagaaccagatactggacatccctcaactaataaaaccgttcactttagatcctccggtggttttgaccctagttttattccacatggcggctgagttagcgtgagacccatgtgggctacacatgtcagcattgccacatcagccttctctctcttttcctctgttctctcccatcctcatctctctctctctgttctctgcgactgcgaggctggcaatgcgaggcggaaaagaaggagggcgtcagcgaccggcggccggcgaccggtgaccggcgacgcgacggcacgcgggcggccgggggagggccggcgcgtaggctcccctgccggccgccgcccacgaggtggcggcgggggacgagctacggggaaggggcggtgcccggccagtgagagaggaggagggcggcgttgtacctgctcatctgggaccacccgacactgcaggtccaggagatgcgggcggcagtggcgcacgcgtcagacttcccggcgctgccgctagccctcgtatgggacgtgctccgcgccaacatcttcgactagctcagcgccaccttcgggttcaacgggaataaaggagcacctcgtgctcctcctcgccaacgcgctccgcatggacctcctctacacggcgatgtacctgctcatttgggggttgatgagactnctgtacaatatggagttcatcaatcaactcgc

SEQ ID NO: 9941 - DNA, 13045 bp, Oryza sativa
  unsure (1)..(13045): unsure at all n locations
cgaaccttgttcgggaggaccaaaccctactaggagtttccagggaacaacgaatagcaccagaagctcctcatgaagaaggcgggtaaagcatggcccagtgtcacatcataaagtacttccggttgggaggtgcaccggctttgttacccaaaaacattgctggcgctcacaaataaacgcccatcctcttcctttgcaacgagtccggggcaggttcattcgttgaccgagttccacccctcccccaaggcggcctgtaggtcctcgtgaaccacgttaggcgcggaagcccgcgcgttgatccttttacggccgcccgcccacagctcctcccccggccgcccgggcgccgttccttccccagcagcggcgttgtccgtcgccagtagccgacaccctccccctctcccgtcgccagtcgcagagaacggagagagaaagagatgaggattggagagatgagagaaagagagagagaaggatgatgcggcaatgctaacatgtggggcccacgtgggtcccacgctgactcagccgacatgtaggataaaaccagggtcaaaaccaccggaggatctaaagtgaacggttttgttagttgagagatgtccggtatctggttttgcagttgggggacgattttgtaactcgatgacaagttgagggaccttcggtatactttttcctttaggaaattcaagtagggccagcatatgtgggctggccactacctgcctgatcaggtgggcggtaacactagctgcacaacgctgctcttctctctatcttccccccccccctcctgtttctctattttgctttcacagattcatcaggataaaggagtaatacagtactcggtatatgattttaaaactgagtgaagtacttaaatgaatcgattaatctgtaatatataaattaactttgctcatgattgcttgagtagttgttgtcggaaaaatgttttaagtattctggtagtgatgagtacgtcactttatcagatacgctcataatttcacacgttacaatgataatttcaagtttaagtccagttcagcctccggagacagcactgacttcaaatggacctagcgtcttcatgccaactccgatttgggtgatcttggacttcgtggaaagcttatctcgctacctttcaaacgcatctggtctcgtgtccaaattcatctcgagtcaacgggaatcgccaaaataagacagtgctgttgctgaaaccgaacttgggccttagccttgtaatagactaggcccatctcggaagtgtctccctccacctccacgaattagcacttaaccctaactttattttcctctataaatagctttgtacattctcaaaaacatttgggttttgtttagttgaattttgccaagtgccattcaccttgtatttagtcctcgctcgattagtcggcgactattgattcagagcctccaatagttggtgtgttgatttgccgggtcgattagatctaccacttcaatcgcaactatttctttgtgcttaatcacctattcgcaatatttagattgcatcttatcttgttcttgtagtgttctctcgtttgcattgcagggatcatcaaccgcgcgtcacggttggtacgacatcgtttgtggtgtagcgattgcacggcgttctggacttgttctggttggtagccacgtcgcaaacgtcacactcgatcaaagcgagggttatcccctcaccagaagattgggccacgagagagagcatcatcagttggtatcagagcttcagtagtctggtgaggattttagttttgtaatttttttcccatcattcactatacagccgcaccactttttcctttaccaaacattagttttgagccttgcaattttcattcaattttgctttattgagttttggtccactgtcgtatcaagatctggtcttagccctagtttcatcttggtttgggtttgcatctggttgtctcatcggttagttttgttgcggtcatctcggttgtgtttgtagagtttgagaaaagaaaaaaaaagtatccgagtttcctatttaagtcaaagattgacctccaattttattgcgcatgcatatgcatgtgtaatggtgtaatttccatccacgacttgctgattccttgcgcatgcagatcgcgggccactttaattttccgtgaaaatttcctgtgtgcgcatgcagcctagcaggttccgttgagttagttggtatcggtaatctttttttttacccagttttttttttcgtctgttagccactgtttgataaagaaaaagagagataaaaaaaaagaaaaagccagcgtggtgcaaaaacagaaaaaaaaggccgcaccaaaaaaaatagaaaagaaagaaaaaaatcaaaaaaaaagagaaaaatatcagaaaaagaaaacagtgtggcattttctttggttttttttttgagagagttgtgtgataaaatcagttgtttctagtccgagtgttaagcatttgtttgcttgagctaggattgagtctaggcaaggccagcaacgttgaccagtactttggactattattcaatttcacaaatctgtttgattttttctattccttgtgatatagttaaacctaccaagatccacatattactaacctttacaggtccggccttgcaatcgctccactcatcaagcatgtcattgtgccacgaaccagccacggtgattgacctgttttgcattctttgaggatattataataatttggtatatgcttaagtgttgagtgccttcaaaagctccacatatctatagattgttaggaactgacactttcttgtgagtttcttttgcttgataacgatgtcaggtacaagttccgacgaaccaacactggagaatctagcgcataaactgaagggcatggaaaattggtatgaagagttgatgcgtaatagtaaatcatacaaggaaagcacagataaacatttaaaaaccttaagtgaaagcctggtaaaagtagtggatcaaattgagaaaatgaatcaatcccataaacaattaactgaaaacattcagaatatgaatattggacatgaaaatattgtgtgacgcattggtttacttgaggctgcaggtgaagaaggtgcaggtgccactgctcatcgacaccaaagatatgacgatgaagacgaagagcaatctgttgctgatgatgaggaggaagacgagagtgttggaaataaaagacaatgtcgagttagggacaaagatgatcctttatctaaggtaaaatttactatgccttcttttaatggtaagtttgagccttctgtttatctagattggaagttagctgttgagcaaaaattctcttgctatgattttcctgataataagaaagttaaagctgccagtagtgaatttacctcctttgcatctctatggtggaatgatatatgtggtagaggacttagacctagaacatgggatgatatgaaacgtacaatgaggtctagatttgttccttcttactatgctcgtgacatgttaaataaactacaacttttaagacaaggtcccaattctgtagaaacatactatcaagagatgatgtttgctttgtcacgctgtgatttgcaagaaactgaggatgctagaatttctaggttctatggaggtcttaatagagagattcgggatattcttgaatataaataatacaataccatgaatagattattccattttgcttgcaaagctgaaagagaagtgcagggacgcaacaagcataggagttcttttgcaggtgctacttctacatgacagtcaataccacgtcaatctactactgccgttcgtccagcttcttccacaccacctacctccacgccatcccatgctcaagaaacaagcaaaaatgcttcagttgagactccagccaagagtgaaacttcagtagtttccactagacgtacctgtgatactacatgtcataggtgccatggcattggacacattgcacgtgactgtccaaatcggcgagctctatttgtgaatgttgatggtgagtatacttctgctagtgattgtgatgatgaatatgctttagctgccactgaccacgcatgaggacaagataatgatgacatcgaggaagtccatttgcatccagagtcgctagatcagtatcctagcctaattgtcaagctagcacttagtgctaaagagaagtgtgaagagcaaaaccaacgtcacaatttgttccaaagcaaagttcttgtgaaaggccataccgtcaaaatgattattgatagcgggagttgcaacaatttagcaagtgaagagatggtcaagaagcttggcttgactacccatccacatccacatccctatcatattcagtggtttaatacatgtggtaagatgaaggtaacccgcttggttaaaatacctttttctataggctcctaccatgatcaaattgaatgtgatgttgtgcatatgcaagcttgttctgttattttggggcgaccatggcaatatgatagagaagttgtttcttatggtaggactaatacatataaatttatgttcgatggtaaaagagttgttttgcattctatgactccagccgctgctttcaaagatgatcttgcaagacttgaatgtgaaaagaaagcgaaaagtgaaaatcagattattgctaaacatcctgcttcaactagtaaaatagaaccaagtaccacaaagaatgaaattaagttgaagggtgctttgttggcttctaaatataatatatgtgcactagatgagctagattcttgttgctatgctctattttgcaaagatcctatactcacattggctactgctcctagtactttatattctttgccacccgttgttactaaccttttgcagtaatatgaggatgtttttcacgatgagacacctccaaggatggccactggacgagagagtgcacacaatcaagaaaacgggattgagtcgaggacgactccaattcaagaaggggaggatgatgaggatatcactttgtcggatacgctcataacttcacacgttccaatgataattccaagtccaagtccagttcggcatccggagacagcactgacttcaaacggacctagcgccttcatgccaactccgatttgggtgatcttagacttcatggaaagcttatctcgctacctttcaaacgcatccggtctcgtgtccaaattcatctcgagtcaatgggaatcgccaaaataagacaatgttgttgctaaaaccgaacttgggccttgggccttataatagactaggcccatctcgaaagtgtctccctccacctccaaacttaaccctagctttatttccctctataaatagctttgtacatcctcaaaaacatttgggttttgtttagttgaattttgccaagtgccattcaccttgtctttagtcctcgctcgattagttggcgactattgattcagagcccgcaatagttggtgtgttgatttgtcgggtctattagatctaccacttcaatcgcaactatttctttgtgcttaatcacctattcgcaatatttagattgcatcttatcttgttcttgcagtgttctctcgtttgcattgcagggatcatcaaccgcgcgtcacggttggtacgacattgtttgtggtgtagcgattgcccggcatcctggacttcatttggttggtagccacgtcgcaaacgtcacactcgatcaaaatgagagttatcccctcaccagaagattgggccacgagagagagcatcatcaggtagttaaatgatacttattattaaaaggttggagagtaaattttgaaagatgtaatatgaatgatccgctacagtgtcaagaaatatagcggggaatctttggatgaccctccatatgaaatgaagatatggaggcttgcatttggatattccgaaggatcacattgctccactaaatttgggtgcgtcaatgccatctcttccctcaattcaccccaccccttaaaaaagagacggactatatttacgacgccacttccatataaacattcaaaatcaattttacactgtaaaattatatccatttatattataattacactgtataagatttaaaacttacattatagttacactattaagttcgttataacttttctaatacacactatgtaaaaaaatcatgattaaaagtaattgattaactacttaaaagaggagatataagagatataaacatacttaaaaaagcaccaccttgctatgaaaatgcaagtaattaaatgcaagcacttagtcataatgactaactgcttctctgtaactaagtgtaaatgcaagttggatatagaagaacctaaatcttgatgcaagattacataagaaaaatcgaaagataggagccaaaaatctgttgcaagtgaaatagtgaattcgaatatttatattttggaatggatgaagtacatgctatgttccgttgaacccaaaatgccctccaacaatttcgacgaaatttgctgcaacctcgacttcagtttctagttcctcttcgtttgggcagcaatgctccatagacaaacctctcttctatcatctccatcctgctcaaaccttcccaccttgtgatccagaaagtttttgatgatatgttctaccttgaccaacacccccctctcaatgtttttctgtcaacatgaagtcaaaacttcacattcatttcatactcagtacattcattcaactaaaaaaattgtatttttgaatcgccatgcattcccccatgtactccataaggctattcacaatatagtgaggtggcgtttgtcctcagtgcactacatttaaccattcacatgcgtttggcacatgtttgtgtccctagtgattgagttgctcgtccctgttaagacctagtgtcctcgtaagggagaagcaaaaaggcggcatggaaaacaaaaggcaagaaagaggggtagaaagcaggagagaaaggggaaggcatcgatgacccggaagtgtcattgacaacgaggctagctgctgccatgaagctacatgtccattgcctagtgtggccggctcgtcgttgatctcgccggccgaagtcgcctttagtaggaaggggcctcgatgactagatctatatatgaagaagttcctagacccaatggggatacagtgcactatggaggtgtgtggctctactttttttgttacgtaaagattgtgagcctggtttggtgtgccatgcgctgtgagtgccataaaagcagcagataatcatatcagacattggggagggcgcaatgtggtgatggagaagggtgcaatgtgcatcggtaaaccatatcatgtactctctccctccatcccaaaataaacaaacttctagagtttattttttttctaaaatagatcaacatctacatttttatttaccattggtccacaaatcaaaacattttatccctcatcacctacgcacccactaatatacctttactactaattatagagatattttggtcttttatctccctccttaactctatctcggaaatctaggattggagtatttttgggatggacggagtacacggtttctcttgcagtaaacggcatcgcagattaaggctgagtgaacacacaacatcacatcagggttcaccaaaccgttttggattagattatcatcaccctacggtaaggcagttatcgcggggattactgttgtttaaaaactgaggatgttatcgtacggggtaactgtgtgataactgcatggttttgcataccgtgcgtcacatacataggcctatccaactcggagcaatcgtcgtacgttacagggacatcgatctcacctttgcagatgtagggggccagcagaggaattaaattccccggtttcctctcaatcgttacagactcgtgacgtgaatggtttcagttcacctttactactcgcgcccgtacgtacttgcccagtacacattgtggtaccacccaaaaaaaaaaaaagaagctttgcttgccctctcctcgtccgtcccgactccccgtgccgcaaataatcgggacgccaacatgggacgaacaggacaccgcaccacctcggttgcagtcgcagccagccttgcaggcttgcagccgcagcgccgtcgagtcgagacttgacgacgatgtgagaaccaaatagcaccctggcctagtcgcctcgcctcgcgttgccaatcgcgtcgcctgcagccagcgcagcggccggcagggcatctccaacaagtgcgcgtacggcttggccggctgggccaaaaggcaaaagcccaaaggggtcgcaactcgcaaaggcgcacgcacgcgctgcacagtgcgcgcgcagaagcagacctcagagtcggacatgggaggaaaaaaaagaaagggcaacagcgcctcgtcctcgctatacgctcccgtagtatagacaataattgggacaacggccacccctgcgcgcgctgtgggctgcgctagctgcggctgggacacggccacggccaggggccagctagcacagcacagcgcgcgacgagacgacgacgacgcaacgggcgggcgatgatggggcgagccagccgagcgcccgagccggcccccgcgcgggcgcggtgcgagcgggcaaaacgacacacgcaggccagcgggtggcgcgggccggggaggggaagcaggcagagaggcaggcagtgggcggcaggcggcagcgcgtaccacaggcggggcaggcgtgcaggccgcgtggttataataaattgtgtgtggggggcacacgcgccgcgcgcggcaacgggagaagctagagcgcgcccaccccacttgccgatcgagcgggcgtcgcggcatgcatgcaggtacgtacgtagtacgtgaggtgagagtgcgtaccaccggccaccgggcgtcgcggaagatccaatgggcgcggcggtgggcctgcgcccgtcgcctcccgccgctttgctcgcctcctttatggcaaagcgtttttaccttacctgcgtgcagtgatatgcttccactgctagctactgccaagccagctgtgaatgtgatggatacctggatggagtatagtgtcatgtgctacctatggttcttcttgaggtcttggaatgtttaaagtagtttacaatccacatttttaatctaaaattttaacaagccataaaacatccttttgtctagtaatccagctttctaatgaacaagagtcctcactactgctttgtgttttcggccacgagcccacaaaggagaccactggatcggcatcaaacgcgggagagagagagaaccttttgctctacatgcattattcatgcaattagcacatgatataagattgcatacggtctagtgctgctgctcattacatgccaattcaagttgtagagaaacataaagttgtaaacttgatttacatatgcttacgagtgcttataccgagcatacatatatagaagcttgtcgtgctacattttaagcacggcatgcatattgctcgccaagaggttagcaaatgaaatgaaataaagcctggttccagttcggcaggtccgatattacatcaacacttagaatcgaattaaacacacttcgatgattcgatccaacgaaaagcaacaaaggatcgatccggaggaaattgagtcacacttagaacgacggccggccaatgctcacacggctatagctagcttcttttcctcttcaagccagccgccgcggccgtggcctcgccgtcgacctgatccccgtcgccgccctcaaccgccgccgctgccgctgccgccgcctccgtcagcttggtcagtagttcgccggcgttgtcggcgaggacgaagatgttccgcgccgcggcgtcgatgaacccttcctcgacgcccttgtcgaacagcgagagtaagttgttgtagtagccgtccacattgagcagccccacctaacgaaaacaacaccaacaatatttatatatgtttgttactactactagtttattcattgggagatcatgtcgaaaatgattaggccatgaagcatgacggcctagctataagctaagctaagctaagcgctatccatcaatctagctagctaatccctatccaccggccaaggacaataagattatagaatgcaaatggcagttaaatacgacaaactaagttaagctaatagtattaagctactggagtagcttttagtaccggtttgttgtggatccccagctgcgcccacgctatgatctccaacagttcttcgattgtcccgtaaccacctgcgcatcacgcggcaattaagttgttaattaagctaagatcactcctaggccctactagctaactactattagccaattaattctcgtttgtgtttgcatcagtgtcattgtgtcaatgtgtgtgtgtgtgtgagagagagagagagagagagggggggggggggttgacaagtcggctaacagctcacctggcagggcgatgaaagcgtcggcgtgtttcgccatttctgacttgcgctcatgcatgtccctgaccactttcgcctctcccaacgtctcccctgacacctaggaaaggcttgcacaaaatcatagtagtaccaccaaggtaaaataaacacgttccatatgtatgcgtgtgtgcagtaaaagatcttttaggaagtgatagacaatagaccaatcgtatactggctactccagctccacacaagagattcgcttgttatacctcttcaggtaggagagcactagggatgaccctgcatgcatttacagatgcatcgacgtgatcagcagatggatcgatcagcaggcacagttaagtcagtgactgtgtatgtgcgtcgtcgtgcgtacccgaggacgtggcggccgccgtcgtggacggtcttggagacgaggcccatcaggccgccgctgccgccgccgtagaccagatcgagctccctctcgacctgcgtggatcaatggaggccttcgtgggtgaggctaggagagggtaaagaccgagagcgaaagggagggggaataagcttgggggcgtcgtcagagctagacagtgtagaactatacccaagtgagcaggacacatcttctccatggacaatggcattggaagctgaagcttttggatggatggctagctagtagctagctaatactatcgattaattgctcaagacgcgacgagactcaccagctgctttccgaggtcgagagcggcagcgctgaaggacggccggtttccccgcctgctgccgcagaagacgcagatcgtccgcaccggtccccggcccccgcggctgccgctctccacaaccttgtcgtggttagcatccatgtgtgtgtaatggggaggacggagcgagagagagagagagagaggatgcaggggcttgtgtaagacttttcccggctcttccctgtgaagacctatttatccacactccagcaagcactccacacaagagtacaagacgtttgcttaatttgcatgctatgtaaacttagctcgcaattgattatctagttgctagttaaatgatgctctgggccctggccctctcgatatcgttttgatttctagctgcagaaaccatatactatacggttattggtttagtcatatcacatgcatgttttacgtacatatgcagagacgaagtggtaattgactatatatacggtacagtggaggtatgtgcacgtaagcatatctgaaacaaattcccatcaaaattcagaagccagtcagacagattataactactccctccgtaccattttaagtgcagtcatagtttttcgtatccaactttgaccttccgtcttatttatttttttaaaaaaaacaaaataaaagcataagtcacaagtaaagtactattcatattttatcatctcataacaacaaaaatactaattatataattttttcaaataaaacggacgatcaaagttggacgcgaaaacttacttatggttacacttaaaatgggatggagggagtatcacatatcctaaaaatctaaccaaaggttcgtgtctccctgtgtcctccaacacatttgcccatcagcccaccaggccaggtgccatcttcttttgtctatgtcaccagatcagtatgcctggatgcagtggcggagctaggaaattttttaagctcagacaaatttaaatatatctagtatttgctataatattttcaactttaatcctttcaaaacaataaaagttcaatggtgtatttgacggcgagcccggacggctgcccgtgcaagccgagcggtggctctgcccgtgcttggatgcaggggcggatccaacgtgggtgcaggggcngctgtnnnnatnnncacttttatattngtacaactaaaaccctaaaaatattaagtatttattcaaacaaagttttaaaaaatacacactatttcacctcaatagtcacatataggatctatgaatattacctgaaatcggcgtctgaatccggcagggcttgtccccttcttctttttccttcccctttttttttttttttaacggaattgaaggggaaggaattaagtctggggctggtaacaagctttttttaacaatcaggctttctgccataccaagggcggtaaggggccgcttgcaaaatggccggcccaaattggtttttttgatttcgggcccttgcgggaaagggtttattgaaaaaaacttttttttttacacaccctgcctctccgttttgccaataagattttttccaaaattgggggggggggtctattttttaaattttttcccccataaattattttttaaatatttttaaaaaattctaaaataaaaaaatatttttagaaaaaaaccgtgccgtcctttcttcaggaagttttccttccttaattcaggaaaaaggtctcaacattggaattatctccccaggacc

SEQ ID NO: 9942 - DNA, 2167 bp, Oryza sativa
  unsure (1)..(2167): unsure at all n locations
tgtattggaggttgttccaaccccacaaagaccaatgaatactccccgaagcacccctttggattttttcaccatgaaatataaagtaaaggttcctaaatggctggagattgaagatactgtggtctgtgtaactgagccccccaattttttgttcctggatctgcccctgcctagatgtaaccataatagctcgttcggcttgtgattggctccactcaattcttcaagaaatgttaacgagctgagtcaaagattttagtttgttagctatcttactgagatgctcgcgagccgaacgagccaaaagaaatatcaggccaacagaccgagagtctaagggtctatttgggggagcttttagttgctgtagcttctaccagaatcagaagctcctccaaatagactagcttttggtccagattctaaagagttgtagttgtagaatccagaaaatgaacaagccagaagccagattctcagaagctggctaccaatcagctactttttagaattttaagcaccccaaataggccctaagaccgacaacccatcaaggcaacaaggaccatcaaccatttggcccaagccaatcggactaaccttaaaaatctaccactaccatatcagggcttatgcaacttgggctcatccccacccccccccccaccccagcggttgtcttgcacacgtcgcttggatctcgccaactcgctgtattgcatcgtgtcacgctgtcaccccactccacccccacaaccccagatctagttatctaccttactcttgttgtcgagctgctagttatcgcatgttaggtttgccactcgtttgtaacaaccgtcatgtcaccatcgcccgtaggcaacaatgtcttggttagaggactcgtggcggcatgatgtcggccaccccaccctccatgtccactcccaatccccgcctcagccagctgctagttcccactcctccagctatgcttctatcgctgctactcgctaatcccgactcattctcaatgccaactcatcagctaattaaatgagctagcaaacaagccgatatgaggcaactttttagctcgtataacaagttaaagctggctcgatatccacctctatatctgactgtaccgtcacttaaccttatgagttaagtatttgaggaattgtcgatattcgaagtttcaaatgttaagactaaatcatgcctaaacatcagatatttataatctaggaagtggcattccaagggcatgcattcaggctgatcttacaatatattacaatagcgtatagcagcatgttttatgcctaggtgtgttgtacttgtatatgacgcaaatagtagcagttttttttttaaaaaaaatggtaatatacactactaggaaaagcattatcgcaagcggccgaaaagggtcttcgcaggcggggcggccgtccgcctgtaagccaacgattgtgaagatcgccgatcttcgcaggcggggcggccgtccgcttgcgaagattattttcgcaggcggacgttggctagtccggtccgcctgcgaaaataggaatcgtccgcttgcaaaaaaaaaaaacttccacctacgaagataggtagaaaattttgaaatttaattataatttggccgtaaattacttttaaattatttaatagaaattcttgcaggtagatttttatgtacatatattggaagattatcaagcatttggtacatatattgcataactcaaaagtgttgccaaaatatatatattacaatatttttttacattgtcacttcaaataacgtcatctagttacattatggcatagcagtgttccacttccgaagatccttgaattcgtcacttgccgctagggcaccctctgggtcaaagaaatctcctttgacatgacagcactcatggtggatgaagtggcacagatcacgctggacatttgtgatacctgtatcgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9943 - DNA, 1068 bp, Oryza sativa
  unsure (1)..(1068): unsure at all n locations
ccgcgccatggatcgcctaatcgattgtacagagttcatcaggatctgtgtatgaaggagctacaaagtatcagccagcctctccctccttctgggttcccgatctgggaaggtccagtcccaacccaagcctgctctccctatgggcaaggtcctccttttatatttcaaggggataccacatgcacccctctctctttttgtgtggggacttatcctatcttttcataaatggacggagatttgtatggttgccgtctgaatgaccttctgatgggacagcccacacctacctccactttcgccggaagcaagcgcgacgtgggaacatggctgtctgctgacgatatgaccagtgtcagaccggtcacaaatcggtcattcttgtccaccacgcgtcagtttatcaatctgatgttcgcccttcttcatacaatatcttgcctgtaatggttaggatgaagcctggcatatatctgaccggaaccaacgtgccatctccaggaggtaacacgccggctccggctagggacgagtgcttggaggctctcgtcctgacgggatggggcgaggcgtgcgtcagaccgcctgtcgccacctaacccacgatctgaccggtttgtgactgatcacagaccggatgaacgagcgcgctgtactgcattacgtgtggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacaaaccgggactaaagatcatctttagtcccggttcgaatgctgtcaggacctgtcangccccccccggaatcttgtccccgttggtcccaaccggccttaaaaaacttactttttttccggggg

SEQ ID NO: 9944 - DNA, 3460 bp, Oryza sativa
cacgcattcgattacagattcatagtaggccatcaatgatgattcttttgcatgtggacccccactcagccaccattcccatctctctcctgcttttcgggctcgcttcacccttttctaacattttttgatgacacccttattaccaacagatgacacgcaaacctggcaaggtatggtctccacacccctttctcttgcacgtaagcaatctatctacgtggatggataataccacacgtcatatgtatgtattgtgaatggcttaacgggacaatttaccctgctgaaacgtgcagctacgtgtttctgtaccaactacagatttactccctccgtcccaaaataagtgcagttttgcactattcatgttcaacgtttgaccgtccgtcttatttgaaaaatttttatgattagtatttttatcgctattagatgataaaacatgaataatactttatgtgtgactaaatgtttttaattttttcacaaatttttcaaataaaacggacggtcaaacgttaaacgtgaatagtgtaaaactgcacttattttgggacaggtagtacttatcagagcagatcagatcagatccacagcacatttgcatcgacaaccgtgaacccagtacaagattcacctgccggcacaaatttttttcatttctctctctctctctcttctgttccgttttgtctggacatgacagttgtacagtttggcttctgcatagagcatagtttaactggccaaacagatcgatcgatcggctctatcaggaaggatgcgtcttaattgctagcctgattagttttctgatctgagggtgtaatcatcgtgctaaactatactcaccttgtctggcagatagcatcgaacagattacagtgatgatcccaccgtcgctacgaggcaacagaagaagcaaccttttttatgtccattgtaagagactgagtaaatcctaaaactaatggtttcttcaggtaatcggtgacagttcactggaatatgcggaaaatatataccccaaatgctagctatagcatctttggatcaaaggaaacggcatgaaatcaaaatcaaatttaaaaagatttttttcttttttttagcggttaaaaagattttttttattacacagcaaatgtgcatatgcacaacactacactcatatacccacaaatgcgcctggccctaacacaagctaaagagaagcaaacaagcggtgcatcccttatctcactagattcctattgagatttctattgaaagcccacttaaatatgtgtaatattcataaatttaaatttaaaaggatttctaataaagagtgtgactaagctagtttgtaaggttaaatatgttagaattaaaaaggatgtttgtgtttgttctaaaatttatgtactatgtcgctaatagcggcatcctaatcctaaaattaaaatgtctcactcactgagaattgtaaagaacataatttgatcaaacttgtcaacaaatgtagcatgtaattaacaaataaaaatataaaaagaatcaatgcatttcctctaaaaattcatatactccaattaaagggttcatccacaccacagccagtaacatttgatcaagttttgtccataaatagaggatattctcagtaatatgcaagtttatttggtacagctgcatagtggttactcaagcaatctactccctccgtcccaaaataagtgcagttttgcactattcatgttcaacgtttgaccgtccgtcttatttgaaaaatttttatgattagtatttttattgctattagatgataaaacatgaataatactttatgtgtgactaaatgtttttaattttttcacaaatttttcaaataaaacggacggtcaaacgttgaacgtgaatagtgcaaaactgcacttattttgggacggaggtagtacaatgttgcaattttgtcggcttccttggcgcatcggacattaggtccaccccttgttaaacgagaagtacaatgtgttgatttcagaatcgaccgacccaatgccaggccacccctgacagccgcccggactcgtcggtgaatctgaatgtattttggccaagtacacattggtagagtaaaccggatgcttttatctaacgaaatcttcattagagcttgttcggttaatcacatgagaaaggaattgaaagagattaagaggattaattttacacctcaattttttttttagaaacacggtacaaacattgacactcatagcacacacacacactcacccctaaggcatttatggaagattgggccggcataaatccacacctcaatatgtatagaataaatcatatctaaaccttatagaacaaggcattttttgaaaagaaaagaaaaccgaggcatatgccttagcactaggcgtgcaattgaacagtgaatttagctcgtctgtgttatctgtatttttaactctaccctacctcttgcactgtccatttctttgtaaagaaaaccgcaccgtccatttcaaaatattaagattgtccatgcacatattaaattctgtgcatatagaatatatcgccgatagattcgatcatcctctggaccattcatccaggcttcgaatgatccatccgttgattcaattcgtatatatgcacagcccaaacataattaagtagccaagcagagtactccggcaatacaaaccgaaatttcaaacaatctcacgcgagctttgaattaatgccaaatttatggccacgtcccctcgaacgatccgttgatgtactgtaataactaatcgacctacaccacgcacgttgatgtactagcaccattattccatagatcgaggtcgacgagacgagacgatcgtcctgtttgtaaaaataaattaattattataaagtttaaaagttgatttaatctctaaaaagtgttgatgaaaaggtttttccttactgtttagaatcgtaaaatgtgtggccgcacgatataatccgtaatcggatagctaaaaagaacacgtcaaaccacatggtgtgggccatggctaatgggcgggtgaacgcccacagcgatcacccccccatccccatgtacgcttatctcccccttcctcctccatttcttctattcctactacaccataaaatttttttaaaaaataagaaaacaaagctagaaaaatttatgtatggaaatactgtatataaaaaaatatttgaattcaaattcaatttaaaacgggtatgtaaactttcaacttataaactttgattctataaactaatattcgaattcaaattcaaatttgaatcgggtatgtaaacttttgacttataaattttggatgtataaactataggtgtataaattttaaatgtatagaaatactatataaaaaatatttgatgaactacttgcaatcgaagccgtatcttaacggccgcg

SEQ ID NO: 9945 - DNA, 2817 bp, Oryza sativa
  unsure (1)..(2817): unsure at all n locations
gagagaatcgctaacagatgcgacattagttcatcaaaatactatatataaaaatatttaaattcaaatttgaatcggatatataaacttttacttaaaaactttgggtctataaactttaggtgtgtaaactttagatatatagaaataatatatatataaaatatttaaatttaaattcaaatttgaatcgggcattttgacttataaactttgggtctctaaactttaggtgtataaactttagatgtgtaaacttgaggtgtataaactttagatgcataaatttactaaaatagaaaagtaatgcggtgccaaaaaaggaaatcacgtgaggaggggtgatcacgcggggcgatcaatcgcccattagaaatttcgcaaaccacacgcattgctattgcaagtctcatatttatataaggacaaaattctctatgttaaatggcagaaatttatgacccctccaatttatgacacaaatttaacatacactatacactggtggagaaaccctttgtagtcccggttcgtaaccccctttagtcccggtttccaaaccgggagtaccaatccgggactaaagatcgctatctttagtcccgggtgaaataaccgggagtaaagatcgatctttagtcccggttggtaacaccaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgttctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgacttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctcgatttgtatgtaatcaccaaaataaattcaatagaaattttggcatgacctcacctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttggtgctccaaccgagactatagatctaatctctagtcccggtcggtaataccaaccgggacgaatgatcccggtgatctttagccccggttggtgctaccaaccgggactaaagtcccccccctatatatatgtcctcttcctcctccagcatgccgagcaagcttaaaaatttcttcaaaaaggaggtgaaggggcctctcctccccaacaaagaggtttttttttctttttttctttn

SEQ ID NO: 9946 - DNA, 20743 bp, Oryza sativa
  unsure (1)..(20743): unsure at all n locations
cgcgcgacctgatntttgcacgtgcgcaagtagcncatcattattgcggtttgggtgagcacgtcacgccacacgtaatgcagtacagcgcgctcgttcatccggtctgtgatcagtcacaaaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccataaaaggtcattcagacggcaaccatacaaatctccgtccatttatgaaaagagagagaggggtgcatgtggtatccccttgaaatataaaaggaggaccttgcccatagggagagcaggcttgggctgggactggacctttccagatcgggaacccagaaggagggagaggctggctgatactttgtagctccttcatacacagatccaccaaaacacatgagtagggtattacgcttctcagcggcccgaacctgtatacatcgctggtgtttcatgctctttcgagaggtcgcgatctttccacatatagacagagcttgggatttcaccctgagcccccggccgaaccggcataggggggcctgtgcggtctcccggtgaggagcccccacactccgtcatctggcgcgccaggtagggggctcagcgtgtgttttctgagctctcgcacttttctgtgtgcgccaagtttttcttgttcagcctaatggccgggcaagcaaaggcgcacgacctctctccgagtgtgagcggcgacgacggggagccaaacccacgccgtcgagctcgtactccaccgcctcctccacaccaaagtcctaagcagggggaggcgctcgagagggtcgatagatccgcggcttcaccgatcgcgggcgatggaggagaacggcgagatggggagcgttgcctcctcgtctatggcgacggcagcacgccccagggcgcgcttcaggctgctggcgcgctcctacgtcactcgcccgtcgtccctgacccggagtctccagcccagcgatggctggacgacgtggccaacttggtcatgacggcacagcagcgcctgggtgctggtggacggtcctccaccaccaggacctccggcgccgctaccactggctccgtgtcgtcaaggcggagggcgcggcgagcggcggctgttgcacgccattcggctgctactccctcgtcggcgccttcgactcgggacgatcagcgtggagagccggatgcccgcctcgacatcgagcgccggcgtaatgaccggcgtgctccccacgcgacggagggcgcctcttcgtccagagtgtcgcctcgacatggacacgaggaccagccctccgtgcccccggctggtggtgtcggctgtagagcctttgtggcgagtcttcggaatgtccgttggcccccaaggttccgacccaccatcgctgagaagtatgacgggagcgtcaaccccaccgagtttctccaggtctatacgactgggattgaggccactgggggtgatgacagggtcatggcgaatttctttcccatggccctgaagggataggcgcggggttggctaatgaacttgccacccgcgtcggtccactcctgggaggatttgtgccaacagttcaccatgaactttcaaggcacatatccgcgcccaggcgaagaagcggacttgcacgcagtacagcgaggggatgatgaatcacttcgctcgtacattcagcggttttgccaagtccgcaacaccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacctggaacccctccggttccggagtggcagcttctgccgcccccggatccgccgctcagacagggcagcgtgacaggaggaagaagaagaggtcggtccattccggcgacgagggtcatgtcctcgccgtcgagggcgctccgcgggccacccgaaaggggaggcctgcgagcgacaaaaagaaggaagccgacgctccctgacctcggctacttggaagagcgaaggtggcgcgcggcccttcgagccgcgcgctaccagcagagcctgcggcgctaccatcagctccacgtccgggtccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtatcaggtcttgggctcgggccaaccccacaccccccgggcgtgcagggttggccgggggcttatcttttttctcttccgtatttcaataaaagcattttcgatttcttaaaggctgtatctgtgctgttatttccttttgaagaatcttggcttgaaataggtcactcgtgctcaatcctaccctcgggggctcgggtcggctaaaatcgccaaacggggcccagaaccgagctgtgccccggggcgtggtgaactccggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggactatggcacagaccatcctcgtctcatacacagaacaaatgaaattgacacaaaaatttcctctttatttgattgcagattaaatcagcctataacaagaagggggcccgaaggcctcggaagaagaatgaaaagctattaagattggcggaggcctgggggctcactccgacgcgcctgggtagccggcctcgccgtcgctgtcgtccgcaccgtcgtcaccgcactcctcgttggagttgaaggcaaacgcgagccgaggggccgctccttattgtcggtcggttttcccttgctgatgcgcgcgatttgcgaccgccgggattctgcccgaagagagagagagagcagggaggagaggcccccgagccgaacggcggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggaaatgtggcccctgacgaagaagatcggccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagcttgtctccgcccccgaggccagctcgagcccatcgcagctgcctcacaccgccctttgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgttcatccggtctgtgatcagtcacagaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccatcagaaggtcattcagacggcaaccatacaaatctccgtccatttatgaaaagataggataagtccccacacaaaagagagagaggggtgcatgtggtatccccttgaaatataaaaggaggaccttgcccatagggagagcaggcttgggttgggactggaccttcccagatcgggaacccagaaggagggagaggctggctgatactttgtagctccttcatacacagatccaccaaaacacaggagtagggtattacgcttctcagcggcccgaacctgtatacatcgctggtgtttcatgctctttcgagaggtcgcgatctttccacatatagacagagcttgggatttcaccctgagcccccggccgaaccggcataggggggcctgtgcggtctcccggtgaggagcccccacactccgtcacggttggtaacacaaaccgggactaaagatcaaatatgcccgttacccttttgaaccgggactaaagatcatctttagccctggtttttattgcatccgggactattgtggaaatcggccgaccgacgaaagatggtttctccaccagtgatacatgccgatgtactagcaacgatataaatttaacatacactataaattgttgcattgcgtttgtatatcataaccagacaacacagagaggcagggggacgtagttttttgtatggctgcgaatcagttttgatatatattactatctcatataattatttgatggttggaacaatataaatggcttatgtttatatatagacaagattatcttacgattcgcacagttttttatagggagtaattttcacgcctcgtgtttttatatatggataaaaaaatactatatgaattggaaagggcatatttacggtgactctaatttacaggttaagtcatagacttatgagcattcgtatttacggctatttatccttttagtagtaagacggcgtatttgtcaacaacgagatgtccatataacttcgtcaactagtctagtttttttaatatgcttataaagatatggtgtgtgtatatgttcatatcggtaagtgtttgcgttgtactgtgtaattctaaaaaaaagtgagctaggtagcgttacgagtatattgttgggaaaattgatctctcggtttgaaagatcacgctagaccgttttccacccgttgtctacgcaaaatcagagcgatccaatctgttaattcccgattaactatgcgccgtgatcggtggcacccaatttatttcctattgagtcgcccccgattccccacagtgctaaatataaaaggggaggccggcccaacagtagatgacaatctctctcggtctcaatctaaacccaatcaacattggcgctggaggggaaacgtgtggcggttctaggatagtgtaggtggcaaccggaaggctgccgctaccccgcaaccggcgttctcactgctacgactacttcccttacgccgacgatcacggagcagttcgagggacttcatcctctacttccactccggttgatggtattggagagggaacaacaagaatcgcaacggtggtttcaaataacggtcagtaatcgtaaaattccgtattagggtgatcatgtttagactaagcactcatgttaatagatcagtagaatctacatatatgtgttcgtatcgggtttctagaaaattttacaacgaatagggtaatactccctccgtttctaaatatttgacgctgttgacttttttaaatatgtttaaccgttcgtcttatttaaaaaatttaagtaattattttttttcctatcatttgattaattgttaaatatacttatatgtatatatatagttttacatatttcacaaaagtttttgaataagacgaacggtcaaatatgtgataaaaagttaatggtgttaaatatttagaaatagagggagaggaagtactgatatacggagtaatcagcaaaaagatggaccatagccgtcgtgttggactcctccatgtaagacgacccggaacagcgaaaagaagaagcgcacgtaagaatcggcagggtcaaagctagtttctcaaaaaaaaaaagataataagaataatataataagaaaataaaaagaaaaaaaatccccatggagacgaaacgtggacaaaaatcgcagccgtcacgtccatctccgcaagaccgcggcgccaaacgggtcaaccacccacctctcttctcctcatccccatcccattcccatttctctcgcgcgcacggcgccgcgcgcgacgcgagacgcgacgcaagccatcaccaacacaaaaacatggcgtccaccacctcctcgcccacgcgcgcaccctcctcctacccgtaaacgacacccacaccgacccgcctccgcctgcgcggcgagaaaacccaagaaccccccacgtaggcaagacgaggagaaagaggattgcaagacgctgtccatcgaagcatgccatccatggcgcctcctcggctataaccaggcgagagagagagagacgagacgagacagccaagaacacgcgcgtgcgcgcgtgcgtgattcttagtttagcgccttcccccccgcggccgataataacacggtggtgggggaggtgttcgtccgtggcgcgttcttttgtcccaggcgtgcatggccgagacgccatgacgacgacgacggcgacgaacacggcgacgaacacggcggcagccatggaggtgaccaaggcggtcacgcagctctgcgcgcagggtgggggcggcggcgggagaagaagggggaggggcaggccggccgtgctgcggctcgacctccgctggggccgcctgctccgcctcgccgtcatcagcagggtcgtccgcctcgtctgggaccagctcctcgcctgctcctcctgcgccggcggcggcggcggccgctaccgcaggctcggcccgccgccgcagggcgtcgccgccggtgccgtcctctccccgctccccagggacgccgacgacgacgctgccgccgccgaccgcgacgcggccgatgtcgaggacgtcgtcagcctcaaggtcagcctgctcggcgattgccagatcggcaagaccagcttcatggtaacttctcccatctcctcctcctctttcaaccaagaagcaatcaaattctgaaactcgagtcagcaatcgaacacaagaatcatttcttcttgaattcagaatagtcaatccagatagtaaaaagtaaattaatctattgggtaattgattctgcaggttaagtatgttggggacgacgaggagcagaacggcttgcagatgacgggcctgaatctgatggacaagaccttggcagttcggggagctcgaattgccttcagcatttgggatgtggcaggtaatttgcacaagcatatgaactacaaatgcaggatttgtttccccctttatacttgcattggttgaagaatcagattttttttttggtgtgcctaaacttgctttgtttgatgagtttttgttgtgtgatggaatgcaggagacagccagttcctcgaccacgtcccgatcgcgtgtaaggacgccgtggcgatcttgtacatgttcgatctcacgagccggtgcacgcttactaagttagtgttcctatcagtctcacagcatcataatcttggatcagattttgagtaattagaactttcaatatctgtagtacttattgttgattatattatcttttgcttgatgcagtgttatagattggtatgagagggcaaggaaatggaataaggttggtacattgttcttctataatcgtgtggttttcattttttctggatgtgttctttaggattatagctgaaccataggtagactgtgcactgaaaaattgttacagtattacaagttgctgctaaaacagtaactagcagatgggttcccacaatccaacatatgtcagagcatgcctgcagatcactgtttctgaacaatttagtaatgctgatacttgttcatatgtttttatcggtgctctagctgaacagtgaaatggtgtccttggttcttggtattgtagctgaacagtttttatctctcttttgttttctgacagacggctattccaatcctaattgggacgaagtttgatgacttcgctcagcttcctcttgagatgcaatggaccatcgttaacgaggtacgtttattaatagtttcttgcaatcaaaatattgttcccccttgcctttctttggttcttggatatgcagccttcagcatctccaatgtttgttagcatagaaagatgagaccttttcttggttctgacgatatgggtttgggctacacatgtttcttttatctcaaacgctgcaaattaaccagataggtcagaactttaatcttgaattagccttttcatggctaccaagtgctaatagcaaatcagaaatattcgaaagccaaccatcccctgaaaactcccattttgaggttcagatttctgaaaactgctactgaatcaaaattttctcatcaaagatttgagcttctttctgtaggccatgaacacgaaatttttttagcttgatcgcatctgcaattaattaagaatacctatgtgaaaacgacaagagagcccaaatcaaacctgaatcgagtacagcatgctaccaattatgtttgtgcagaccgtgctgacctgatagcaccatatatgaatgcctattactattgcaacattgaatacagtggaccttggttgatcagggggagcattcgttaagtaggcccaaacacgtcttgtcttcgtcttcgtctccggggaaggaggctcgccagtcaccactaacaacagccgggatgatcgagtcaaacgatagaaaatttattaggcaatggatataatttctgttttgtttgtgcccatttgtttgcatcttgtccaaaccatacgacgatcatcgatccctgtgggccttacaacatacagaatgtagatcgatggtcactaatcactcgacatgctaaaagcaaggaaaagctacatcacaactaaccgaaaataactcctcgtgctactgggagccctcatgcttgaaaatgtagttgcgtttcttttcagccacagtgaatatcagttcactgaaaagtttttgtaactaatcctagaaactactgtttgaccaggtttaattctgacaaagaattcgagaacacaaaaccatatgcttcgcatttggtttactgttgttaaaaaaacatgttgtattcgaaagaaactcctctgatgtaatgccctctgacatgtgggtccacgagttatgggctccatatgtcagtcccttaaagtcggaggacagtaagttagaaggtttttttccgttgtattcttgtttctgatggaggattttttttttctgaaatttcaggccagggcatacgcgagagcgatgaaggcgaccctcttcttctccagctcgacgcacaacatcaacgtgaacaagtttttaaagttcattacggccaagcttttcaacttgcggtggcgggtggagcgcaacctcaccgtcggcgagcccatcatagacttctgaagactctacacccttacactgacaaaatgctaggcaaaaaaacgtacacgagcccttccttccctccccttcgtcgtcttcctcctgacctttctctcccggtaatggaggccggccatggccatggctgagcagaactgagctcttgcatgtacatataggtgaaagaaaaaagaaaaaaaaaagaaagaaaaaggatcaagttgagttcgtcgttgtcgaggtgttatcccttcccttgtgcagtgcaggcaagggcagaagaggaaaccgtgagatgttgtctgtaaccctcgtcacagtgtatagtagagtaggagtttaaccgatccatgtaatataatcctcaccgtttttttaacaccagttttagatatgggtactcatcgaaccattcgatcagtttaattttttttttttgcggggaaaccattaattcgatcagttcatctaaagtctaaatgaactaaaatctacatagtccctcgtttcaaactaagtatatgtccaggcctccagggatacttgtactacttctatcctaatataagagcatttttagacgtgagagaaaaataagaagagaaaattacctaaatgttctatattaaacgagagatgatggaaagtgcgagggtaattgaggataagatttttttttgactaattcaccaggagggagagattccccacctgaatatattgcgtcaaacgaaattacacagggcaggcttcacctacgcaagtgcaggaaccctggaggataatagcaaaaaatacacggggagtcctgagaagagaatacaaaagagaggccaccttcccaaaataacagcaattgaagtttgcacttgcaagaaacccaaccgaaaaccagagcaacctaaagctaacaccctagctcatcaacaaccatatcgttatgcaaacttggaaacgccagagtccacgccggagggcctttttgccacaagcatgtcagctatggattaacggcaaccaaaagactgaggaagtcataaaccacccgcattaagccgtcaaaatccaacttaatcttgttgctgcttggatcagtgcccgccgacaccatttgggggaaggaagcctcagagaagggagggccactaaaggttgcggccatagagaccgcccgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctgaaagaacgtcaaccgcgtcaacagggaaggctgcaagaatagtagccattcaagccaaagaaaaccgtaggcactaacataaaagacctgacctaatccatcaatcaaggagcatgccaaaaggagatctagagagagggagaggcactagcgaatcctaattgacggatcagagccaagcatgttatggcaaggagctcgttggctagctcaagggcgcctcaaagaggagggaggaggagggatggggatggaagaaggtgttgggcaaggtcaccggtcccgcggggagaggggggtccgaggccagagcctgccaccggtgccacggattcgaccagatccggccgctaggagcgcggatctgcacgccaccagtcgggggcgccgggcctagccttcatcgctggccgaggggggggctacaaggagccaagccgaggccagacaccgcccccacggacaacacgtcgccagacagcaccgctggcgactgccctccgcggccaaggagcacgaccgctccttcgccaggaacagcacaccgtcgccgggacacacgccgccgcaccgcctccaccacgccccatcgtgccaccgcgcacggcattgtcgctctcctccggccaggtccagaagcagggtgccggatccagccacgggggcgccagatcagaagcttcgcgccgcgccgatgtcagcccccacccatcacgcgccacgtcatcatcctcgcgctgagccgtcgtgttgccgaggaatggcctcgccgccgccctcacagctggcagcgcggaactccggtggtgcgctccggcggcggcgaggggagaagaggaagggagggggcggcgggggctagggttcaccccctgtgccgctcgcgcgagagggcgacgcggggttgtgccggcttcgtactcttccaattgaggataagatgaactgatgtgataagtagtatgagattgtacttattttaaaacaaaatttgaatataaaatcatacttattttaggaggatgtagtatttgggacttggcagtaattttactgttcttggtattagaaggtaccatttattttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcatgatgttaccctataatttacgctggcggccatatgcaaaaaccgtcaacaaaaacataacaataggtggggggctacggaccaccagcaaaaaccaatttttgctggtaaccacgctaagagaaacgcctaaaaaactactctatttttcgaggcgggcctcttaagtgtccgccagtttttctaggcggacctcttaggcgtccgccagcgaaaaatctcattttcactggcagtaggtaaggaggaccgctgcaaaaaaagttttgggcgaatatataaatctaccgtcccccacccccaccgctcccttctcccttcccccaccgcgtggcccctccgccgcctctcttccttctctctcggtttcaccttcttcctcccttctccaccgccgtcggctgccgtcgcctctaccgcctctccgcggcggtggggcgtggcctcctcctctccgccgctagccgccatgagctcgggccggattcggccgctgcgacgacggcggaggccggatctgccgccgcaacgacgggggagaccagatccgtcgccgcgatcgccgcagggccactagtctctaaagtctaaattatatatttaaaaaacattacgaatataactttatgaaagagagtttctcataaaaatataccaatataacttttcatattttaaatatttttacgtctattaaatttttaaggtttcaagatttgactgcacttataggagatactactatacaagaatcaacgagaagcgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctnctnctcctccccttcgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacattttttttgttcatgttgatgtccacggggattgttctagttatgtcatttttatcttcaagacttaaatgctttgaatcgcgggtatagaccagattattgtcgtgaagatcgacgtattttccgagctgaccctctgcatgctgaaaattttgtagtgggttatatctagattatatgtgtattgttgtcattcaattagcacttaaacttctgtagcataaacattttcatcatcttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgaggacccaattgaggttttaaccattggtttgctgaatgtgtcttcagtgttgaaaaatttggacacatttgcttcaaattatgcacattcgactgttgtttataggcctgcgatgtccattccacattcagtatttgttaagctgactgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtactgtgacagtttatatatgattatgcagtgttgtgtgtgactctctgttcattagaaacatatggtgtcatgattgatgtatcagtgctatgtgtctgtacaatgcatgtggcaataaccatcacgtagttttaattgcatgtggctttcagctgtgcatttttcttgttatgatacatggttcctgttttcaggcaaaaaccaccaagaagatcgtgctgaagctgcaatgccaaagctgcaagcattactcccagcaccccatcaaggtattatttcattgtcaagactccagagctgaaaatgaatcattattttgctggatgtgttggatgctcacttgcataattgttctctgcagaggtgcaagcatttcgagattggtggagacaagaagggcaagggaacatctcttttctaaattgcttgctacctactggatactaaagttgttggtctactgtgcttcaatatttcaatgttattaggagcttatttaagcataccatatcaatgtattcaagtatcatcgtctgacatttactctagcaaggattggctttctgctgaatcaagttttgttgcttaatgctcattgaatccaatgtgatgcatgtgtttatattttgcagcaattttatcttacgacagttctatttcccttagtcctcagtatccctttttttttgttatcttaccagctgtctgttgattagtagttagcaaacatagagcgacccactttaatgacttcccgtgacatgaatatgacctcgagagattagtctagtgaacttattcagactgaatgttgtattgttaactgtactggcgtttggtcagtatctttcgaaagagattgaatgtagggacgtaattttattgcaagataattcatttgttcttgtggttcagtatcttggaaggtcttgtgatgttagtgaattcttttcgtagcattgcagtacttgctccgtccttaatgcatgattcaataggctacgcaatctcgtttgtagcaatgaattttaaaaatttggaatcgctaactatcgtttgacagatttatgagccttccatcattcgtttttttaagctgtcagatggttaaaaattataatttattatgaaccgaataaatagcttcgaacaagctaagctatgctgatgtagaaaaaaaatagttcgagaaccgtggtatatccccccccccaaaacctccccaacccacccataaaaaaccggatggcagcaatcacaacttagcattgcttctcatagcaatgttcgtatactataagtgcaggttagttcagacttcagacacctatggtaattgttttttattttgttcgttaggtggtgtttgggtccatggattaaactttagcctttatgtttagacactaatttagactaaatatagattacttacaaaaataattaaataaatgagagctaattcgcgagacaaattttttaagcctaattaattcataattagagaatgtttactgtagcatcacataggctaatcatggattaattaggcttaatagattcgtctcgcgaattagtccaagattatggatatgttttgttaatagtctatatttaatacttctaattagtgtacaaacatccaatttggaaagtgctaaaaaattttagtcccttccaaacacccccttattatttttatcaaatagccacgtaagcgtcatctcaatagcacgtgggacaaagacccctagtcaaaggcgtcatgtcagccaaaaccagagacattgctaccgagggagctcgtttgcatagttgaagaaggcgccatgtcagccaaaaccggagacatttttatcgagggacctcgtttgcatagttgggttgtactccctccatattttaatgtatgacgccgttgactttttaatcaacgcttgaccattcgtcttattcaaaaaattatgtaattatcatttattttattatggcttgatttatcatcaaatattctttaagtatgacataaatatttttatatttgcacaaaaaatttgaataagacgaatagtcaaacattattcgaaaagtcaacggtgtcatacattaaaatacggagcgagtatatggttttcggataaggatgaaaaacagacttagcgactataagggaataagttaactaatcataaaccgtgcgaaaaagatccaaaaacatacggagcgacaaagtaagggacctattgtgaacttatttgagggataaagtcacttccttaactacaagggaataagttcacctgacgtccctcaactttatgttgagtttgtctgcggtccccaatccgcgatagcaaaaatctctacccctcaactatcacaaaccgtgcaaaaaagatcccaagacaatattgatccattttccccggttttgctgatgtggcatacggtgggacccacatgtcagcgtcctgtcttctcctcttttcttttttctttttttttcttcttctctcttctcctcttcccttcttcccctagcctgagaggccagcgggtgggcgagcaggcgacggtaggaggcagcagcggtgtgcggagcaggcaaggggtagcaggcgacgggcgagcgacgacgcctcagagagggtgtggtgtgggcgtcgctgtgctgtgtcgggcagagcgaggtggcgtcggtggggtgtagaggacgacggcagatggaaccgacggcggatgctgtaggggacgatgacgcggaggacggagtaggccgggagaggatgacgctgatgcgcttggggtttcaccgggagaccccgccttcaccgtcttcgtgccctcaccggagtcgttccacaacgtcctcgggctgcggcatcccaacgacagcgttgccgatgggtgggtctcacattttctttctatttcacttacatgtgagactcacgtattattttatttctattttgttgactaagatgtcacgccagcgaaaccaagacatctatactgccatgggatataaattgaacggttttgtatatttaggggtgaagatttgtggtattgaggataagggatgacaaacaaactcggtgtaaagttgagggacatcaggtgaacttattccaactataaggcaacgcatcacggcccatggcccatgggatgcgcattctggcccacaaagcagcacacgctctctcccccaccagtaagccctagcctccaggagctcagccgtataaagccgcagaccttctccttcccctccccgccgccactcgccgcagcgtctcgaccagacaagggagcgcctccgaaaccctagctccccctttcccctccgcggccaccaaaatggtacgcttctccctcctccccgtccgcctctttccgtcgcacgacggcaagatcatgcgcgtgtgtgtcctcgtgccagtccacggcaccctgctctggtcgatttgtagggggattgcattctttattcatgttgatctgctgtagatgggggcgatcttgagccggaggagtagctagcttcttgttgatgcggtttcgggatttagagatttaacacggagattgatagtttctctttagcgatttctttttttcttgttgatataatgatatccacggtgattgtactagttatggtttttttatcttcaatgctttgtattattgtttttgatttgtgggtagagaccagattattgttgttaagatggacggattctctgagctggtcctttgcatgctctgaagcgcagaaaatttgtgtaatgggttatatctggattatgtgtagctattaacttctgtagtaaacattttcatcttcctttgaggacatgggatgaattcctttttttcttctcttgttgtgctaaaattgttcggtaatcttgtctgtggctttgactgatgggctccgatgatggcatgaaatctttgagacctgacattcttgtgatgacaaacataagcatatttcctgaggacccaattgagtttttaaccattggtctgctgaatgtgtctttgctgttgaaaaatatgtatacacatttgcttctgattatgcgcatttgattgtgttgtttataggcctgctatgtgctttccaacaaccagtatttgttaaatttgtttcatatttgttatgtatataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtactgtgacagtttatatgtgattgcgcagtgttgtgtcttactgtctctcttcattagaaacatatggtgtcatgattgatgtgtctgttcaatgcaaacatgtggtaataaccatcacgtagttttaaagtatatgactttcagctgtgcatttttcatgttatgatacatggttcctgttttcaggcaaaaaccaccaagaagattgtgctgaagctgcaatgccaaagctgcaagcattactcccagcaccccatcaaggtatttttgcaatgtgaagattcaagctgaaaattctcatgaatcagtatctttttagatgtgttggatgctcacttacataattattctgtgcagaggtgcaagcattttgaaattggtggagacaagaagggcaagggaacgtctcttttctaaactacctactggatactgaagttgtgggtctactgtgcttcatacttcaatgttattaggagcttaatttaagcagaccatatcatgtattcaagtactctagcaaggattggctttctgctgaatcaagttttgttgcttaatgctcattgaatccaatgtgatgcatgtgtttatgttgcactgcaattttgtcttatggcagttttatctccctaaggactcggcgtctgctgttcgttatcttacctatttttgaatcctagagcgacccacttaaacat

SEQ ID NO: 9947 - DNA, 745 bp, Oryza sativa
  unsure (1)..(745): unsure at all n locations
cgcgggtgaatcggctcgttgcncgtgttcattggtcaactttggtagttaaggaccgtaaacagcgatgatggttacgaaatattgtaataaaccccaagtcgtcgattctttgtcatttgaaaatccatagcagcggtgtcatgataaagattgggataatgatgattccgatttgaagtggtgtgtaattcagtcgagtcatatctcctaggtctgaagtcgtcgaagattttttgttcacgcgattcgccttttggacccatctcatcgaaaccttgaagcaccatatccccctacctggcacgccactttcgacgggctatagccgcctacggtatttgtagaatatggaaattgttagtgacatggtatacgcgagattgaggtaaaagaggcaggagatggggacttttatacaggttcggaccacgtaactaatgggtaatagccctactcctatcggctgaagccggtgttgccttttatatatcaatatcacacgagtacaatattggagaggacttaatctagtcccggtcaagctttaaggcccccacaaaccccccccaatgaactctacatgggcggcggtagtgtttctgcctctcgaattacacgcgagattgaaatgnatnnnngcttgctaaaccccnnnnnnnnnnttatccgtccggtagcnnnnnnnnnnncnnnnnnnnnnnntnnnnnnnnnngtctctttgtccaccttgatgaaaaccat

SEQ ID NO: 9948 - DNA, 18602 bp, Oryza sativa
  unsure (1)..(18602): unsure at all n locations
aggcgcgttgggtgggtaaaattttacttggtgccaatagtttctagatttccaaggaatatgtgattggcacaatatattttttttacacagatatgcataatcctggttcacaaaatcttactactacaagttaatcgcaacttaaaaattcgtttctcgttgattcttgtatagtagtatctcctgtaagtgcagtcaaatcttgaacccttaaaaatttaatagacgtaaaaatatttaaaatatgaaaagttatattggtatatttttttttatgagaaactctctttcataaagttatattggtaatgtttttttaaatatatagtttagtctttagagactagtggccctgcggcggtcgcggcgacggatctagcctcccccgtcgtcgcggcggcagatccggcctccaccatcgtcgcagcggccgaatccggccccgagcttatggcggctagcggtggagaggaggaggccacgccccaccaccgcggagaggcggtagaggcgacggcagccggcggcggtggagaagggaggaagaaggtgaaaccgagagagaaggaagagaggcggcggaggggccgcgcagtgggggaagggagaagggagcggtgggggtgggggacagtagatttatatattcgcccaaaacatttttcgcagtggtcctccttacctactgccggtgaaaatgagatttttcgctggcggacacttaagaggtccgcctcgaaaaactggcagacacttaagaggttcgtctcgaaaaatagagtagtttttttaggcatttctcttagcgtggttatcagcaaaaattggtttctgctggtggtccgtagccccccacctattgttatgtttttttggcggtttttgcatatggacgccagcgtaaaatatagggtaacatcacgaaaaatcgttttttatagtgtaaaattgttatgatgataaaatgtgtattgcggactatgctgatgatgtcactcatctgaaaacagagatagtaacaaggagtgaacacgttacatatgcccacttaacccttacgaaaatgtattcgagaattactaatctaaatgctccactacgtacagtacatcgtcggagattaattgtgtgatgggccacaagaatgagctgccatgcactcgactgaattctgatggaacaggaacaccatacagtattggtaccggcgacagcaacagcaattggtttctgcttctcgcgttgacaatttcactatgctaaccaccactttgtccactaaaacgcgctcatgaccaatgtcaaatcaaacccgtggatgaacgtgcacggcccgagtactccaccaagcaagattcagctgccgagtgaaagaagaaaaagctatttgcaattgctcaaattaaatcaccttgggaacagatgcaaacctacagctaacacagttcgttacggtcctaaccgtatgttttttatacctcgagaaataccaagttttatataaaagaaatggtaccttctaataccaagaacagtaaaattactcccaagtccaaatactacaatccttctaaaataagtatgattttatattcaaattttgttttaaaataagtacaatcccgtactacttatcacatcagttcatcttatcctcaattggaagagtacgaagccggcacgacccccgcgtcgccctctcacgcgagcggcacagggggtgaaccctagcccccgccgccccctcccttcctctcccccctcgccgccgccggagcgcgccaccggagttccgcgcggccaactgtgagggcggcggcgaggccattcctcggcgacgcgacggctcagcgtgaggatgatgacgcggcgcgtgataggtgggggctgacatcagcgcggcgcgaagcttcggatctggcgcccccgtggctggatctggcaccctgcttttggacctggccggaggagagcaacaatgccgtgcgcggtggcgcgatggggcgtggtggaggcggtgcggcggcgtgtgtcccggcgacggtgtgctgttcccggcgaaggagcggtcgtgctccttggccgcggagggcagtcgctagcggtgctgtctggcgacgtgtcgtccgtgagggcggtgacgggcctcggcttggctccttgtagtccccccctcagcattttcagtacaggaaaattacaatacattagatttagggtgcaatcttttcagcttatgaacttcgggatatgcataccactgttctcaaactagaaattttctacatcagcattgcctggctcgttctaagctatttattcggtttataataactagcatggtggcctgcgcatattgcgcggctagcatcattatattttctctcatataatagcatatatgttttctcattatattattataatatattacaatgacaacataattttaaattttgcaataacttttcaaaactactaatgtgtaataactactctagtctcctcttctaatatttcttattttttaattctgaatttcagctatttctaaattgtatttctatatggactctgttttttctttttctctgattaatgtgagaatttctatgccatgagagcgaacctgaaagctcctttttattccgaattttagttggttttaaattccaatatgaactctatattctacttctaatattccttattttttaattccaaatttctattttttttcttaattgtatttctataaggactctatactctacttctaatatttcttatttttaattccgaatttcggttatttcctaattgtatttctatatgtactctatactctacttctaatattccttatttttaatttcgaatttcagttatttcctaattgtatttctatatggactctagtctccacttctaatattccttattttttaattccgaatttcaactatttctaaattgtatttctatatggactctagtctcctcttttaatatttcttttttttaattccgaatttcagctatttctaaattgtatttctatatagattctgctttttctttttctccgattaatgtgagaatttctagatcatgagagcgaacgtgaaggctcctttttttttccgaattttagttagtttgaaattcctatatggactctatactctacttctaatatttcttatttttaattccaaatttctattttttttcttaattgtatttctatatggactctatgctctacttctaatattccttatttttaattccgaatttcagttatttcctaattgtatttctatatggactctatactctacttctaatattccttatttttaattccgaatttcaattatttcctaattgtatttctatatggactctatactctacttctaatattccttatttttaattccgaatttcaactatttcctaattgtatttctatatggactctatactcctattctaatatttctttttttaattccgaatttcagctatttctaaagtgtatttctatatggactctagtctcctcttctaatattccttatttttaattctgaatttcagctatttctaaattgtatttctatatgaactctgtttttttctttttcttcgattaatgtgagaatttctaggccatgggagcgaacgtagaggctccttttttttttccgaattttagttagttttaaattcctatatggactctatactctacttctaatatttcttattttttaattctgaatttctattttttcttaattgtatttctatatggactttatactctacttctaatattccttatttttaattcagaatttctattatttcctaattgtatttctatatggactctatactctacttctaatattctttatttttaattccgaatttctattatttcctaattgtatttctatatggactctatactcctcttctaatattccttattttttaattccaaatttcaactatttctaaagtgtatttctatatgaactctagtcttctcttctaatattccttattttttaattccgaatttcagctatttctaaattgtatttctatatggactctgtttttttttctccgattaatgtgagaatttctaagccatgagagtaaacgtggaggctcctttttctattcctttaattatataatagatttaggagtgtaatatttaattcattactataaacaattgtcaataacctatccaaatcatgcatgaagaatggaacaagtactacaatgctacgaaaacagttcactaacatcacaagaccaaacattgctacgaaaacagtttcactaacgccacaagaccaaacattagtatcgaccttctaagataacaatcacaagaccaaggcctatcttacaattcacctccatccatggtattccataccttctatctcatgacgaagatattgaacaaaacatagtatagttaaccatatacgaaattcagtctgaaaaatggaagttcatcagactaacctctcagggattcatgtcacaggaattcgtttaagtgggtcgctctaggattgcaaacataggtaagataacgaaaaacagacaccgagtacttagggagataaaactgccataagacaaaattgcagtgcaacataaacacatgcatcacattggattcaatgagcattaagcaacaaaacttgattcagcagaaagccaatccttgctagagtacttgaatacatgatatggtctgcttaaattaagctcctaataacattgaagtatgaagcacagtagacccacaacttcagtatccagtaggtagtttagaaaagagacgttcccttgcccttcttgtctccaccaattttaaaatgcttgcacctctgcacagaataattatgtaagtgagcatccaacacatctaaaaagatactgattcatgagaattttcagcttgaatcttcacattgcaaaaataccttgatggggtgctgggagtaatgcttgcagctttggcattgcagcttcagcacaatcttcttggtggtttttgcctgaaaacaggaaccatgtatcataacatgaaaaatgcaccctgcttttggacctggccggaggagagcaacaatgccgtgcgcggtggcgcgatggggcgtggtggaggcggtgcggcggcgtgtgtcccggcgacggtgtgctgttcccggcgaaggagcggtcgtgctccttggccgcggagggcagtcgccagcggtgctgtctggcgacgtgtcgtccgtgagggcggtgatgggcctcggcttggctccttatagtcccccccccctcagccggcgatgaaggctaggcccggcgcccccgactggtggcgtgcagatctgcgctcctagcgtctggatctggtcgaatccgtggcaccggtggcaggctctggcctcggaccccccctcccccgcgggactggtgaccttgcccaacaccttcttccatccccatccctcctcctccctcctctttgaggcgcccttgagctagccaacgagctccttgccataacatgcttggctctgatccatcaattaggatttgccagtgcctctccctctctctagatctccttttagcatgctccttgattgatggattaggtcaggtcttttatgttagtgcctacggttttctttggcttgaatggctactattcttgcagccttccctgttgacgcggttgatgttcttctagctgtaggattcccccctctaccacttatcttttgtccagctccctcttcgtctccacccttttccttggattgtcctcaaccacattgttcggcggccctctctcctttgaggcttccttccctaaaagggcgttggagggcgtggaactagctagcaatttgttatagtcggattgaagaagactcgatgcgagcagtctctatggccgcaacccatcgccgccatagacgtacggacggccggctacaacacaacacagtaactgtaactgaagaagccggcgccaccattcccgccgccaatatgctcgccgccgccgcctccgtcaagctctccacggccgggaccgccacggcgcccaagatggcattattcaagcccctccacctccctcccctcttcgccgccgccgccgccgccgccgggccacgtcccctctccctctcggcgcgccccctgtaccggcagcaggacccgttattcctggcgtcgcgcgtcgcgtcaccggcgccgccgccgccgtccgccaccgccgacggcgcccggccggtggaggctgcaccggcgggcgcggcgccggaggaggcggcgaggcgggccaagatcggggtctacttcgcgacgtggtgggcgctgaacgtgatcttcaacatctacaacaagaaggtgctcaacgcgttcccttacccgtggctcacgtccacgctctccctcgccgccggctccgccatcatgctcgcctcctgggccaccaggatcgccgaggcgcccgccaccgacctcgatttctggaaggccctgtcaccggtgagatcgcattgaccatggacaccatcgtctcctccttcttgattctgttctattctgaatctctgacgcgttcgttggatttggggattcgtttttgctcgttgtgggacgagcaggtggcgatcgcgcacaccatcgggcacgtggcggcgacggtgagcatggcgaaggtggcggtgtcgttcacccacatcatcaagagcggcgagccggcgttcagcgtgctcgtctccaggttcttcctcggcgagcacttcccggcgccggtctacttctccctcctcccaatcatcggcggatgcgccctcgccgccatcaccgagctcaatttcaacatgattggtgagtgagcaaacactctgcatctctctgtctctccacctgaaatcctggagatacttgcagcagatacaccagaaatatcctcactttttgattaaaaaaatagatattatctccaagaattcttcagaacaagaactgtccattaaccaaagatatgttttcttatgtcagataaagaaatatacaccagccacgaaaaagtgcacaatttgttcataaacctgacacatcacatcaatctgttcatcgtgtattgctgaaaattcgatgcaggattcatgggggcgatgatctcgaacctggcattcgtgttccggaacatattctccaagaaggggatgaagggcaagtcggtgagcgggatgaactactacgcctgcctctccatgctctcgctggtcatcctcctccctttcgccttcgccatggaggggcccaaggtgtgggctgccggctggcaaaaagccgtcgccgagatcggtccaaacttcgtctggtgagcctcacatgcttttctttgtaccacttctcaccgtttcactgtcacaaccatcacgtcagttgagatttttgggtatcaattgggcaaaaaatttctagtgataagtgcttgacctaagctttcaaacagtttcagcatgcaacactttgtactttcagtaacatcactcaagtattctatacaaaaagaaccattatcaattaatatagatataggatcgtcctatcactatcatttcctcctaagcggcaatatcttcttcagttcattctgaaagagaaataagaagtatcaaaagatttgatgatatttttgtgtgataatccagctgattcatgtggccatggatttctctgtggttttgtaggtgggtggcggcgcagagtgtgttctaccacttgtacaaccaagtgtcctacatgtcattggacgagatctcaccactgacattcagcatcggcaacaccatgaagcggatctccgtcattgtcgcctccatcatcatcttccacacgccggtccagcccatcaacgccctcggagccgccattgcgattctcggaactttcatctactctcaggtagattttccgcacatgttttaccaaatcacatttttcacaaaagagccaattcatgaacataagtctgaatctctaaccaaaaaaaaaacatctcattttttcaggcgaagcagtaatggcataagcatggaaatggcacccgttttcgccacaagtcgcgactcggtgctcgggatgtaacaatgctatgagcatatatccaaggatcccttgtaatatattagatcttcttttcttttcatttttctttctctaggtgtagctgccaatgtttcttctgaattcgtcgagttcttgtactatgactatgatgatgtagagaggtggatctgcctaaataaagctgttagattttttgcttgaccctttgctgctgctgctgctgcttctgaattttgtgatgtggtccaaaacacaaggtgtggttcagaatgagttgggggctaccggttagatcggagagcagaagcagtgcatgcttgacacactacggtccggcttgttttgttgctgggtgatggatgatgggtacagggcatggccctgaaaatccttgaatagtcccaactggcgctgtgcaatttgctcactgagatctctgggatggattcagcgttggacacttgcgattttccttacatgaaatgagaattttaggattctggaggaggcatataccccaaaaatgacgatctgttctggaatcaagaacagcttttctgggctccaaaaggccaaagccttttagcttcaaatgctagtagagtaaattgccagatggatgcactttactacacgaacttgtaaaagacttgtttcggtacatgaatttgttcgatgcatgtgaaacaaggtcaaaatgacacatcataatcaattttactaagttatacactgattaggacgagatgtgcatatggaggtggacatgagacatgcatttgtgctttattattctttgttctaccccttgcactatttctcagtatttttgtgtctttctccatacaatctttaggccttattaacccctttttattgaacaaatgtatatgtacttagcatttttctcacacatgtgtttatgtagtatcctaattaacactaaaataagattagctttgttttttcttttggccttgattcacatgcacctaacaagttcgtgtatcaaaatgagcgttttataagtttatgtactagattgcttccacctagcaagttcgtgtaccgccaatgcaatttactcatgctagtatttggagaaagcatataaccaaatgacggtttgtgcttgaatcaaggatagcttttctgggctcaaaaggccagagctgcttaggttccaatgaagatgtttctttcgtgctttttgggaggatcactgcgatggcactcctccgatgttgctacttgcatatccttctatactttatttaacttggctacaacttgaaaatgaacgcaaccaatcaccacggctgtccgatccaacagcattttcagtacaggaaaactacaatacattagatttagggtgcaatcttttcagcttatgaacttcgggatatgcataccacggttctcaaactagaaattttctacatcagcattgcctggctcgctttaagctatttattcggtttataataatttaggagtgtaatatttaattcattactataaacaattgtcaataacctatccaaatcatgcatgaagaatggaacaagtaatacaatgctacgaaaacagttcaataacatcacaagaccaaacattgctacgaaaacagtttcactaacgccacaagaccaaacattagtatcgaccttctaagataacaatcacaagaccaaggcctatctttcaattcacctccatccatagtattccataccttccatctcgttacgaagatattgaacaaaacatagtatagttaaccatatacgaaattcgatctgaaaaacggaagttcatcagactagcctctcagggattcatgtcacaggaattcgtttacgtgggtcgctctaggattgcaaactcgggtaagataacgaaaaacagacactgaggacttagggagataaaactgccataagacaaaagtcacaattgcagtgccatctaaagacatgcatcacattggattcgacgagcattaagcaagaaaacttgattcagcagaaagccaatccttgctagagtaaatgtcagacgatgatacttgaatacatgatatggtctgcttaaattaagttcctaataacattgaagtatgaagcacaatagacccacaacttcagtatccagtaggtagtttagaaaagagatgttcccttgcccttcttgtctccaccaatctcgaaatgcttgcacctctgtaaagaataataatgtaagatagcacccaacacatctaaaaagatactgattgattcatgacaattttcagcttgagtcttgacaatgaaataataccttgatggggtgctgggagtaatgcttgcagctttggcattgcagcttcagcacaatcttcttggtggtttttgcctgaaaacaggaaccatgtatcataacatgaaaaatgcacagctgaaagtcagatacattaaaactacatgatggttattgccacatgtttgcattgaacagacacaaatcatgacaccatatgtttctaatgaagagagacaatcacacacagcactgcgtaatcacatataaactgtcacaataccttcttgtggaaaacaggcttggtctgaccaccatatcctgactgcttacggtcataacggcgctttccctgggcagacaggctgtccttacccttcttgtactgagtgaccttgtgaagggtgtgcttcctgcactccttgttcttgcagtaggtcttcttggtcttgggaacgttcacctatacataagaaatatgaaacaaatttaacaaatactggttattggaaagcacatagcaggcctataaacaacacaatcaaatgtgcataatcagaagcacatgtgaatcgatatttttcgacagcaaagacaaattcagcagaccaatggttaaaacctcaattgggtcctcaggaaatatgcttatgtttgtcatcacaagaatgtcaggtctcaaagatttcatgccatcatcggagcccatcagtcaaaaccagacatgattaccaaacaattttcgcacaagataaaaaaaagaattcatcccacgtcctcaaggaagatgatgaaaaatgtttactccagaagttaattgctactccctccattccttaatacaaggcataacttgtttggactcggagaacaagaaaacctataactacccatcgtaccgatttattccagcgcgttccaatgcgtgacgctttgatcagttcatcgcatctagtgccaaagcagcatgcacccgtgtcctgcagtttttgcgcgtgcatgcaagcatccgagtggtggatcctttgcctttaaactaatgaaccgaatatcatgagctcatgcaaccatccattcaatgcttgcatgcaccaagtacggagttgagcagttgccgccttgtatactggtacttgaagaaaagacggttgcgccttgtattaagaaaagactattgaatgacagcaatacacataatctagatataacccattacaaaaaaattccgcgtttcagagcatgcatcttaacgacaataatctggtctctacccacaattgaaaaacaatcacacaaagcactcaagataaaaatgacataactagaacaaccaccgtggatatcattatatcaacatgaaaaaagaaatcgctaaagagaaaccgcgaaaccgtgttaaatctctaaaaaccccgaaaccgcatcaataagaaactagctactcctccggctcaagatcgcccccatctacagcagatcaacatgaataaagaacgcaatccccctacaaatcgaccagagcagggtgccgtggactggcacgaggacacacgagcgcatgatcttgccgtcgtgcggcggagagaggcggacggggaggaggaagaagcgtaccattttggcggccgcggaggggaaggcggggagctagggtttcggaggcgctgccttgtctggtcgacacgctgcggcgagtggcggcggggaggggaaggagaaggtctgcgactttatacgggtgagctcctggaggctagggtttactggtgcgtgtgctgctttgtgggccagaatgcgcagcccatgggccatgcaccgtgatgcgttgccttatagttggaataagttcatctgatgtccctcaactttacaccgagtttgtttgccatcccttatcctcaataccagaaatcttcaccccaaatatacaaaaccgttcaatttatgtcctatggcagtatagatgtcttggtttcactaacgtggcatcctagttagcaaaataggaataaaataatatgtgagtcccacatgtaagtgaaatagaaggaaaatgtgagacccacccatcggcaacgttgttattgggacgccgcagcctgaggacgcggtggaacgactctggtgagggcacgaagacggtgaaggcgaggtctcctggtgaaaccccaagcgcgtcggagtcatcctctcccggcctacttcgtcctcctcgccatcgtcccctacagcgtccgccatcacttccatatgtcgtcgtcctctgcaccccaccgccgccaccccgctccgcccgccacagcacagcgacgcccacaccacaccctctctgaggcgccgtcgctcgcccgccacccgttaccccttgcctgctccgcacaccgccgccaccgcctgccgtcgcctgctcgcccgcccgccggcctctcaggctaggagaagaagggaagaggagaagagagaagaaagaaaagacaagaagaaaaaaaagaaaaaagaaaagaggagaagacaggacgctgacatgtgggtcccaccgtatgccacgtcagcaaaaccggagaaaatggatcaatattgtcttgggatcttttttgcacggtttatgatagttgaggggtagagatttttgctatcgcggattagggacctcagacaaactcaacataaagttgagggccgtcaggtgaacttatattcccttatagttatgaagtgactttatccctcaaaatgagttcactttaggtcccttacttcatcgctccgtctgttttgtgatctttttcgcacggtttatgattagttgagaggtagagattttattgtggattaggaacctcagacgaactcgacttaaagttaagggacgtcaggtgaacttattcccttatagttaaggaagtccaagtggactttatccctcaaataagttcactttaggtctcttactttgtcgcttagtctgtttttcatccttatccgaaaaccatatacaatccatccttcaaagtgtgcaaacgaggtccctcggtaataatatttctggttttggctgacatgacgccttcttcaaactgtgcaaacgagctctctcggtagcaatgtctccggttttagctgacatgacgcctttgactaggggtcttcgtcccacgtgctattgacatgacgcttacgtggctatttgataaaaataataaggaggtgtttggaatggactaaaattttttagtcccttccaaattggatgtttggacactaattagaagtattaaatatagactattaacaaaacctatccataatcttggacttattcgcgagacgaatctattgagcctaataaatccatgattagcctatgtgatgatacaataaacattctataattatgaattaattaggcttaaaaaattgggttaattggatacatgccattgtaaattcttcagttttgaaatataccattactactcaactatttggaggtatgccattataatttttcaggtattggaaatataccattacataccccttggatatgtctaacaaaaattttggaccaaattgcccccgtcttcttcctttgcctcccccatctctcctgttctgttgttcatcttcttcctcccgtttcttgctgctgtgagattaggagtacacagtaatagtcactttgtcaggatcatgcacaagcagggccggccctagggggggtcagcccgtgcgcacgcccgagtcccccaaaatttagggggccccatggcggatgggccatggcccacgacgcccccagggtcagcatcgctctcagtcctgaatcatgtatggtatcgaagacagaagacgaagaggagcgaaggaaaagtgaagcgatctgactccgttcccgtcgcctcgatcacgcctcgcgtcgcgttgcaaacggtaaacggcggcaaaccgcaacgcaaacacggcaatcggcagcaaatcgcagcggctctgcatgactggctgactacgtcgattggaggccaaccgcccggcggcgcgccctcatcggccgatcggctgctcgcgcctcgcagtcgtcgtctaaggtaattttctctatctttctttttcctctttatagatcaaaaattattagcttgtactacttaataattaatgattattttttagcacaacattaatcatattgtcaagaaaatatgtatccggtagcgaaaaaagaaaacggaaaaaatgttcggatgatttcattgaaattttagaagaaacttttgaaagtgccaagtaagtgtttatgattatattatttctctttgaaagttttaaaatattatatatagataattttatcatatcaaatattaaatattacatgtttataagactataaatatatatattagtttatgtatatatataggggcctccacgtaagtttttgtcctagagcttgaaaactcaggaccggccctgtgcacaaggcgcgctcgtcgacgagcacgtaatcggtggacgtggaccacgccatggtgaagccgctgtaggcgaatgactccagctgcaccgacaggggcacgtccttgggcgtccgggtgctggacattcaagaacgacatgctccgcgtcttggttgttgcagtagacctcggggaggctggaaactgagaaggtggtgatgcggccagcgaagggaagaagggaaactagatggtgcagcacaacaccgccgttgctggccgagaaaggagatgtggaggaagaatactaagataccagatccaaaagggaaagaaatggaagaaagaagatgaacaggagagggtggagacaaaggagaagacgagagcgatttggtctaaaatttttgttaaacacatccaaaggttgtacagtgacatatttccaatacctgaaaaagttgtaatggcatgtttctaaatagtttaatagtaacggtatatttcaaaactaaagattttataatggcatctatccaattaaccctaaaaaatttgtctcacgaattagctctcatttatgtaattagttttgtaagtagtcaatatttaatactctaaattagtatctaaaacaaagactaaagtttaatccctggatccaaacaccacctaacaaacaaaataaaaaactaaaaaaaaacaattaccacacgtgtctgtagtctgaactaacccgcactcatagtatatgaacattgccatgagcagcaatgctaagttgtgattgctgccatccggtttttttgggtgggttggggggcagcttatgacagttacaaactttggaatataccacggttctcaaactaatttttttctacatcagcattgcttagcttgttcgaagctatttattcggttcataataatatataatttttaattcattactacaaacgggattgcgtagcctatcgaatcatgcattaaggacagagcaagtactgcaatgctacgaaaagaattcactaatatcacaagaccttccaagatactgaaccacaagaacaaatgaattatcttgcaataaaattacgtccctacattccatctctttcgaaagatactgaccaaacgccagtacagttaacaatacaacattcagtctgaaaaaggaagttcactagactaatctctcgaggtcatattcatgtcacgggaagtaattaaagtgggtcgctctatgtttgctaactactaatcaaaagacagcaggtaagataacaaaaaaagaaaagggatactgaggactaaggtaaatagaactgtcgtaagataaaattgcagcaaaatataaacacatgcatcacattggattcaacgagcattaagcaacaaaacttgattcagcagaaagccaatccttgctagagtaaatgtcagacgatgatacttgaatacattgatatggtctgcttaaataagctcctaataacattgaaatattgaagcacagtagaccaacaactatagtatccagtaggtagcaagcaatttagaaaagagatgttcccttgcccttcttgtctccaccaatctcgaaatgcttgcacctctgcagagaacaattatgcaagtgagcatccaacacatccagcaaaataatgattcatgataattttcagctctggagtcttgacaatgaaataataccttgatggggtgctgggagtaatgcttgcagctttggcattgcagcttcagcacgatcttcttggtggtttttgcctgaaaacaggaaccatgtatcataacatgaaaaatgcacagctgaaagccacatgcaattaaaactacgtgatggttattgccacatgcattgtacagacacatatcactgctacatcaatcatgacaccgtacgtttctaatgaacagagagtcacacacaacactgcataatcatatataaactgtcacagtaccttcttgtggaaaacaggcttggtctgaccaccatatcctgactgctttcggtcataacggcgctttccctgggcagacaggctgtccttacccttcttgtactgagtgaccttgtgaagggtgtgcttcctgcactccttgttcttgcagtaggtcttcttggtcttgggaacgttcacctatacaaaacaaatttgaaacaaaagcactcagcttaacaaatactgaatgtggaatggacatcgcaggcctataaacaataatcaaatgtgcataatttgaagcaaatgtgtgtacaaatttttcaacagtgaagacacattcagcaaaccaatggttaaaacctcaattgggtctcaggaaatatgcttatgtttgtcatcacaagaatgtcaggtctcaaagatttcatgccatcatcggagcccatcagtcaaagccagacaagattaccgaacaattttagaacaagagaaaaaaaaaggaactcatcccatgtcctcacaggaaaatgatgaaaatgttcatactacagaagtttaagtgctaattaaatgacaacaatacacatataatctagatataacccactacaaaattttcagcatgcagagggtcagctcggaaaatacgtcgatcttcacgacaataatctggtctatacccacgattcaaagcattgaagtcttgaagataaaaatgacataactagaacaatcaccgtggacatcaacatgaacaaaaaaaatgtcgctaaagagaaaccatctcatgttaaaatccgctagaccccaaaacgcataatcaaagaaactagctactcctctcctccggctcaagatccccccatctacggcagatcaacatgaataaagaacgcatcctacaaattgtgaaacaccatgagaaagacggcgcgcggagccgtggactggcacgaggacaagcacgcgtgcgatcttcccgtcgtgcggcggaggggaggaggaggaggaggaggagggagaagcgtaccattttcgcggccgcggggagggggcggctagggtttcggaggcgagcggcggtggcgggggaggagaaggagagagaggtctgcagctttatacgggtgcggtcttggaggctagggctttactggtgagggagatagagcccatgggccgtggtgccccggctaagccccgcaagatattgtgggcttgtggccgcactttcagcccatgggcagtagtgccccggataagccctgcgcgacattgtggccgtttggttggtaaaaattttactcgtgacaatagtttctagattttcaatgtatatgtgatttgcactatatattttttttacacagatatgcattatccttgttcacaaaatcttactactaccagtttatcgcaacttaaaaattcgtttctcggtgattcttgtatagtaggatcttctgtaagtgcagtcaaatctttgaaccttaaaaattttatagacgtaaaaatatttaaaatatgaaaagttatattggtatatttttttttatgagaaactttcttttataaaagtatattggtaatgttntttttaatatatagtttaatctttagagacttgtggncctttcngcggtcgcggcgaccgatctagact

SEQ ID NO: 9949 - DNA, 2723 bp, Oryza sativa
  unsure (1)..(2723): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcttctgaagaataatcttgttgttcaaatgttcttcccaagctcgaccttcttaaccagccgcaaggtgttgtggaagatggaatccagtattccagcaacctagaattcgcatgtcatttcattagccatgtacacttgatggattcagagaaaaggaaaagataaaaaaagggtgtgtgctctcaccgtgaaaactcctccaatgatagcacaaacatttgtgatgaaatgggagaaggattttggaagttcagttaccaagaccttggaagtgatgataaaataagaattagtttttctttcagttatgaaccaaacgaagaaaaggtgagatgccaacctgcatgggagaaggttcaaaatggaatttcacaacaggaacatagaagctgtgcaccaagctgctgtgcgctgtgtattcatactcctcaaccagtttcaattcctttgatgatctcagtgtaacaagctcagttttcacaatttgcaggtaatgctcaatctaagaatgacaaaaaacaaaaactatgttactccataagaaaccagaaaatttagtgctggaaggcatgcctgctgtaatcatcttgataacaaaaacaaagcaaaatttagggacttacagtaacgttggcattgacatcaccatgcttaacaatgtaggattgaccagctaatctatcatggtggccaccaacatagggagttagtcttttcagttcattaaacatctttgccgatagccttttgccaaaagagaactgtgttacatagtgggaaacatttatctgggatggatcaaaggagtgggaaccagatcgagctgagattacaacactcccagggacctgataaagaggaaccagaaatcaaataccacagatagagatcatcatcaacactacaactattacacctcagaagttcatttaccttttttacccgcacaaaaccttctattctgcatccactggtcaatggagcagggcgttttgcaggatcaacagtcttattggatttgtcctccaaagctagaacatgggcatcttttgggatgtttgcaacataagtttccattgcctgaggcccaaaaaaatgtcaggaattttatccacaatttgacaagaccatgaacaaagtcagtgatttacaagcaaaggatagttagccttttgttctccctaggaaaatggggacaataccttttacaggtaagctaaagcttagggtgaagaatatatcatgcagtacatcaagaaaaataagtgggtaacagaatatacataccgctactaaactctcagtatcacgatcgccgtagtatgattcatgatcatggtgaccctggttttccctgcacaaatgtcaatttgtttgtttctggaacatgagcaaaaaaataataataatacaagtcttgcgccacaggttaactctcagtagagtatccggaagactgtaagatttacttgaacttacttaagatcactccctttacggaaaatgcgaatggatggataaccttgtatatggtgcctgcatttaataaattaaaacaatgaactgtagtccttaatttaatgacgaacaagcataacaagagcacatataattaggtaaaactagtgggagaacaatttaaggcttctattgaggagttgtggttcacatccaatgcgcatagcttgaaatgttactatgtgcatcaatggcaatggcactattacacagaaaccagtgtcatcagaagcagaatggctcattttcttataaaaacatggtcagtaacaattagggttgtgatctatggaataaaggcttttgaatcattccaaatgcaaacaagtccagaaggcataagcatccactgaaccaggataagaggacacaaacacgaatagctcatgaaagatgtggcataataatgacactttgttggggatattaaaaactagagtaaagtccatcaccgcnnncttgacatgtgtttnaaaggcaatgcggtccctagacgttcttgtatagcgagataatacattagcttgtgcgactgagtatcccggaaggattagcgatatgagcgcattcttattggagcaaatcagttcatgcttttgacttaatgcattatacgataagctacacaatctccgttgtagttatgaatttaaaattatatattattatgaaccgaataaatagttttccatgaagactcgcaatgctgatggggacaaaatataattttagaaccttaggatattccaaagtttggaacttgcataagctgnccccaacccacccaatataccggatggaacaattacaacttagcattgttgctcatgacagtgctcatatactatgagtgcgggttagttcaaactacagacacgtgcggtaattgaatttttttacttttttatattgttcgctaagtggtgtttggatcccagggataaactttacgtgttaatttg

SEQ ID NO: 9950 - DNA, 22687 bp, Oryza sativa
  unsure (1)..(22687): unsure at all n locations
cgtgcgattcgtttgcatgcgctnnnnnnnnnnnnnnnnnnnnnnnncatctgggtcaaataggacggtctaaagactttatatttaaaaataattcataactttttcatgtgaactctaatgaaaacaaactttatatcaaacttgtagccctcgacgcgatctacaactttgtagttgataattcctttattttaagtcattttttgacccaaaatgtaattttaaaattaaaattacaaaatctataaacatgcaacaatattttgggaccctaaacagttttaattcaaaaaattttcaactacaaagttgtaggtcgcgtcgagggctacaattttgatataaagtttgtctttattagagttcacatgaaaaagttatgaattattttttggtataaagtttttagaccgtcctgtttagggaccggggtgacacaactgaacaagttggaggacctaaacgagtgatctgcaagtttagggaccgggatgatacagtcgaacaagtttaaggacctgaatgatcgatttgcgagtttagggaccgggatgacacagcggtacaagtttagggaccggtgatggactttactctaaaaactaattaactaaatttctcttggtacatggatcaaaaagggatttgtaaagttcatgttgcagcctaaatatgctttgtccttgttttggatatgaataataattaagtacagacgaacctcctacacaagtcaatttcttcagtgcagtcaaccttggcaagaatgattctgccatccatttcaggatcatatctgcagaaaaaaaaaacaacatggtatagattaaacagcacattaaaaccacaaaacacaaacaaagagaaacagtatgtacctctccctcattatttttgcagtcttctcccacgaaggtttctggaggaagatcaagtaattagaaatgtctccatttgttagttcaataagccgtgccatacttacattactttaccagcaataatttactaatcatttccttacagatagagtagcatatactagaaaatcactaaatgcaaaggaacaagatgaattctaaccaatcgattgctccagtaacaccagggggcataaaaattaacaaccaaaacaggatacctgaaaaggaagtgcatgataataatcagtggaaacaatatttgggctccgaaacaatacaagagggattaactagatataccgaacggcacttcaaggaaaaatacttgaggcaggtaaaagtgaagattatcaccaatttgccatagacaatctggttgaagtgattggagctatgaatataaagtacatttctccatgaatgtgaaggagaaagaagacagcatacatgaataataggttgaccgttgatatggtattgaaacgcacaattgctaaaatgctatatgttatgtgttacggataggtggatattgaaatacatatttgaatacttactggtgtgaatagctatcaaaattgcgagaggacaagggaactgaaccatcatcatggttttcttcaacatcatctccatgtttgctgaccgtaggaataggtcctgggtggaactcggatccagtaggcactaaattccgatcaattgaatatttgcgaacagttttcggtatgttcaatctgttctgcatgtgttttgaacagaaactttaaggttaaaccagcatggagaaaaactcgagctacaaaaggcaagatatgatcaagaaatgcttatagatagaaagttagttaggaatttaggataggtttcattcttttgacatgcacagaactttacaaaaactgataaattgtcatatttcgtatttttaacattggtgtaaaatatacatgtagagcttacttcctccgtttcacaatgtaagtcattctagcattttccacattcatattgttgttaatgaatctagatagatatatatgtctagattcattaacatcaatatgaatatgggaaatgatagaatgacttacattgtgaaacggagggagtacttttaaaagctagtggaaagttatttgtaatggcaagttaacaagaaaataaagtcaacaatagtttttatggaacgcgcaagatgagcttcatgtccttcaatgatatcctcattctagacggcagatgaacaaaaacagagtacatgaggtcaagttagaatcttactgttcccagaacatcactgacatcaactgatgcaaattcgcatgaaagtgcaggaaagctgtaaatcacagaaccagatcgtgagcatctactggaaaaacaaggaaaagttgagtccagctttgctgatgtcattccatagaaaacaatgggcaaccagctagactaatgtagataccctcctatgcattatcacatacaaataaatgagcagtgcctgactagtccttgtttgctggaaagcatcaatttcaagtataaacaatggctctcaggttcatatagaccaagggttgaaagtgttgagtaaaagaacaacatcagaattattctacaaacatattactacaaatggttggatctggtaattaggtgacctttgaagataaatgaattaactgagaatcatatgtttttttccacaatgcaccaaatgagtacaaatacattgaaaagaatgtactgagtgcctgacattaattaacgctgtgctttgctgttgcatatatagtattccattaaaattaatcacaatagggataaaattactatcagcagattagagaattaggaagacattagttctatgaaccataatgatagcagtattatctatgtgatcatgaaggttctcattttgtattctaaccttattacttgttgagatgtgcagcatgtgccatagaatttaccttaagttaaaatctatccgtaagaactccccatctgaactcctatcaacaatcacagatgtgctagtattgactgctaagtaattactcagttcctgcaataacaattgaacagatttagcttttcagttgaaatgaacctttaaactagtctaaagcttgattaaggaatcagctcagcatagtgaaaagtatagcacattgcaagccttaacaagcaacagccaaaattatgcatatgttccggagtaattacaatatacttgggcatatacattacttaactgccactttcaaggttggatggaccaattgataattcggtcaaaaatattcaaccaaaataggttcagttaagaatctagcctatcatgaagctctaatagtcaattgaaacagatatcaggaaaaacgagctattctcaatcatcaaatgaaacaagcaaatcgagactctacattgatccggcgatagcgattagctacactacagcagttggaatggtagaagacaactaatctgcatataaataaataaatgctctatcattttagtatggctctgtaccaaatttcagtctacaatcaccaaatggaacagaagaacagtccaaccattttttgtttgtttccctaaagactggaaccagagtgaaaaaatgaaatctaaaaataacagtgcaatcgctaatccaacgaaaactgaccattccaaacaaaaacaccatagctagtgctgctacaatggacaatccagccccagatagtgatgcctcggtcaaatccctaggaattttcctgcaagcacgaaaagaaaaagcgcatcaaccaaattacccatctcagtagaaaatacaccagacattacactactcgcaacgaccgcacgaatggtcaataccaccacatacgcccacgcaaccccgattttctcggtgcatcaacgaaccatcacaaaccatctactgcaatcgccagaacagccaggcaagagaattcacccaatccgaacccggaccagcacccccagccgaggaccgcgtcgaaatcccccccgcgcgcgcgcgcacagggagtaccatagcaagcaatggagggagagagagagagagatcgggagtggaggggacctgtagaagtcgacggacttgagcttactgaaggagatcatggctgccggcggccgggccctcctccccgccggtgacgaggtgggggtggggggaagagatcgggccgccggttgaaaagatttgaaagaaagaaaaggaaaaggaagaagaaaaaagccaaattttttgtgggggttgaaaaggaagaagaaaaaaaagcttgtccccttggggtcaacgttgttacgttcaaggttcgcaaaaaatttgcggttggaactggaaactccatttcttgcccgcgtcggtgttctttggttttcttttctttttttttctttttttttgattggaatagggccgtatacaaacgggtccatccgcgaaactagttgataacctatgaattcccttgccgctttccacgccttaaaaatgtaagtggatcaatccataaatctatttatagcttgaattagtagataagtcatgagtcaatccacggtttaacaaactaattttgcctacaaatagattcatgggttgatccgttagaatccttatgaccgattttaggataggtaaattggagtattttggataaggccataggataagagtaatctaattgatttagagtgatgtggtgacaaaataagtaaatgatgatgattttgcagcggcatcttttttaaaaaattatttttctgtagcattgaaattgatgatattttggtcctacatgccaattggatatgtaacaactcattaaattagaaaacatatgacttgtatgattttttttattcaattacacattagacacacacccacacacactattaaacatgtaacaccatactcacacacgctcacgcattatgtgagcgcctgagtttgtacttctaaaaaaagagacaaaaatcaatggcacatcactcatctcactaaaattttgttgaaagttcacctatatgtgtaggcaaaatataatattcgtggtatcaagattttgaaccctggtgaatggtggagtcatacgcctacgactctatcaccatataactagtgttttccctgcatgacactttttaatctcaagtgcaggataatattcactaaataagtttcactttggaccaccttttattacgattgtttcactttacattactctttaactaatgttttcactttaaaccgggtaatcttactttgtgtcactttggatcaccatcaactcttttatccatctacattaaatttgtcatttgtcaaataaattgtctatataaagcggtgggagttcactgacgaatcagagttggcgtactcaaaatcattcgtatgcttgaaagagagtaagggcaatccaaaatgcagcaaaagtaatattactcgatccaaagtgaaaacattggttaaatagtgatccaaagagaaataccggtaataaaaggtgacccaaagtgaaattttactaaacttttaaactatcaatttatgctaaattaagtttacaaaaccaatattaagttcacaacaatatgttactttcaaggcaacgcaaatttacgcgtatataccacctttacttttaaactaaaaaatgatattctattgatggccctttaaagaaaatttgcaactgtatatggcacctgaatggttatgtatcaatcatgagaggaatccaatggttattacttttctagatgtcatggttcaatgtacattaaattttataacaattaactatatttagtggattgtaaatgcatatggcatatggatggttgagatgaaagcatgagatggatcaaaaagctactattttctagatgtagggatgcaagtgggtagtcccgctacccgcataaaaacccgcttgctagtgtattttttacatcatagtacaaaatttagaagaaaaatgaactagaagtgggataagcgggaaaaaaaaacccgcttgcccgccccgcttgcatccctatctagatgacatggctcaatgcatgtcaagtttatggttccaactatagtaggatatatagatatagatatctaaataatctatatttgttctatagtagttgatgtgaaaatacaatactccatccatccttaattataagggattttagttggatgtggtgtattctagtactacgaatctggatatactctatgtccagattcgtagtattaggatgcgtcacatccaaccaaaatcccttatatttagggacgggggaatactacataacacttaaggcctgtttgggggagcttctatctgctgcagcttctcccagaatcataagctcccccaaacagtacagcttttggtccagattctaagaagctgtagttgtagaatccagaagatgaactataagtcagaagctgggaaacccagcttttccagattctcagaagctggctaccaaccagttgcttctcagaatcttaagctcccccaaatatgcccttagattttttatgtatcaaacatgagagggatccaatgactatgtgttatagttcaatgcacattaagctttatagcaataactattcttagtggattgtaaatgcatatgacaaatggatggttgagatcaaagcatgagaggtatttttttatggaagaaatatcaaaacaagttcaaacaccaccaaccatttattaatggtgattttgccatccaaataccagcatgtccttttgacttttatggtttaaaatgctaactagatgatttaagtatgtttaaaacaaattttcggtgcggcaacaatatatgctacaacatgaagactgatgaggacatcctccactattacccgctggcaaagacgccaaagtcgggcggcgaccgtgtgagcctttgaataatcccaccttgcttagcttgggaggaagaagccaccttaaaagggagagccacccttcccttattggactagtcttttagagagattaggcctttccccgagtgggtgtgcctaagaactgttggggtccgggcaaccttaagttattaggccttggccgaccccacctgagctggattgttatcatttgatacggcaaccttaagttattaggcctcggccgaccccacctgggccggattgttatcatttggtatcagagctgggcccttgttaagagggtgggaatgatgaggacatcctccactattacccgctggcaaagacgccaaagtcgggtggcaaccgtgtgagcctttgaataaacccaccttgcttagctcgggcggcgaccgtgtgagcccaccttgcttagctcgggcagcgaccatgtgagcctttgaataatcccaccttgcttagtttgggaggaagaagccaccttaaaaggagagccaacattcccctattggactagtcttttagggaaattgggttccccgagtgggtgtgcctaagaactgttggggtccgggtaaccttaagttattgggtctcggccgaccccacctgggccggattgttatcaaagactaaattaaatagctcttaagaaagtattataattggttttaaaagtcgatggatataaggaaaatcccgacctagaaactatatggtacttatcatactcgccatatcatatatcatataggtactacgtataaaaattgtatgcccaaaatggtttcttcaaaataaattcttatctaatctcatctcccttgctccttgtgttaattcttgtttcttgcatagagctggtttctttatcttttgccgttattcttattaactctcttgccaccttagtttttcttcttatgtcacacgatatttaatgctatgtaagctagctgaaatagagggttggaactaccctaacatatccggttctataagtgatatatttctaggtttacaggttgtgtgctttacttataaaaaaatatggcatacacggtttcttccatatgcaagccccatcgaataaggtcaaaaatcagttgttgctcgacaaaaatcaaagtaggcgatagaaatgcttggttgggtccagctagcataaaagcaaatttttttggaagaattgaatattgatagtactatatctctagctctaacacagttgtacctacatatatggaacatattcctttaatcatacatcaatttctagtagtacgttacttagcaccggtacttgtatttattactaattattttctttaattatagatgatgtacctatcaacgacgagatacttataatgactttaaatatgtcagatcagaccttgaaaggtgttcatatggatagagcgtgtttgtttatagagtgagtatttgcgcctaaatgtaatgtgtgtcaagaaaagaaatcccaattccgacatcgttttttaaaagaaaactgcaacctgagcaaagacaaggacagtaaaaaaacaaacttaatctaggatttcaatgacgtctactgatcttagggcctattcattttggaggaatttaaacatataggaatagtaaaagtggaggaataggaatgcatgaaaacttcaatccataggaattttccaaaaaggtttgagtggatgaaaaagtgtctatgttttctctctataacttgtaaaaaaaaactttgtttcctatacctacattcttattaaccgaatgatactcatatgaattaatccttaggaatccaaaacctttgaatttcctccaaaacgaaagaggacatattttcatgaaaacgagttaagtgttgaaaactcatgaaaatcatatcaaaaagtttcgtaaattcatgaaaaaaaatactagagataggtgtagatatgaaatacattctcaccaaatctcaactctaaactcaacttcgtttaagaggaaaaaaaagacaaatttcaggttaatagtaagaggacactattcacctgaaatttgtcttttttgttacacctaaataaagttaagtttgaactggagaattgtgaaaatgtattttatatctacacctatatgtagtttttttcataaatttataaaacttttaggtatgattttcatgagtttccaacacttagctcgttttgtccccaaacggatatgcccttcagagggtttacacaggcttacagccacaacatatggtgtccatatatgtttgcttaggtaattagaggaattcactatttctttaaatatataaatcatttgattcattaagtgtaacttgggtcaaatttgagctgaatcatacataaaactcagaatatatagttcagcatctgatgaagcaagtacaccagtagtacaagactacaagtgcacagatcatgaacaaggcgcgaacgctttaacatactgaaatcttgcagatgtgccatgcccttctcttcaaggggcttccatcttcagtcaactgtttcaaccaccaattgacaatgttattgatctgcctcctccttgtttagatctttgttctatactccattttcccaatatttattttccatgtatatgctttccaaactactaaacagtatatatttgtaaaagaatttccatacgaaagttgctttaaaaaataataatgatttatttttcgagctttttaagctaacacttaattaatcatataatactgatgtgtcgttgagatctgtgtgtggaaagggaagggttccgaagccgtaggttggaactcagataatgtccaaacttcctgttgcttcatggctctctttcgtcgtagctgttcatacatgctgatcaatggcgtataggagcttgaggttaacccctgataggaaagagaatctatagacaagcttctgtgacaatatatagccttctctctaaacaatgtgacatgtaaacccatcaaacatctatgtccaagacggcaagaccccagccagcccatgtgaagataagatgaatgaaaattgtagctagatggcccatcaacaccagtatttgcattgagcggccggtccaccatgttgaattaacaagctatatgcaatgtactttcataatacatcaccaaacactaaatagaaaaactaacttttcttttttactacatataggaactgcctcgcagatttagttaacaccatagatctttcaccagctttgtttcgtaatatgtttttaggccaacttggttaatttggcaatcccatccaccgcgggcgagttaaatgtgggctcatctcatcatctgacctcaaggtagaattttcacatgtttaggctctgtttagttttcaaaaacaaaaactttctacccatcacatcgaatgtttggatacatatatggagtattaaatatagacaaaagaaaaaaaataattacacagtttgcgtgtaaattgcgagacgaatcttttaagcctaattacgccatgatttaacaatatggtgctaccgtaaatatttgctaatggcggattaattaggcttaataaatttgttttgcagttttctggcggaatctgtaatttattttattattagactacgtttaatacttcaaatgtgtgtccgtatatccgatgtgacaactaaatccaaaaattcttgggaactaaacaaggccttagctgaaatccatatgcctatactaaggctgtgttgtttacccctctttcccaactcacttttctccttttcaaactgctaaacggtgtattttttataaaagttttctatatgaaagttgttttaaaaataatattaatcagtttttcaagtttttttctcatacttaattaatctcactataataatcacgtgctttgttttccgtgtcctccgcaatgcagcctaaactaccacggcaccatttaccctcaaggtagtatgccttttttttctttcataaaggcataagttaagggctactagtatactgtacaatagtcctagattcagtcagggcccattaatttgagatgcccaatccctatcagtccaagcaaacttccaaaaagatgtgaataattagcctcggaagatatctgagcgtttctccgagcaaacttcccataaactagattgagcatgcgagtttatttaaaaaaagattgagcctgtgagcaaaattagattgccaataagcctctaaataataagcattttctacgagttaaaccttatttccaccgtataggtgcaaataaaaatagcacaaaatattatggtttggtccaagccttgggccaaagctcgagactgagtgagttttgatggcttaattaatactccctccgtttcaggttatacgacgttttgactttggtcaaaatcaaactgtttcaaatttgactaagtttatagacaaatatagtaatatttataatactaaattagtttcatcaaatcaataattgaatatattttcataataaatttatcttgggttgaaaatattactatttgttttataaacttagtcaaacttaaagctgtttgactttgactaaagttaaaacatcttataacctgaaacgaagtagttattttctccggtcacacatatttaaagtttaagataaaatttgattaaatttttataattttgactaccaataatttcttaaatacttagtttaaccagcgcatatgcgtttgcattttccttgtaatttttctatgcaaacctaagtcgtggattttgtagtggtgggcagctctatccaatgattgccgtgtattctatgtgaaaaaaccatcatcccttgaatcagatgacaaatgacaaaaaaaaaaaacggattgcaatcttgtcaaagatacggggtaactgggacaaagacaaataacacaatcaaagatttcgtggttcctcccatacctctccatcttggcagttggttcagacatttttcatatttcctatggaatcttgcaatcttttcttgatttctctagtcatgctatatatctagacgactaacagaatttctgttgaaatcttgcagaatattatattgtttgtccagaattaacaaattaatccagtattttctccataaatcgattgagtacctaccaagtgctccaaaaagaaaagaacaagatatataatgcagttgctggaatacgctgaaatgcctacatctgggattaaattatactcaagttgcaactctgtacttgccgatctattcatctgtatacaaggatcgagcaccaaccttctaaaattcttaggctgaggagagaacaccttttaaagaacgaatagagaccatttgagttgacaaattattttacagaaagatcaaactctgaattcaaatttgattatttgacccatctcatcagtgtgtgtctgaactctgaataatgcagcttactattttgttgcatagatcaaaccaagataagggtgtgtaagggtgtggtagtggtgttggcacgtaacgtgatgcgtttttcttattttcatgagcatagcctttccgaaagagtgattttgcagtccttaaggagatactagtaggtaccaaatttgcgctaaaacttttggtatctctcaatgactgtaaaatttcttttttaagaaaaactttaaaattttaatatgaagatgcataattcttttgcgtatttttgaagaaaaaaaaagatgcatggttccctctctgaagctaacaacggtatgaagctttatgtgatcacgacatctcaagattctcacatgtatgttctaatgagccatgatttgtgagtgagcacaatccagcatttgtttgagaaatggagcaatccaacaggccaactgtactaacctcctgtatggataggagagaaaaaaaacgagcctgcaaaaagaaaaggaaacaagccaaggcagcatgcatgtgagctagctccaacatattatgttctttgtcactcaccaattagctctctctctcttggtaggtgaagcatccatcactcgtacggaaaccttcttgtcagtacaacaaactgttgccatctctgaagaaaaagaaaaaagaaaagaaaagaaaaggggatgaaaaaacatgcaacaacttgtggttgatccatgcaccatcaactgaacctctgaaagacggttcgacacttcgacaggacagtgtaatgtaatgaggaaaactgcaccggcctagctactgaaattttgtactttgaatatttcatattggaagttagtttaaaaacccgtttaaaaatataaatttagatatgaacatagataagcgcttgtctagattcatagttaggattggattcttttttatgaagggagtagatctaaacttgtgattcaattatttacagataatttaatacaaaatatctgcgttgatcaataagtagttatggggaaaaggcaaaaagaaacatgaattgtcttttcaatgttttggcagaaaacagtctactttatgtgttgttcctctcctcaaattaaagctgagaactagggccaacaagaccccaggaatcaatctagttttggtatctgaaaacctgaggagcactgtagcaggtcatatagcttcagttgtttgacggtaacatgattacatcaacatacaaaagaatcataatttcacttccttgcgacgggataattgtccctgaaatataaaataaaatattggtgaacattgacttcttgtaaattctttgatgttttgcaccattccgcaaaataatttccaacttgttgcgattttaaattcagacggccggagaatataaatcatggatacacgggcagccaagacgtggataagataacatatttcaattttttttctcatatgtgccaacaaccttaatgccgggcacatggacacatgacagttttctcagtttgagttcattatatttttttttccattccccccccccccccccccaaaaaaaaaaaaaatcttctccaaacactagtcctcaaggacattcaagaggctatctttgttccacttgtttctaactttctgtgaagggtgcattacgacataactgatgatgattcaggccagagtgattaattagtcttcaagatgttctttaagggacaagacactgtctaagtagtgattaggatggtacctaataaggattggggattaagataatctcttttgtttatttattatttattttcagagctagccaccttttggttggaagcttcagtaacatgcaggccaacatatatggcccaaatctacaagtgcaatgtactattcttagggcttgtttggcaaacctcaaacctctagattttggagtttataggttaaaatataatgatttaagcatctattcttcgtgatctaaaatatgaacaagatggtgcggtgcaaagaattcttgcagctggagctccaccaaaaggcttctatcaaaataaactggtagcacacatgaaagggtatcaactaattttaactttgaagtactgtcatctaaaaatactaattttaagttctgaagctaattaatatatttcctgttcatatataagaactcataagatgaaaaatgcagaagaacatttagattaagatgctaattaatctgatctcttcatatatctttatggggcaacaggttcagttaaaaacatacaaatttagttatgctggataacttacccagcaaattttttttgaaaggttcggttgcccggttacactagggaaaatatatgtgaccagtaaaagtaaattagtatgacgtgaacaatcgcatgcatcaattttcttatcctacgtccaggattcactactacacatgtggtttccactacatgtattttctcgctatatattttaagaatgaataatgagctacagtgataaccggccagaaactatatattgaattcagctgcgtgctcttgaataattcatgttaatcaatagacacatcaaaagaaaaaaaacatgtcgttattgagggacctccaagcgtgatgaggatagagcaattactttgccataataacatcatgtactttcagtcattatttttcgcgaatgcgcaaaagaattgcatgtcaatatatttctcaaaaccttttttttttcattttaagtacacgatatgatgtcccacattcatttattagcaatgtcgaaatctcagattaattaacatcgcacagtagttgacgacgtagaattcgttcttttctttgatctagacagcgggcaattggttatttggatcagtagtcaagtgttcagacagtaacaagatgaaccatgcatgagacgtacaaacgaaaaggctatacataggtgtagctctcaagacttcatgcttgcaaacctaactcctaagatcgattgataaggctacgaaagatggtgaaagaaaataatgttttaacatgcatgaagggacaagctaaaggtgccaaattagggggaggtcatctagcccttaaaaatttaattggtttgttaataagtcctttagctttcaaatcttggcaacagtcaagcacttaactattctcccttcatgaaagctactccctaaccactacttgttcatgggctgcaagcatggtcattgcacatatatgctgcctttatgtttatccactttatctccttagaatgaaattcttttagcatcaagataaccctaaatttttagcattgcatttgctaattaattagctactcgtgggtagtaatagctatagctaattagctacatatcaggtaactgagttaacaggtacatccatgatgtaattaaaaggagttggtagatagcccatctgatcatgctgataagctagtggcatcggctggttgggaacacttattttacatcgaacaaaaagtgagagacatgcatgtaaaggtagagcattgacatgttctgtaactcatgtgttagtcattcactcatttgtgaattgtgaatatactaattaatactaatgtcttactaagttacatggcctctgatcaatcgttggaacttacctgtatagctatatatgtgcaggacagcaggagagcaactcaccttaattcattaatttgtactgcacaacatctcaaaacaccatgtaaataaccatgacaattttgtaccatttgtaaccatctatatatattgttgcttttaggagcatccatatagatatctaataaaataaactgcacgcacagagcataactagtggtaagtaaaacaaaatggaaaaaaaaatgaaacaaggagagcaggagcggtaatatatattcacatatattttcacccaaaaaatatatccacagtaatctcagcacactatattttttggtcatttatcccacacacattcatgtaaggcataaaccctacacgtgctctacattgaagttctcaaattttcatccatggtagtgtagcaacatggacaaaggaaacaaacaaagccccttatcctttagctctccacatggagttacactcttctgactttgatcaacaaacctcaccccctctaccattgcatctgcatagtccatcccctctcttccacgatcatctccaatcccaacttccttcaaggaaaaaaaaaagagacaggatgttaaaacaagacaatatttttactacttttctagaaacctgaaaaaaatggatggacaatttataatagtatcttttcaataaaacaccaactgattattgattgaacttaattaattaccttggttaggtccctggtattgcacctccttttagggctcaattccagctgtgtcaaagcactgacctgaaagatgcaaatcaaacaggcaaatcaacaccaactagctagtaatctctaatttttcttttctttatttcttttttaaaaaaaaaacaaagactctctagctttaagccttcatagcaacaaaaatatatagggaattaagctagctgtaactaccttagggctatttactggagagcttgcggtatcctccagggaatcatcatgatccagggccttgaagaccttcttcttgagcttcttcaactccttgtacctatcaggcaacgccgcagccgcgggagcgcaagacgcggcgtcggagatcatagaatcttcctctccttcctcctcctccagctccttctgatcactgcaatcgccatagacgccatctccgccatgggagcagtatgaagaagcaccatgatcttcttgactcttcttctcctcctcggacatcatgaaatccacaaagtagtcggtccaggtgctctcctccggctgagcttgagcagcagcagcagcttgctgatcttcactagtactactgcagctaattatggcactcctcatcacagatgagccactaactaaatcctccatgcttttgatgttacaagcaaaggtggtgatagctaaagctgatcaacttaatcgtacaagcttctatgcttgtgttgtacccaatgatcgaatggatgaattaatggatggctttgcaaagatgcatacagcctggctctctatatatataaacaggagagagagagagaaagagaagagagaggtgtgaagctgaatgacatcacgaggagggaggagaaaagaaagagtaaggtggttggggtgttaagatcaacagtatatgggcactgtttccgttacaatttttttttttaaaaaaaaggaaaacggagaatatttttgccttggtttcagaagttgcccgacctaatcaatcacgcctcctccttttttttttttgttatagtgtatacgcaggactccagccgcatccccttgctcatctgaatccatgtgacatagtctagctagctaggctctactcaccacaagatgattacttgtattccttgcattatatttaacggataaatgcatgcttcctaaactaccaaatgatgcggcttttattaaaaagatttatatatatgaatctcttagaaaatcgtttcaactttataatagttaattcattcggttgtatccttggataattgtcacgaaccaatcggtcactcagcatttagctcaaaagaatagacacttagattgtcaatatattactggcagaaacctgttaattctcaattcccttgttattaccctcatatctaactacgtaagagaagtttcttttaaaaaaatacagtctctctgtaccttctcaagagccttaaattaatcgtactccctctatttttatcaacatgacgttggttagttcaattttaaacatcaaataaaaacagaaggatttcggtaataatttccacaaaattgagggggaggatatagatgtgtttacctgcaggtagttcaggatggacatacattgtcaagctcgcagcaaactttctgaggaaaaagcatatgcctgcaccaatcgctgcgttgaaattgcaagcaaaggtaggcatgatgaattgatgatgatgaacatggcgacaccggtctctgcagcagttggtctctctctctctgttggtttggtccccggccgttgttaccgttactgacggacgtacgcacgcacgcacacgtacgcacgcaccgaatccatcattagtgcgccgcacgtcgtgagagccatataagtatatagtattccttgcaatacgctgcagcaatgagcaatcattgagatatcaaacttgtatatgtatgtgctcgcgccgaagaaacagtccgggaaattccgtaccatatgacagcttaattaattaaagcctaattgcattcgatcacagcctaactaggttttcaaagatggatatcagtactagttaagacaccatgattaattagctctcaaaaaatctttgcttgctgatcagtacttgatcgggccacggtcgacaacgtgcagaccaaaacgtgttgtgtgtatggggaggagtgatagatttatgtccactgttttgatcttttgacacaaacttgagcctttttaatttcctatggattaagaagaagatcaatatagtttagtaacctcgctttgaaagtgtagttaattgatggtatcaaagccacttcattataataacaagtggcatgcattttgcttggtctaactagattacaagcaccggtttcagattttcagcgaactgataattaatttcaggtcatgggagcataacacagtggcccaatccccatcaacaacgtatcagctacggcattttgggtgatgaccacatgacacagggtgctataagtatgtagcctaattacctatacaagattaatcgtagagacaggatggctgacatgctgatgagcagtagagtagtactaaccacacctctaatggatgattgattggtgcccatgtgttgtggttgacaaaaacttcttctttgcatggcagcatggcaccacatctcctggttttctgcatgccctctggcaaacagacattcctctggaagaaaaggaaaagtgagaaatagaaaacaaaacctgtcccttgaatgagtactgagaaggcaaatgtacaacatttagaatctgtcctggagtatggactatggaggtacaaattgcacctaaaaagagagaacatttcaatagtaaacttgaaagagatgcatgcaaacaaataagacatgaaagggatctgtcatggttgctaaaacgacttcacatagacataatttgcttattttatcggtactatatttgcaacgtttacatcgaattttaagtggcctagactgattaatattctgacttgtgactgaaacaaaagatagagcagcactgtaaagcatttagtttcttctgtagggaatagcgagttttcatctaaccgatcgagtgataaacaagtaatttgtttcttctctaaagaaacattgttggctcgttttcatctgcctgttcattgtctgaatgaaaattgatgttcagattatgtgcctcacaacttctgcacatggcttgtgttttcataatagctagaatgattatggtgttgaaagttatacctgaattcgtttttgacggcgtaaatcaaattagcacttctggggttccttttgacatttcagagccaaatcattgagtttttccctactagtatgtttgaagggctaatagaatatggcccccatataagaatccatggcacgggagcattgacttattgggacaaacatattagtgccaccgtacctgccatgacttgcttacaagacctgaaataaagatgaaaatgattcagaggtacatgaatcaagaaaacagaaatattgtatgtgcaagaacaaatgtaagggtaattagggaacaaaaatcctttgagaagactaacaggctgtacagaaaatggacgaatgtgaattgtaatgtgttatatagtactagtacttatcattatcctagtaaatagtgggaatgtgggatctcagctgttgctactaatcctcgcttccttggagaatcttaaggatttgatttaatgatgttgtccatgttttaagctcagtggtggcaggcaaagcgcaggaaaaactccagctacagcttcatgctagcctgtctttgggacaaaaatcattggaaatgcaactattactccaactagtcaacagcaagaaaaggctccaaatattcagtgcagataattcaatataagaaagaatatgctgttcaatacaagacagaaacttagcagcatttctatgctgggaatattaatactatgggggttgacacatactaagtatgatcttagaataaaaccagagagatgtatgaagttaatggcaagccagttcataggatagcacggaataataatactatcaagtatgtcctaaattgcaaaatcattaaaaaaaatgcagcggaaaatagctttttgtacctatcagcaaaatgcagggtccagcagtaactggaatattttatgccacagctcatagatattaggtgctatctgggaacaatctaggtggaccattagagagtttagtctttaggtactacaaactagatatatagaaggtagctaatcaatgtgattgctgaggttagctgttgcagccaatttagaaacatggataattttgtatgtattatagatatactccaagttaaaagatagagatgcctgagaacaattgacatcaattgcatgtctccagaactcggaagcttcagaactaatgtacctgtcagattatcaattggcaaaaaacggagctgataatcaacttaaccatatgggcatacagggagcaaactaaagaagttaatatgcaaatactaaattccaccaaagaaacagcattgtacaatcaggtcacatggataggaaatctctagacatatagatatatccaaatttcactgcactaacagcaaacctagtataaatagtatgtcggcagtttgttgcaggaaggaacataaaggagaagcataggtccaaagtaagcaatctgggtaccattagttaacaaagattatttgcagcaacagcggtgagaagatggaatctacataacttgtggtgcttccagatgccacagctgcatgtttggccctagaatcatctcctgtccctgaaacatagtaaaggtaaacagattagcaaaaggtaaggaaagctcaaaacaagcaaaacgtcaggcaaatagcaaaagaagtacagctttgcatttccgacactactaattcctatcgtatttcaaatactttgtttactgaagggtacatgccggagatacatatcaaatctcagctgcaaagaatgctttttcttggtgtaattccagggggaaaaaaatgcaaaccagattgtcacaaaatcaaaatgaagatcccagaagcagaaccaaaaggcacaaccattagctgacaacacaaattctttccctatatactaattcaacaacgtgaacagattttgaaatcacatggtcacaggttccatgaaaaagacctaactgatattcaccccgtatagagtctacagaggccatagggtgataaaacaattctcacagcataagtttattctccttgaagaaggtaatattcttgcagatcaggagatgtgcaacatccagaaatttgcaaattttactgggatggagaaccactaaaatcaccacagcctacagtcctgcaagcggatgattgataagagcaggcagcaatcagccagcaaagcattgatgttctgaattcgagcccgggggaatcaacccgtttcctgttttagctccctggacgatagcagtatagcaccaaaccccagcacggcccgagtctccatcccatgccgaaatgaagtagggaccgacagggaatcagaaaacgagaggcaccaaacgctcagcccaaaaccaccgccgcgcctccctcgctcgcgcaaaccgtcgaacacgtcgcgggcatcatagggaacctcgtgaccacgagaccgcatcccgcacgagcagcaatggcaccatcacctcgcacttaccaatgctgtgagttagcacgcgcgcgcgaaggcgagagagagagagagagagggcagtggcatcatccatccgatatcgccgccgcctcgttttctcgcgcgcgaacggcggcgcgagagaagatgatgagctgctgtacatcaagttaagcgcataaaccctc

SEQ ID NO: 9951 - DNA, 6960 bp, Oryza sativa
  unsure (1)..(6960): unsure at all n locations
cgacgggccgaagaaatgagaaaaagacgtggtgggctaacccaggacgaagcgacttgatgggctgnaaatgcgagaggtttttgggctccgaacgccaattaatgggcctgttcgggactccatacaccaggccagattcggaaagctaacgcgcgcgtacgcgccgctagcgcgcgactccatttaactcgattagcgattccagaggacgtaactaactcaattagtttaggttaatgacggtaattaataaaatatttccttttctccggaattttttttactaaaaaaatctggaaatgctctttgccggtcgcccggtgcggagggagccggatcgggcactccccccgcgccccctcccccacgtgcctacttaggcccacctatttatgctcctcttttttccacaaaagatgtttcacataatgtatttacaatgtttcactatttatagatctaatgttgtagtaaattaaaatactcttttgcaaaaaaaaaaacccacatattttagaaactctctattaagggaattttgtttattttttgttccacccaaaatgtttcacctagtgtactcataatatttcactatgtatagatctaatgttacactgaacgaaacattccattgcaacaaaaaacccacatattttggaaacccctattaagagaatttggtttattttttgttccaccgaaaaatgtttcaccgagtgtactcaaaaatgtttcactatgtatagatctaatgttgcagtgaactgaaacattctttcgctatttgctgaaacattgtttttatataaggtgaaacaacacccaatttaaacgagtgaaacattttcgatctacttagtgaaacaattctgatatatctggtggaacatcttgcaacatttaaaaataattcaataataagataaaagaaaatttcgtcgaaatatatccatgcgtggtcttgttttgaagatttaattgcaatgaatttaatagtgcaatcggatcatcatttggataagtagtttaagagataaatcagtttaaagtaattttgcatgtaaatcggacgctgacgtcagcgcccgattttaccctctcctgatcggacgcccgaccaggagtcatccaaaaaaatctatacgtgaaaaaaaattctcacttaaaatttaaaacttttaactcaaaatttgaaaatctaaattcaattttttaatattttcaactagaaatttaaacttttaacttagatttgaaacctttcgacttaagatttgaactttgaagtcaaaatttaaaaaatttcaacttaaactttgaaaattttcaactcgaaatttaaatttgtaagacaaattttaaaaactttcaagtcagatttgaaaactttcaactcgagattgaaaactttcaagtccatatttaaaaactttcaactcaaatttaaaaactttcaaattttaaaaaaaagaatgaaaaaaatatatggaaaatacgctgaggggagggaggcaaaagggaaaaaatcacgaaaaaaaaggaaaaatcgtgctgaaaatcgctaaaaaaatcacacaaaaaaaagagaaaaatcgggaagtcgcaaaaaaaaaaaagccacgtggccggtggaggggcgcgcgccaattagctcccccgaccagattgggccttaaatagacaccgttgtgtgcccatataggtttattgaatggaaagaacattattttttatcctgcatctgcttttattttctctacgaagagagtggctagggtatttcaaagaattttatgagttaagctaattcatttgaacttccatttaaattttggtgttcgaaagaaatcagtacgatgagctcacatccttgatgaaaaatgggactagaaatataatcaagttgagcatgtgtacattagttgtgcctatatgtgcttttgtatactactcctgttctcaagcaatagttatcttttctagtgaagtaaaatctcctaggaatataaagtatttttatctcaactttaaactctcttaaataacatattatctcttatattcgtggcctgataaagcatattattacttacaagttagtacaactaatatactactagagggtactattctttcttattgttttctttttggaagatcactagcaaagtagtgctactcttgctcgctagaacgttctgtatgacaacagtacataccccaatcatgtggctgtaactagcaccacgagtaaacttggccggatctacctaccgccagcctcttgaaaccaaagtgcatgccaaacagtctcccgtcccatactgccatacatacacacacacacacaagagtacacagctgaatatatatacgtgatttccgtgtgactacatatactcaagctcacgcacgcaccgtgacctcacttctgatccgcgtatatatataatctgcacacacattttgctctcccttttccacgtggggcgagacgtacgtggcgcgtggccatgtacgtacgtacgactcgccgatggaaacagcaacacgcacggggaaaccgacgcgcatgcgcgcacgccttgatcgaaacgccgtggcgcgtcgaatgatcgcgtggtggtggtgaaaaacccgcacacggcgctcgcgcgcgccgcgcagagaaaaaaaaaatctccggccgcagcagaggcgcgcgcgctgcaggttgcagctgcggttgggcggggcggggcggatgcgaacaaagctcgcgaggtgacaggatagcacatgcgccgatggccgcggaaggaaaggctcggaagcagacggacggcgcggccgcccgatgctggtccgcgcggatgccgggttggtgtgggcagcgacagctgacaaaacgtacggcatgatgatgtgcgtgtgttgctcctcatcctagctagtagtacgtactgtactgtcctagtagcaagcaagcgaaacacggcacgtagctaggagtaagactaaagcgcagctaccaagctgtacataacatatatacgatcgacgatcactaaacctcccagcgctgatcgatcgatgggtagcagtcggcaatgtgtgtgtgtgggtagatcgatggcacgggttaaaccgatcttaaaagaaaaatgacagcacgaaattccaacggcacggagagtgagagatcgagtacgttacaaatacgtcagtacgatccggaatcgatcaatcgtacgtgcaagttgtatagcatagcatatgtgtctgtcttctcgattccctgaaaacgggagctttgcccatattcgtcgaatagtagtaacattacagtaccatttttcttggacgagcctttcctaattcatacagcacgatcacccattgctagttccgatcgatctggatatctgatcgagagcgccttctccactccaagccgcgaggcgatcgatcaccattcaccaatttcaccacttgctatactagcttagcagtagttgccattcaggggaagcagcagaatggaaatagcgcgcggacgcccacaaagcgacgacgcgagcgaccaaattgcacccctaaacgacagcgccttgtgctgcagcgtccgtccgtcgtcgtactgggctattggcatactctctccgccaaaaaaaaaaaacctgattttcgtgtccaacgttgtactgtttttcttatttaaaaaaattatgaaaaaaattaaaaatacaaatcacgcataaaatattaatcatgttttatcatctaacaacaataaaaatacgaattataaaaaaattttatataagacagacagtcaaagttggacacgaaaacttagggtttgattttttttttttacggagggagtatggtgcatccctctcgccccaccccgaaaaaaaaatcttcccgcacagtacgcgcccccacgcccacgtcccacgtgaccggggtccctcacggacggccgaggtgtgcagatcgcgcgccacgcggggccacggcctctctccgccgctaaaaccccccctcctatagctcctcctctcttggcgctagctagctaggtgacccgcacacgccgtcacgcagcgagcggacggccgcgaggagcccgggaggacaggacagggccccgcggcacaggacgtgtcgacgtgacgtgccagtgtgcccgcgtcgtccgtttggtttcgatcgtcgcgaggtacgcgaggagagaaacggacgacggatgcgcgacgaggtctcggtctcgggtcggcgtgaatcgcgtgaagcttccgccttccgcgctcgcgagggcgaaggtgaaacgcagctggtaggcggctacgctggtggtgaggttcgctgtaccggacggacggcgagaggctctctcgggtcggggcgtacgtgagaattagcggtcgacggtcgttgccggcacagggccgggatggctcttctgttgacggctcacctcctccgaggctccgactagtagtgtgccagtagtgttaggttttgtaccgttgtggtgggtacgtcgttttccggttttacttcgaaagaacaccgttggttgcaaataattatattcgacaccaacttagtagtatattttttaaattttaatcattttcacagttttgttacagtactagctccttataattaaacagatgatattcattttattattggttcatatgagcacctcgcgtgatggcgtaagcccttataattctgagcttaattagggagtagttagtatccatatatatcctcctatgaaaatgcatgttgacatcaatattgatgttgattttgcaaggtgggagattttgcaagtctttgagcatgtttagaatttcgaaagaactcatttggctgctatatatacgtacaagcagcggtcaaatgaaaagccctcgtattgtaccacccaacaaccaagaggcaagccaatgccaagtggccaagagtgtgaaaacacttccctgaaaatgctaggcaaattctcttcacaattttaaacgtgcgtaaaatatacgttattagtactacatgttcacaactgtaacgatacgtagcccatacgcaacatgaaaaatatgcatttctcgaaaaaatattaattaatatacaaaatcacttactaacaattaaaatgtagttgtcgatgtttttctattttgaatgtagaaataatcattgagctatttcaacatcatacacacaacgaacaaagaattgaggaatcaactgttatatgtaccaaaccatgaataaattggtatggtaaaaatagatatgtgcaaatgaatgtgttgatttagtattagaaaaattcctgtcattattttatcagaaaagagaaaatatttcataaatgaatacctgagatgtgctaagatttgatcattctgtttcatgcattctagcaaaaacggattctcaaacagtaaagatgaaacatatacagatgaacatttccatacattagatactactttgtgcagcaatttagttagggcttgttcggaacggagggattacacaggattttgtaggattggcaaatcctttggatttggccatgttcatgcattcggttcataggaagcacgtgtaggaattttgtaggaatactatagcaaccctgtgaaaatgcgggaattccataggattctgaacatccactcacacctcatttttttcattagctaccacagggtagatgctaatcacgttggagtgactagatgggaactaatattttattgcttaattatactataattatactataatatatgagatcaatattaattagaacatttctatggtttatatattcatgtattccgaacgcttcatatcatcaaattccattgtttttcaattatacgttttgcatatgcaatcctatattattcctgtgttttcctattcctatgtttttcctatcctgtgatccgaacaagcccttagcaggcacaaatcatggaagcactagccttttcttaacataatgcatagtatttatgtcctcccaatatggttatagctgaatttaatcgtgcatggtggatcgatagtgcattatatacaattaaccgagcattatgtataaaacatgaccataaattaatcgcaaataattgtaatatcgaaaaacgacacagcggacaaactgtatataaaaaagaaagaaatgcacattttaagaagaaaaaagaaaggcaataattcagaggcagcaaaaatcaaaaacctcactacggtgagaaagatgccatggctggcgacatacatgcacaaaaccggctcccttcttcttcgcgcgctccctataaataccttccttcccccaacaccttccccctacccatcgccgccatagacgtacggacggccggctacaacacaacacagtaactgtaactgaagaagccggcgccaccattcccgccggcaatatgctcgccggcgccggcttcgtaaagctcttcacggncgggaccggcacggcgcccaagatggcattattcaagccccttcaccttcctcccctatttgacgacgacgacggcgtcgacgggccacgtaccctcttcctgttggcgcgccccctgtaccgggagcaggacccgatatacctggcgtcgcgcgtagcgttaccggcgccgaccgcgacgtcacgcatcgtcgacagcgcccggccggaggaggctgcaccggcgggcgccggcgccggaagaggcagcgaggcgggccaagatcggtgtttactttgcaacgtggtgggtgctgaacgtgatcttaacatcttcaacaagaaggtgctcaacgccgttccttaaccgggtgctcacgttcaccgtctccctcgacgacggatttgccaatatgcttaccttctggggccaacagaatcgccgaggcgccctgcccccgccctaaacg

SEQ ID NO: 9952 - DNA, 893 bp, Oryza sativa
  unsure (1)..(893): unsure at all n locations
ntcacagcggaagtgggtcccccgctctggtcaaagcaaggctcctgtttcccagtgtaatagaagcccagaagtcctcacccattaaatggtgactgacaggggcaccccccgtgtcaggcggcaagatttgacaggcctcatcatcaagatgacgtgcgcttgcttcccaagtcaagagacaggacatgcatttaatgcaaagattgtaatccttctccactaagttatgtttttgggcccatgtggtaaccccttgagatataaaaggaggtccaggcctagtaggagggggggctagagcccctgatgatcaacaccttctaccccaacaaggagatcttataatttctcacaagatcagctaagcataggagtagggtattacgcttctcagcggcccaaacctgtataaactccttttgtctcatcaccttggagggggataactccctcaagatgacacagcttcgctcaacaaaccctcgaatctcacccgctgccctcggcagaactcacaaaggggggcctcacggttccccggtggaggagttcattctccgacatctggcgcgccaggtagggggcgcgttcgtgatttttgaggttctttcgagtgccggtgtgacgagcgtcgcggcgccaaagcgggggaaggcgcagcctcctcaggagtgtcgcgccaccccaggcagaaggctaggcccccccacatcctcatcgaaaaaggccagcggccaggcttttgtggcgagtcttcgaaatgtccgatggcccccaaagttccggcccagcctcactgagaagtacgacggcggcgtcaacccctccgagtccctccagatcnnnnnnnnnnnnnnnnnnnnnnnnnnnnnnnnnnnnnnnnnnnnnnn

SEQ ID NO: 9953 - DNA, 27331 bp, Oryza sativa
  unsure (1)..(27331): unsure at all n locations
cgggcgggcctttggaaaaaccccaacacgggccctcttttaggtgtctggcccctttggggccctttggccaaaaagtttttcccggggttacccccaatttggtgaaaaaccaatttcccgcccttaatgagttaaacccgctttcccaaaccaaaggccaaagccaagatgtcagttacaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgattctttccggcgtattctgatgatattatagaaagaaaacaaataagctacatccctgattgacatgtgtgtttgtgaaagatctctcgagaagggtcagtatacatatggatgaaacgatttaccttttcaagttccagagttagcttctccagttttggtgcgttctgaaggaagacaaccaatccatagaagttcgcatccaaacaccattgaccaagagtcaggctgacaagattgttgaattttgggtacaattgcaaattgttttccattgtcagctgcacgatactgaaatgattatgttgcaacagaaaacccttgccatgttatagacaaaatttccaacaaaacatgaaaacacaatccagcgcactaacattatgcgataaaagaccataatagcacatgcgatttaattgtcaggatgcttttgatgcaatttaagtagctacgccagtctaaacacaacacaaaaaactattgcaagactttcaacaattgcggagacatttccatttgtatgttgactttgaggttgtcttgattttcaaatttatgtgcagtaatgacaactgaaattagacaaacactcagatttctcaaaatatgaatatgaatcttcagttgacaacccaatattacagcgaacaagaacatgtcgagttaccaaatgggaaatgctccagtttcattgtgaaattgaatagccaacttagatagttcatgtctgcttgaccccaacagcttgatttatatacaaatgaactgactacacgaaatagctagattgcattgatgattgatgtcatcagtcatccttacaacacatcatgatttcacgcataagaattagttatgcaacgcttagttttgccggtgctattgtgaagtgtcaataagaaacaccatgcttgagtttttcctttttcatatcgacaactacattgagatgcatggatgtaataaggaaagggggatgtgtgagaccaataaccataccttcctcccaaaataatcgaactccaatcttttagcagcagaaaggctcctgagattttggcagaaatcactagagtcttgtacatcataaagtactagaattgaagtcactagtaatggcatgtcgttgaacacatatatgccgttcacaggcctccacaacttcagataagtaacactcggggtcgaaatagtagtcctgaacttataggagaactgagtgctcttgatggtcaaaaccttcagtgtcctggaggagatctcaacatccgcaacgatggattcatctaaaaagagattttccaatactggacaacccatctcgagttgctggaagaaacctggcatcataagaacattgatgaacttgattcttgtgaggtagcggcaggtaaacgcagagtgatcgagcttcaatgcgtcatacagcacgagaatatccagaacccagggctgcttctgcatagcgtgggtaatccatctgttcatatctgcctcgtccgaggtgccttcgaatccgtccaatctgcagcacctgaaccggaacgtgcgtatcggggcggccgggttgcggagctccagcaccctatccatgaacatcttgaatgccgactccctctcttgatcatactcttcccactcagtgtcgctccgctggaactcgccgacgtcggcgttgatgcagggcacggagcgccagaggttgagccaccgccgcgacagcacgcacgtctgcacagcctggcgcgtggtcaggaaagacatgatgttgaggatgacgtcgtccgggacgtcgctgaaccagtccccgtcgtcagtgtgcgctggggccgtgacccccctcctcttgctaggcgacccctccatggcggccgagcacgcgcgcagaggcgtttcgtcgaacaggtcgcgcgcgtagaaactgcacgagagaggaaaaccaagaatcaagaacccaacaacccgcagctcaactcccagcacaagaatcgagatcgtagcacaagaaacgacgctcgagaagaaattgattggtcagggaagaacatccagagaaggaggatcgatgcaagaagagttggaagccgtacctcgaaaccgctcgggcaggcgtttcgtcgaacaggtggagcgcgtgggaactgcacaagaccaaaagaatcaagaagccatgaatccacagcacaactccaagcaagatttgagatcgtaacacagcaaagcacactcgaggagagattgatccgtgaagaacattctaggggaggggatcgatgcatggagagatggaagggaggagggagctgtgtgtacctcgaaatgtcgaattcgcgattcgcctcgcgcgctccggggaaaggttcactgctccctcgatggaaacatgggcggttcaggttggataaatgtgtctgccggaatgaaatactctgtccggttaaataatatggactccgtttcacaacgcaagtcattctagcattttccgcattcaaatttattttaatgaatctagacagataataaatctagatagatatatatatctagattcattaatatcaatataaatatacgaaatgctaaaatgacttacatggtaaaacggaggaagtccttggagtaatgtggttatagaatctagtctactccataagtcccaaaaagatcccttatagaacaacgaatctgagctaccatttatccagatttgttagttttttttggacggagggagtatgtaattcctccatttcatattactaaatcattttgactttggtcaaaatcaaactactctaaatttaattaagtttataaataaatatagtagtatttattacaccaaataagtttcattgaatctataatcgaatatattttcatgatataattgttttcggttgaaaatgttagtatttttttttacaaatttgaccaaacttgaaacatatttactttgatcaaagttaaaaatgacttgtaatctgaagtagagcgagtagtcaataaataaattttgatcataatagttagggttaattggatccatgccactgcaactttaccaaattaaaaacatgccattactattcgttgtataggctacatgccactggaaatttctaaaattgaaaccatgccactcttgtcacgttttccgtctcctctctcatgtcgtttcttttcctccagtttaatcgtttcccctcatgtttcctctcctctcctctcctcttcttctcctctcctctcttccgaccaacctcccaccaccacaccgctcctcctcctcctgctgttgctgcaaccgtgctgccctcgagaaactaagtctttgatcaccgctggtaaacaacaaaccaaataaaaaacccttcttgcggtggtttctgggcagatctgagagagaacaaaaagtgattaggcagatccttttccgatggcttcttccccttccttttcctcctcctcctccccttccgccaccagtgccgcgccggcgtcctcctactactggtgctacagctgtgaccccttcgtgcacgctgcccctcacgaagactccatcgtcgcctgcccggactacggcggcgtcatcctcgaggagatgggtgtgcccccaccacgcaccgcctgcctttgccacccgcgcgcgcaccacaccaacgacctgcgcatgtgacggacacgctacgctgccgcagcagcggcggctagcgaccgctcgccattcaaccccgtcatcgtgcctcaccgctcccccgctgccgtagctgctggcgacgacgacggcgcgggctccggcctccgcccgctcccggagaccatgtcggacttcctcatgggctatgccttcgagcgtctcctcgactagctcacccagatcgaagtcggcggcctcgcccacatgagggagaacctaccggcctgcaaggcttccatccccatgccgcggggccgtccactcacctagctcaattgttggagaggagacagaaaaagtgacgggagtggcatggttccaattttagaaattttaagtggcatgtgactgatatgacgaatagtggtggtatttttttaatttggcaaagttgcagtggcatagatccaattaaccctttaaacaacatcaaatcaaatctaaaatcaagtttgaaaaatttaaaaatgtaacttataagcatacaaacataagtgaaactaatagggttatatatatatatatatatatatatatatatatatatatatatatatatatatatatatgtctccgttaccacctaatactactacagtgctacgacagcttcacccagaatctgataagccgatgccactgcatcgaattcttcaggtgaaactgcaccgccattacacgagtatctgaatcgacgatgttggtaccccatgtttctgaaattttggatcaaagaatacaatgtgtgacacagattccataaccatgtgtgtgacagtggtgtttcataacaaatatataattgtatgaaaaaattaacagttttgtgattttcttattttccactgatacaaaaaattgttgcagcttgttgatatataaccaattaaccatgcaggttacacatccttgatctacatccggcgtatgatatgaacctgagcagaggtcagtccactattaacaaagaaggtgaccacatctttgaccaggggatcatcctccgagcatacgatttcaacacgcgtaaggtgctcacatgtaaatgatctatcttcaatcttgccaatgattctttgtgttttttcctgataataatatagcaacaaaataaaataagctatattctcgattgacatgtgttcttgtgaaaaatctttcaagaaggatcagtagacatttgtaggaaaagatttaccttttcaatctttagagttagcttctccagttttggtgaagtctgaaggaagaccatcaatccatagaagtttgcatccagacaccattgaccaagagtcagtctgacaagattgttgaattttgggtacaattgcaaattgttttccattgtcagctgcacagtattgaaatgatcatgtggcaacagagaaaaccttgccatgttatagacaaaattcccactaaacatgacaacacaatccagagcactaacactatgacaatagaaagaaatgatgtcaacaaaaaaccagaggattgcaaaactcaaagggaccctaaacatgacaatgcaatccaaaggactaacattgtgccacaacagaaagaaattatttcaacaaaaaaccagaatatacgatactatactagtttgccttcaccaagtctctcgatgcaagttaggtagctacactagtcttaacaaaatgcaaaaaactattatgtggtagcaggagtaagactttcaacatttgctgaggcatttccatttgtatgttaactttgagtatgtcttaattttcaaatttatgtgcagcaatgtcaattgaagttagacaatcactcagatttctgaaaagatgaattttcagttgccaacccaatattgcagcaaacaagagcatgtcgagttaccaaatgggaaatgctccagtttcattgtgaaatcgaatagccagctaagatagttcaggtctgcttgaccaacaggttgatttatacacaaatgaactgacaacatgaaataaattacatcgaatggttgatggcatcagtcattcttacaacacatcatgatttcccacataagaattcgtcttaatttgccagtgcaattctgaagtgtcaataagaaacaacatgcttgagtttgttttcttttttcgtatcaatacgtacattaagatgcatggatataataaggaaagtgggatgcgtaagaccaataagcatacctctttcccaatataattgaactccaaacttttagcagcagaaaggctcctgagattttggaagaaatcaccagagtcttgcacatgataaagtaccagtaatgaagtcactagtaatggcatgtcattaaacacacagctatccacaggcctccacaacttcagataagtaacactcggggtcgaaatagtagtcttgtcactggagaacagagtgttcttgatggtcaaaaccttcagtgtttgggaggagatctcaacatcattaacggcgcattcatctaagaagagactttcccatgctggacagcccatctcgagttgcttgaagaatccttccatcaaaacaacactggtgaactcaattcttgtgagatagcgggaagcaaactcggagtggtcgagatacaatttgtcacacagcacaacaatatccagaacccgtgcctgcttctgcacagcgtggctaatccatgcgttgatatcttcagggtccgagatatcatcgaatccttcatccaattcaaatttgcacctgaactgaaacgtgcttatcaaggcagcagggtcacggagctccatcaccctctccatgaacataatgaacgccaattccgtcttttcatcatagtatccttccgagtcggagtcccgcgtgaactcgtctatgtcggagttgatgcagggcacggagcgccagaggttgcgccaccgccgcgacagcacacacgtctgcacagcctggcgcgtggtcaggaaggacatgatattgagaatgatgtcgtccgggacgtcgctgaaccagtccccgtcgtcagtgtgcgctgggcccgtgacccccctgctcttgctaggtgaaccctccatggcggccgagcacgcgcgcagaggcgtttcgtcgaacaggtggcgcgcgtggaacctgcacgagagaggaagaccaagaatcaggaaccgaacaacccgcagctcaactccaagcacaagaaacgacgctcgagaagacattgattggtcagggaagaacatatagagaagaaggatcgatgcaagaagagttggaagccgtacctcgaaaccgcgcaggcaggcgtttcgtcgaacaggtggcgcgcgtggaaactgcacaagaccaaagaatcaataagccatgaatccacagcacaactccaagcaagatttgagatcgtaacacagcaaagcacgctcgaggagagattgatccgtgaagaacattctaggggaggggatcgatgcatggagagatggaagggaggagggagctgtatgtacctcgaaatgtcgaattcgcgattcgcctcgagcgctccggggaatggtttttttactgctccctcgatggaaacatggacggttcaggttggataaatgtgtctgctgcaatgaaatactctgtccggtaaaataatactaatgtggttgtagaatctagtcgtacttcgtccatttcatattataagtcattttgtgttgcatgttataagtcagttttactttggttaaaatcaaactactccaaatttaatcaagtttataaataaatatagtaatatttgtaacaccaaataagttacactgaatctataatcgaatatattcataatatatttatcttgggttaaaaatgttagtatttttttatacaaacttgaccaaacttgaaacagatggactttgatcaaagtcaaaaatgacttgtaatctgaaacagagcgagtagtaattaagttaattttgatcataataattagggttaattggatcatgccactgcaactttgctaaatttaaaaaaaaacgccactactatttgtcatatcagctacaatgccactcgaaatttctaaaattagaaccatgccactcccgtcacattttctgtctcctctctcacgccgtctttgtcccccctcccccagtttattcgtttcccctcatgtttcctctcctatcctctcctctcctccgaccaacctcccaccacaacaccgctcctcctcctcctcctgctgctgcaaccgcgccgccctcaggaacctaagtccttgaccaccgccggtaaacaacaaaccaaacaaaaatcccttcttgcagtggtttccaagcagatctgagagagaacaaaaagtggtttccgatggcttcttccccttcctcttccttctcctcctccccttccgctgccggtgctgcgccggcgtcctcctcctactggtgctacaattgcgaccccttcgtgcgtgccgcccctcacaaagactccgctgtcgcctacccgaactacggcggcggcatcctcgaggagatgggtgcacccccaccgtgcaccgcctacctccgccacccgtgcgcgcaccacgccaaagacctgcgcctgcgacggacatgctgcgctgacgcagtggcggcagccgatgaccgctcgccgttcaaccccgtcatcgtgctttgccgctcccccgctgccgtagctgccggcgacgatgactccctcgccacggttactagcttcgagctcttctacgacgacggcgtgggctccggcctccgcccgctcccggagaccatgtcggacttcctcatgggctccgccttcgagcgtctcctcgaccagctcacccagatcgaagccggcggcctctcccgcgcaagggagaacccgccggcctccaaggcctccatctccatgccgcggggccgcccactcgcccagttcaatcgccggagaggagacagaaaaagtgacgggagtggcatggttttaattttagaaatttcgagtgacatgtagctgatatgatgaatattagtgataattttttaatttggcaaagttgcagtggcatggatcgaattaaccctttaaacaacatcaaatcaaatctaaaattaagtttgaaaatttaaaatgtagcttataagcatacaaacataagtgaaacaaatagggttatatatatgtctccctttaccacctactcctacaacagtggtacgacagcttcacccaaaatctgataagccgatgccactgcatcgaattcttcaggtgcaactgcaccgccattacacgagtctctgaatcgacgatgttggtgccccatgtttgtgaaattttcgatcaaagaatacaatgtgtgacacagattccataaccatgtgtgtgacagtggtgtttcataacaaatatatagttgtatgaaaaaattaacagctttttgattttgttgttttccactgatacagaaaattgttgcagcttgttgatatataaccatgctcattatttccagtaaaatccactccttccgtttcatattcatataataagttgttttgactttttttaaaaaacatttttaaacttgaccaagtttgttggaaaaataaaaatatttccaacgcaaaatataaatatgttcaatgttacatttaataaaactaatttctagatgttattcaatttttctataaactttgttaaacctaaaaaaatgactagtaaaaaaaaagtcaaaaacaacttataatatgaaacagcggaagtaattttttatttcatgtgtacattacacaaaaaggaaaaaaaatctaatgagtcgtactgaaggggatagagccagagtcatggattgggatcccatgcagtttgaatagggactgcaagtttagcagtcttatatcttcagtttagcagtcttatatcttcactaccatcagatcaaaggtttcaacggcctggatttaggagcaatactgtttgtcagcattggtgcgatctgagtccttgttatttgatccaaagatggttatatgactgctaaagttacagtcatacaagcaaaggtgatctcaattccagtcatggtgtataacatcacgtcgggaaaatataaaggcaaaataatagagtactcaagcatcaacttgcagtacgtcttggttataggacaatagaacatcaacagaacaaggtgacagacctttcacttacatagtactactaagacatgattgtttctactcatatcatagcaccaaacaagagcagtatacatgtttatatgtgctttcggactcaactggagcaacaaatgttatgatatgaacctgagcagaggtcagtccactattaacaaagaagttcaccacgtctttgaccaggggatcatcctccgagcataagacttcaacacacgtaaggtgctcacatgtacttgatctacacccggcgtatgatatgaacctgagcagaggtcagtccactatttacaaagaagttcaccacgtctttgaccaggggatcatcctccgagcataagacttcaacacacgtaaggtgctcacatgtacttgatctacacccggcgtatgatatgaacctgagcagaggtcagtccactatttacaaagaagttcaccacgtcttcgaccaggggatcatcctccgagcatacgacttcaacacgcgtaaggtgctcacatgtaaatgatctatcttcaagtttgccaatgattctttgtggtttttcctggtgataatatagcaacaaaataagatgagctaattctcgattgacatgtgaaaaatgattcaagaaggataaatatgcatttggaggaaaagatttaccttttcaagctttagagttagcttatttttggtgaggtctgaaggaagaccgtcaatccatagaagtttgcatccagacaccattgaccgagagtcaggctgacaagattgttgaattttgggtacaattgcaaattgttttcaattgtcagctgcacaatattgaaatgattatgtggcaacagaaaaaatcatgccatgttatagacaaaatttcacactaaacatgacaacacaatccaaagcactaacattatgccaaccaaaaaccagaataaatgatactatactagtttgctttcaccaagactttcgttgaaagttaggtagttacactagtctaatcacaatgcaaaaaactattgtgcggtgcagcaggagtaagactttcaacatttgctgaggcatttccatttgtatgttgactttgagtatgtcttaattttcaaattcatgtgcattaatgtcaattgaagttagacaatcacccggatttcttaaaagataaattttcagttgcgaacccaatattgcagcaaacaagagcatgttgagttaccaaatgggaaatgctccagtttcattgtgaaatcaaatagccaacttcttgcttgaccaacaggttgattggtatacaaataaactgacaacatgaaatagattgcatcgaatggttgatggcatcagtgatccttaaaatcatcatgatttcacacataagaattagttatgcaacgcttagttttgaaggtgtaattgtgaattgtgaagtgtcaataagaaacaccgagcttgagttttttcctttttcatatcaatatctacattaagattcctggatataataaggaaagtgagatgtgtaagaccaataagcttacctgttttcttctcccaacataatcgaactccaaacttttagcagcagaaaggctcctgagattttggaaaaaatcaccagagtcttgcacatgataaagtaccagtaatgaagtcactagtaatggcatgtcattaagcacatatgtgccattcaaagggctccacaacttcagataagtaacactgggggtcgaaatagtagtcttgttgccataggagacatgagtattcttgatggtcaaaaccttcagtgtctgggaggagatctcaacatcctcaacgctgcattcatctaagaagagacctctcattgctggacagcccatctcgagttgcttgaagaatccttgcatcaaaataacattggtgaagtcaattcttctgaggtagcggcaattgaatgcagagtgattgagctccaatttgtcacacagcaggacaatatccagaaagtggctgcttctgcacagcgtggctaatccatccgttgataacttccgagtccaagatatggttgatttcctcattcaaatccaatatgcacctgaaccgaaacgtgtgtatcaagggggcggggtcgcggagctcattcagcctttccatgaacatcttgaacgccaattccgtctcttgatcatagtgctcggtatctctccgcttgaactcgctgatgtcagcgttgatgcagggcacggtgcgccagaggttgcgccaccgccgcgacagcacgcacatccgcacagcctggcgcatggtcaggaaggacatgatgcggaagacgatgtcgtcggggagggtgctgagcctgatcttgccaggcgacccctccatggtggccgagcacgcgcgcagagtcgtttcgtcgaacagatggcgcgcgtggaaactgcacacagaagaggaagaccaagaatcaggaacccatcaacctgcagcttaacttcgaagaaatatctgacaccgtaacacaagaaacaacggttacaacgctcgagcagtttttccgtgaagaacatccagagaagaaggatcgatgcaagaagagttgggaggaaggaaggaaggaaaggagccatacctcgaaatcgctcgctcaggcaggcgtttcgtcgaacaggtggcgcgcgtggaaactgcacaagacccaagaatcaataagccatgaatccacagcagcacaactccgagcaagattcgagatctcagcgcaagaaacaacgctcgagcagtgattgatccgtgaagaacatctagaggagggaggggatcgatgcaagaagagatggaagggaggagggagctgtacgtacctcgaaatcgcgattcgctgccctcgagcgctccggggaatgggagatacgcttccttcgccactgctactgactggtggggacactgctgtatatcatagtaaaaaaaagggaccggtccggctgttgaaccggaaaaactggaactggtgaccatgacggctcggttcagcacaaagaccgtccccgcagtcggaccggtaaaaatcggataaaccgggtagtttttatggaccgctgaaccggtgcggttctgtagaactgggtggttttgtgtttggacacacaatacccttccttttgcttgccttggtcgttggtactatgaactcaggggtaatattgaaaaatggataagccaccctagggtttttgacatactgtagaaatttggaccgtcatccagatccactcaacctctcacattctcaatttctctaagctcaaactcaattgctgaagaaacctttttaatctcggtttgtaacctccagtagtcccgattatgcaaccgggactaaagattttcatctttaatcctggttgaaataacccggactaaagatggatttttagtcccggttggtaacataaggcttttttttccctattttacatatatcgcgctcgatatctcctaatcattaaaaaaatatcatctcccaacatcccaaattatccacaacaacattctcaaatcaaatcatccacaacaacataatcattctcaaatcacaacaacatactcattctcaaatcacagatcgactgaacaaattattctcaacaaacaatcattcacaaataacaacgaaaaaagaaaagaaaaaaaaaatccaccgcctgccgccgctgggcgtggccctcgcaccggcctccaccggacacggcggcctggccgggcgcggccccgcagggcgccgcgtctgtgacttagagggagagggaggaggaggaggagggagagggatagaggagtgggggaggaggagaaggactgaaggagtgggcgttgtgcgtgaggagataagggagagagagagagagtgcgtaaatcgtgggggagagattatttagcccggttggtgttaccaaccgagactgacttaagttcgttgggggccttccaactattgaaccgggactaaagataaaaaaaatagcgctaggcttttaaccaggactaaaaatattttttagtcttggtttttttagcaaccgagattattgtggaatttggccgaccgaccaaagatgatttctacagtagtgtaagacctacccctactcactgctgctcaagttttccccggtgcgtcgcgccttgtcgccgccacctcgcgatttctctctcgacgcagtgtccggcgacctcacatcaacatgccacaacagtagcgcggcaagccggtagcacgaagttgccgaggtgccgacggccgtcgcggcgtcacgccggtagcagagcaagccggtggcaaggttgaagggcacatcattgcgagttgcttcgtgttctagcctcaagaaatatatgtgcatgtgtggttgattagcttattgcaccagatctgttgctagctagttagcctagctgcggaagtgcaggtgtttgatttgctctgttgatcacccaatctagtctaaaattggtattacatatacgatgaactttattggctaccgatttgttttctaatccattagatttgggagttgtgacctgatgtttatccatttgcagcagtgaattctttatccactccagaatcactaccaccagttgtgccggttagattaaccacaatctcaagaggattgctctgctgctgaaactaaacaagaaatccgttccagtaaaaggtcagagggaagactgatcctgcttgggaccattgtgttgaacttgtccccaaggataaaactaaagcaggaaagccaaaacttttatttttacatacatattcatcaatatctggtgtttctgtatataaaataatacaaaacaaatataatattaataaataaaaaggcagcggttcgaccagtgacctgatggttggaccggtgaactggtgaaccagcaacttgaggggttcgatctccggtttggtatttttactatacttgagatagagatggacagttcaggttgaatgaacttgtctgctgcaatgaaatactccctccggttatctctactacttaaaaaaagcctagtggtggtcttgaatagggtttcacttatcgtgtggtaaccgcgcgattaccgcggttatcgcacttaccgtagggatacggtacaggaaaccggtgatatggtttggatgaattttgaccaaattcaaaattctggaaaaaataaaaaaatgaaaaaaatcatggatgtaatgccaatgatgatgaatttttttgaaatagggtaagctaaattcaaatttgagggcgaaaccgaaaatagtttacaaattagaaaaaaaggaagacaatatcggtaagaatcctacgtattcttccaattatcctcaatttctagttttctacacatattcaaccgtattttcgatttttttgcctatttatttttcatttacgtgatttcagctgcacagcccgtgataactgtgcgaatatcgcggttaaccatgcggtaaccacagcgaagccgcgaaaccaccgagttttgaattcgaatttttggatgcgattttcggcggttaccgcgctactgggtgtgtgtgtgtgtgggggggggggaaggggtaaccctggcccaaacgataaggtaaatcttggtcttggatcctcaccctaatagacccatcgcccaatcaacggctcagatcgtgtttcagtcgataaaaacagtactacctccgtttcataatgtaagtcattctagcattgcccacattcatatagatactaatgaatctaaacatatatgtgtgtctagatttattaacatctatatgaatgtggataatactagaaagtcttacattatgaaacggtgggagtatagaagaaaataatagactgatattttgtttagcacagctctcctaatcggccggcactggcatatagtatatcggcaaaagtaaacaatagtttgacataatcatatctggtcccacacaaaataagcaaatcttaactgaaaagaaaactataactaataagatcgggcattgcacgcgctaaataatcagctgcaaaccgacaccaaatcgccatgcttcacgcggtcttcacgcgcatgcacagaccggttgcatccaaattctcctctctcagcaacgtgaaatccttctgtgcatctcctgcttcttctttttaaatcaccagcaaacctttgactgcatcgatcaatgcatcctcacagtccaagattccaagtacatagctactccctccttccctaaatatttaacaccgttgacttttttaaacatatttgaccgttcgttttattcaaaaacttttgtgatatgtataaaactatatgtatacataaaagtatatttaacaataaatcaaatgatagaaaaagaattaacaattaattaaattttttgaataagacgaacggtcaaacatttttaaaaaaatcaacggcgtcaaacattttgggatggagatagtactaacttctcacataacaccaaatgataaaatgaccctctaacttactatacaaacaaccatccagtacatcacaaattcctatacaaataaattgaggccctctttgtttaggcttataagccaacttataagtcgaaaagtctaagcctaaacaaacaagtagcttttctgtttggcttttttgaagccataagccactctaacactattaagccaaaaactaggttggagaagtgtttttggcttatgtgaggtagatgtgtgattcaactactaaacttaggacattaaatccaccggcttataaatcatataagccaataagctgacttaaaagtctaggccaataagtttaagcctaaacaaaagggcctgagtagattttccaagtaaatcagttgcatcatgcatgtattctaaaataatctcgcctgcacatatacactactcctagctgccaaggctatatatatacatgcacccatggtcatcatattgatcccacgaacagccagcccaggcaacaaccctgtagatatgacactcgacacaatgacgataggcttgccagtaagagaaggtgtgagcagcgcgaagctcaccctcatcgtagcgtgttttctgctaccgtttcttgtcgaggctgaatcgcgggcaccggcgccactctccttcagcttcgacttctccaattcagccagctaccgcctggaggacctcctgttcgagggcaacgcaagcgagcccagcaacaagctggtggacctcacctgcaacgagttcgcggagacgatccacaagtgcaaggggcggatgtcgtacgcccacgccgtgaagttctacgacgccaccacgggcgaggtggccagcttcagcacgcgattcaccttcgctatcgccatcagaagcgacatcagcaacccgacggacacaaagggggacgggctggccttcttcctcgctgcttacccatcaacgattccatcgaattcagatggaggcaaccttggcctccttgccaccaatcattcgaaggcctacggcacagaccggttcatcgccgtcgagttcgacacatacaacaacatctgggaccccaataagacctacgaccacatgggcgtcgacatcagcgccatcgagtcggctaacacgacaagtttgccgagctacagcctgaatggcacgatgacagcctccatcagttttaacagcagcacccggatgctgcttgccaacctgcattttgatgatcatccatcgtttcaaccggccgaggtcagtgcgattttgccggatccggtcacattgcttccacaagaggtatccgttgggttttccgcagccaccggcggctctggcagtgagctccatcagatactttcatggtccttcaactccactcttggtttggccctctactgctaatccacgcagaggtatattctccatcacaatatacattttttgtctctatttaaataactaattaagcactcaatctagttagaaggaaggagtaaactactggctttcatgtcttacatcctcgttaaatatttatacaaacttgtatacttcaggctgaatccaatggaatataatggaatacttaatagctgaatgattcgagacacaaacaaatgaattaactattacaaaattaaaaagcggattaaaaatagtattttacaatattcatatgtacgagtagatagtatttttcatataaaaaaaatcacactatttaagagcttgggaagcttgcatattcttgtttcattccgttatggagaaaagcacactcgagaacaactgtcttcagaaggtcggaagctcaaaggtgaaatacatgaaacgactagcagagtgcatgcatgtgttagcaaatttatggaataaatgatgaaagaaacgaagttttagcgaccttacaactaaaccaaaataagtataatgccacactataaaacacttcttacctagcttgcttagattgataaatgtgtcctttgttgagccttccattgctgcacctaatatttacgcggaatgtgtatactatgacgagagaacaaatataacgtactgtagcagcaacaatatatataatagcatatatatgatcatagaatgattaaattgttctaacatccagattaatgttcttacttctcacttggcttgcttctgtaacacgttctatggatgggaacccaacaaaagaacttcaaacaatatatcacaataatcaaccctacatattaattctaaacctggtatttatctcatgtcctttgttctagacattttttttctgtttttttttaaaacaaacctgaggctaaaggcctcaaaatatattactaatagaaatttgcaagctgagaggacagctagataagcaaagaagcccctaggaactgtgcaaattacacattgagcaacaaaacagcaaagaagggcattagagaagaaactgaaaaagcaatcaggttcctaactctgtttcctccacggcaccagccgaatcgacgacgatggcgatggcgagaccagtaaatccatggcaaactgcaaaaaaaaaaagctaaaacacgaaaacggaggaggaaaaaaagggacggagtacggactaaggagtgcggttggaaaagaaaagttgggtggggtgggggtgggggtaggttgtgaggggagcgtatatagttatggatatggagatacgatcgactatatagtgtattataatgatttgcggggatgatttcatactatatatagtactaatgtgttagtcaagaatatattaagaagcgttcgcgaaggctacaacgtacggatgcttaatgaagtgccattgtcgacctagtggcctactgggggattgcaaatggatgattgaaaacgctcaaggccttcatctccagggaggttggtagggcacacccgctctagctttgtgacatgcatgcatatgtatagatgcatactgtatattgtatatgttaccaccagtaattagtagctagggatatactccatccgtcctataaaaaaactaacctagtaccgaatatgacatattctagtactacgaatctaaacatatataatattacatctgattctagatacgtttttttagggacgaaaggagtacttaaaaacagtggtagaggaaggaacttataaagactagggcataattattaatgcaatttgttgaaccttcaaacttcctacaaaatttaaaagtattttcaagagaggagacaagcacaatagcactgttttttttgaacgcagagcacaatagcacttttaactctttaaactactactgcatatatttttactcctttcatctgaaataacttatttttttatataaaccagaatatcaagctaagttacttttaggacagatggagattttacgctaagcgatggaaaacgatttgattttacgcgctgaacctaacggtattttcttctcgctgtacaagtcctggtaggacgtcactcatcggctccatgggtcatatatcggcccatcaaacggctaccggctacgcactctgcttactgacatgaatgccagtcacaggtcacagccacgtcagccttttccccttcgtgggagacaagatgagaaaagttgttcagcaattaatttcaacaaaagtcaagacctcaaccttagggtagtccctcccttcgtaaaaaaaatcaacctagtagagaatgtgatctagaagagaaaaatgtatgtatgttcaaatttattatactggaagagatgaagtaggtcgatcctaactcataaattattgtataaatatggagtttgtataaaactcagtggatggtttattcaaaataattttttatctaatcacctctcttaattatctcttctttcattcacctatccctttgtctttgttcttgcttcatgcctaaagttattttcttgatgagagatgatttcatcttccttctctctccttgttaactcttttgccactttgtttttttatgtgacaaacatacaatactaggagaagggtttttccgtgcggttgaaactgattttcgcatgcagatgggcggcccgtatgcacccaagggtctacgaaaatcgcgattttcgcgtgcgggtgcctatgtcgcccgcatgggaaaataaaaatccagaaaaaaattcaaaaaaaaaaatccaccggcagcgccaccgcctccttgtcgtcgtcgtcgtccgaagacgctgcccgcgccctcgtcgttgtcgccaccggcttccgcgccgcacgccgcctccttgtcatcgtcggccggggatgccgcccgcgccctcgtcgtcgtcgccggcggcctccgcgccacctgtcgccggcatccgcggtcccctccagccgcaccgccgccgaggcccctcccctccgccggatctggcgagggaaggaagggcaggggaggggagccggatccccagggcggggggaggggagggcagggcggccggccgctggatccgtgctcccgtcggcctccaggctcccctccggccacaccgccgccgacgccgctcccctccgccagatctggggaggaaggaaggggaggggagtggagcgggatcccacgaggagagggcggccggtagccggatccgtgtggggacggccgccaagcaccgtcaggactcggggagaggagaggacgacatggaaaatgaggagaggagtaaaagaggagaggagaaaaagaggagaggagggaagaggagagaaagaggggaaaatttaaagtgggtaggagggaaagaaagggtgggtatttttgcatgcggctttcttaataggtccgcacgtgaaaatgggccctattttcccagacgcgaccagttatggtccgtctgcaatctaaatgactctatatctaggaaaatcttttgtgtagtagtgatatatataatgttatactaaacactacgtgacatggagagttgggactacccttaggcttagaggatgtgccctactacctccctatcaaaataagtgtattaaggggttatttgattgatgactaagtttgtcacatctcacgttaccacaagtgtgtatcacctcctatcatatttcttttcatttacctctaattaacctctctctcacttcaaatcacacccttatttaatgtactttctctattccaaaatataagtatttctaggttgttaagcagatgttaaggttaagaagaaacaactttggtgttcctcaataaagctagaaatgcatttactatgacatagagatatagtaggttataaataaataaaaatattcataagaataatgatatattgtaaagtaaaaaaatatctttagaaaatgttgtccaagcaatacttatgtaaaaaggtttttgagaaatcatacttttgaaagtggtagtaataatctatattatctacataattaagttgtttagaatagggcacaaggtagcaccatttgatacacttagatacataatatatgccatgtgttcttaatttataattaacctaagacattgagttgccaaagtttgaaccctagtttgtcatcatcatgcatgtgagtacagtacaggccttgcttgtgtcatgcaagagaggtaacttgcacaaaagaaaaaaaatggctgatcagaatgaataagaaaaacagaattcgttgtacaaaatgtacaattttagctgattgaaaaattatgaaaattaattagatccctgaaatctttttttccctgaagctacaaattaatcaacacgaaaactataaaacctctgtgaaagacctctgcatgtggatcaagatcctgtgcagttgttattataagtgtaacttaagcagttatatgtgtatcaaatgatctagaatggaaggtcaggatatgaagcggtactgtagcaaaaatactgtagcagggatgtactatattatgcctttactgtagcagtcatctagagccgctagatctgaaaacgaatggccacgattgtgtgcagttgctattgtgcagttacaatagcaactgcatttgatctcaatcctctgcatgtactacatcatccccaaaagacctcatttctcactgtagacctcatttttcactatatgaatatcggaaagaaaatgttcgtctagattcatagtcaaagttgaagtgtcttttgaggacaaatgaatggcctgtttggcacagctctagagctagagtccagctaaacaatttcagctccatctaaaatgggaacggggatgggtggagcgctctcacagaataaactagaggtggagctgggtttttttaggctgttccacaactccgatccactacagatccaactcctggagctaaatctaggagtttgagctctatcaaacagacctgaaagtatataatacaacacttgtcattctaggttgtttaggataaattaaggtttcataagaaaagactaaagtaacccttattgattagaagcggaaggttggttgaggatacaatagaaagaaatttgaataagatgtgattgaggggacgattagtactttacagtgacaactattctggcaaagaatttgcaatataactattttagaacttagggattcatacgatccaacatgcatgctgtgtatgaatcctttcttcatgaatcttggattcttggaggtgatcaggtcagacatatgttggcattcacccttgaataactattacgttccaaaacctgcagtactgccacatgaatgcagacatatacccctactatatggcatagtactatatggtattgtcacttcgattaatttgtaccattccttgttttttcgttttttctccttttcccctccgttccccttcttttcctttttttcctcatgcactctgttattttccttttttccttctctttggagccacgagtaaatattttactaacaaattactctcacctaatcttcttttagtaaataattttttttctttttttcttcttttttttctcatgcactcgttattttccttctctttggagccatgagtaaaaatttgactaataaattactctctcaccctaatcttctttcagtaaataaattatgggctttcagtcacactaagtatctaccagcaaatcaattactcacgagtatattgttatagaaaaaaaatattccagtgttatctcaataaagaaattacttccgatagaaaaatctactctggtcttcacttattaaataatttacttcacacaaaatctactgcatcccttatctcagtaaattaattactcataaaatttactcctctcagtaaatggattacttttactataaccattaatttttctggctttttctcactcttataaaataatgcctcctgccttttcccaataaataaacaagaagattgactccggtattctcttagaaaataaatttctcccagactgcttagccacaaaatttactccaatcttctctcattgaaataagttacttcccgactgctggagtaaaatatttaccaacaaatcgatatagccaaaataaattacaaccatatttttgtcgactataaaactacagacatgtttacaaagactcaggggcacaaacacatatgattctacaattaaaaaaagtagactcgctgctccagttgcatctgcaaaggacaaatagtagccgatgatgacaccggcaccgacaaccttagaagttctgtgcggagttatgggcaggacttgtgtttggaggtgggtgttgggaacccatctcccatacacggaaaacagagcggtctgttagcacgtgagtaattaagtattagctattttttttaaataacttttgtatagaaacttttttgtaaaaaatacaccatttagtagtttgaaaagcgtgcgcacgaaaaaagagagggaagtgttgagaacttgatcttgcagacacacccgttggcaaccacaacagattagctacaggtagaaatcgatggaggaggccaatgacagctggctgtagctagctcatgcacgagcaatccccatcaagagagggatccgcaaaataacaatgaatcacaggggcttagaatgctcacaacaatgaaaccatgatcacagaaactaaattcaaacatgatcgatagaaatggtgaagtagtgagactttgatcttatcgacaagaacaatggttcgatccagtagataatgttaggattttagaaagaagaaaaaatgggatttttttaccatgctattcttctactgcaagtcatccgttatcctccttcagctgtgcaaccaagtttgtactcctagcctgcaatcaatgacattgtgcaataattgtatatagaatctcctcttgttccagttccaaattcctcaacactgcacagaccaattgacaactaaaaaaataaaatttaaacaggaaaagtaaggaggtgttgaatgcatcctgcaggaatttcattgtggtcaggcttgttgttagactgctggtaggaagtcagagagtcagatacaaaactgtagtgcataaaatataatctaaatgacccagtgcataccttgaaactgaatttgttatccagacaagcatggaagtcagattccttttccttcaaacgaacatgatcatgaggcctgaattcactatggttcttggtttggcatatattatgaagtgcaactagttggttgctgaaacaaatagtgtgcactacacatctaaccaaaaagaactttaatagtgacaggttaccaatctcaagaagctcatggttttgttttagagtcaattaagcaaactgctagtaaatcggttaatatgagacattatatttgtgtgtaggcaccaaacatatatattgaaggacaaatccaagcctgtaacctgacaatgcaggcaccaaatccattaatatcttttggagctcaaattcgaaattctggccattgttcatttgtttttatacctgccaaaagtagaatgatgctatttgataacatctgaatatgtactcccatctgttccaatttaatgcactcaaatttgacccaaattaatactgataaaactaggatttcttaataaatagatgaactctagtttttgacatggaaacaagcagcgctttaacacccatgaatttgatcaaacaaagaaaatagcacaaaatgtgcataatggagcacgtgcacattaaaaaaacacaatactaaaattttgagattaaatcactttgaatggtttgtaatgagatccaggcaattttagcaagaattatatagtgtggatagacatatacagatgtctaagaaaatcagccacacgattgcagtggaaaacatttgagtagtttagaatcaaactgcaaatatgaaactattacaaacatgaagcaagtaaaagcgggatgttggcactctgaaactgcaaaaaacctgaaacgcttctattatgtgcttgttgactgcaaacctgaaacggtggagatcgaccgagaggcgacgttgccgatggagacgagcggatccagacacggcatcgattgttggttgctgtcgtgcatgtatttcacctaggatggcaacaaaatcatgacaacaataattccagctgaacaaaataactacagcaaaaatgatttggaatggacgctctcagccggcgcccggcggatgtgcaggcgcgacgccgaaggtctgacgctctgaggcagagctcatggagactggatcttggggcgtcgttgagcctgaagccgaccggcagaggaggggcgtcgaggcggggccgcgggggggggggaatatttatacaaacttgtatacttcaagctgaatccaatggaatataatggaatacttaatacctgaaagattcgagagccaaacaaatgaattaagtattacaaaattaaaaagcacactaaaaatagcatgttacaatattcatatgttcgagtagattgtatttttgatataaaaaaaaccacactatttaagagcttgggaagcttgcatattcttgtttcattgcggtatggataaaagcacactcgagaacaactgtcttcaaaaagtcggaagctcaaaggtgaaatacattaaacgactagcacagtgcatgcctgtggtagcaaatttatggcataaatgatgaaagaaacgaagttttagcgaccttacaactaaaccaaaataagtgtaatgccacactattaaacacttcttacctaacttgcttacaatgagtaacgagtacttgtgtgagccttccattgttgtacctaatatttacgcggaatgtgtttactattaagagaggacaaattttacgttctgttgcaccaacaatttatattatacg

SEQ ID NO: 9954 - DNA, 5428 bp, Oryza sativa
  unsure (1)..(5428): unsure at all n locations
ttgggaagccccatccctaatggtagtgatttaattcggggagggcccccccccaacccatttttaatgcgaaaccacctttcaaaataaaaagaggtccgccataagaaaggattaatataagttctactatgaacccgccaggggttcttggaatggtacccatatttttttcccaagttctactgggccatggggccacctatgggtataatataagccctcctagaagaaaagggacccgggaccaatagttcaagtttctcaatgtcacggggaatgtcaccggagcaatgtcaccgaatctcaatcccatcggatccgccatcgcgccgcctttagctgcgccggatccgcctcgctgcgaccagatccaccgccgcctcgccgagcctccagtcacccaccaccaccgcgcccgctaatgccgcgcccatcgccgttcggcggtggcggaggtggagccgccgcgcctcccgcccgccgacgccgcgcccgtagtcacttgttgccccgaaccgctactgccgccgctccttctcaccgcatgacaaactgcatgcctccgccggatccgtaaaaagtggagagggaggggaaagtgagtggacggttagattcaataataagctatttactccgtaaatgtaggagagggaggggcgcagcccgcaggtgggcttttgggggaggggtggggggtaggcgggnagggggtgggatgtgagaggaagcgttttagttattacgcaccccaggtacggtatagtatgtgtgtgtctatatatatatatatcactattataaaaattgaatatgtttttgtcgggattttggtacgtcatccgtgttagaaacggttttaattttatgtttcagttttaatctatatctatatctctataaaaacaatttccgtcttctgtaaaaaaagaaagataaaagtccgactaaaaaagaggtaaaaaaagaaagaaaaaaatgtccgactcaatgagcgattaaaaaaaaaaaaagcttccgtcgtcctcagtaaaaaaaagagaaaaaaaccatctcttgtccgactcccatacaaaaaggaaaaaaaatctcccagtaaaaaacgaaaaagtctgtttgttttttttcaccggtatttttttttccttttttctttttctttgcacgcaaaagagttttctacgttttctctttgcacacaaaagagtttttttatgcgcacacgctaaggcttttggttttttttaatccgatcggttcaccgtgcacctcccgtgcgcttttagttttttcgtcaatctttgttgtcatcggtttttctcccgtgcgcttttttttttcttatctggttttataatcccatatgttcaccgccgttatatcgatcgtgcgttttctcccccaatttgatttcaaaaatcaattccccactcctctctcatcattttctctatgattttcccttcgattcggctttaattgccggatttaatctctgttttatagttaccgatgatgacggtgatcttccccggtcatttttatcccgagttttatgctctgattcagggaaaacggaaggagtagctcaagtggataaaaaccctcgactaattttggctgaccaagaaagatttagccaaatttgatggggatattttctctggcaaacgtacgggcgcggacacgggattatcttcgggagattgaagatggtagtcatagtcgggaagttgaaggtagttgggtcgaagagaagaacaccaaatgaaggaaggtagcggactagcgtagggctgacaaggaagaaaggctttcggctgaaaacccaggaaatattttcattaccttttcttaattataatttatagcgatcccaatattaagatttttattaaccttttcaattatagtgtatactgaatatccaaatatttcagctgtgtttagatttcaacttttccgtcacatcaaatgtttggacacatgtatggagcatcaaatgtggaaaaaaaaagaaaaactaattgtacaatccgactgtaaatcgcgagacgaatcttttgagcctaattacattatgattagccataagtgctacagtaacccacatgacggattaattgggctcaaaaaattcgtctcgcagtttacagtcggaatctgtaatttgttttgttattagtctacgtttaatactttaaatgtgtgtcaaaaaaaaattggccaaatttttacagcatctaaccacggccttcaatttgttactcgactcttagtatatcattgaaaaaagtctttacccgttgcaacgcacgggcaacttttatttgataatgtgtttgtttgagcgtccgtttctatactatgggcctgtttggtagagctccaactccaaaatttaattacatgagttaggtctggagtcaagttgtggagctgcccaaaccctactccacctctctagttaattttgtgagagctccatccagttccactcccattttaggtggagctgaaactgtttggctgacatctaactctaggagaggtggaggttgagctggagctgtgccaaataggccctatatttcattgacaaaattaaatgccttgtggcttgtacaacctaaccatcacacatataatcgtggcttgtgcaaccaaaccatcacacatataatcatcctcaccatcctacccatcagagattatttatagctttttgccaccacatgtagccaccactaagacaaataataatatctggccaccaccataatatatatatttccgggtgaacagatattgtcacacctgaaaatacggcatcgtcttcacatgctctgaacttaggcatatgcctagcactagtacacgattgattttcctggacgctgcccccttttatttccatgcgattggtaagtaaaaccgcacgagaaaatcgaaaaccggtgccaagctaacgcctgcacgagaaaatcgattttcccgtgcggtcccgcacaagaggaccgcacgggaaaataaacagattttcccatgcggtaatatcctcttttcccacttatccacatcgaaatttcctcggtaccctccctctcctttattctctcacgtgtcacgtgttaaagcagacagcgatgtgtcaggcctcatatcctctcctcactcctccctcctctcctccctcagcgacagcgacgagacagcgtgcggtgggcataggcgactgcggtggtgcgcggcgacagcgtcggcagcgcgcatctgccgtggaagcacgggatatggtgggcagcggcgacgacgaggtggcacgcgacggctgcgtccgatccagcggtggccaccccacgcgcggatccggaggcggcggccacccccacgaggattcggctgcatgacgacgacgacggccatggcaacgaccgccccccgcgtggatccagcggcggcaaccgccccacgcgcggatccggcggcggcggccctgtgccccccacggatccggtgacggcgtccgcccctcgcacggatccggcggcggctgccgcccctcgcgtggatccagttgcgctacggcggcgccagccgccccccgcgtggatccggcggcggcgtccacccccgcgcggatccggcggcgcgacggcggaggcggtcgccccacgcacggatccggcagcggcggccaccccacgcgtggatccggaggcgcgacggtggcggcggccgccccccgcgcggatccggcggcggcgacgggagcgcgacgacggcggcatggccacggcaacggcgacgacgacgggaaggcggcgatggtggcgacgggtagggttagggtttcgttttttcaattttgtttttttttcgattttttgtttttgcgtgcgccacccgcacgcaaaaatattgattttcgtagacgaattgctccagacgggctgaagctgcacacgtgaaaatccaaatcaacagcacgggaaacgatctgtgtagtagtgtagtctccttgaggaagatatatttagtacaatcctatactactagcaacaagattcatgacgattgagcaagatttagtacaaccctacaagcaagccagacatgtacaactagaatatgcaaataatgcacatggcaagttaaaacaaaaaatgcacaagacacaagtaaagtaaggcacatgcatgggtgattttgcgtaagggatcgaatagttttcaacaattcaagacttctacaatgcagatcagtttcaaacacatagtctaacctagctaataagtcataattcaataacattatcttggtagtgtttggtttggggacagggtgggatgggttaggtccatccctgttttttggaatgggatgatcttgttttttgtttggttacagggatggaacgagcactgttttttgtttggtttgaggtatataatgggatggaatgatcctatacattgtttggatggagggatgaaggtgggatgcttgatagggttacctattgatattagttggtgaggttaccctcaactagtcatgaataccacacagtgcaaaataatacttactcatgaacaccacactatttgaaaatgaccattgtgaatctgttcgcaaacaatatagctccataggttattaaaaagatttaataaaacttcatgtatgccgatactaattgctgcaacagtaggcttcacagggcacatataatacaagccacccataataatagcaaattttagtcttacacatattagcaaccgaaggtcttacacataatagcacattttaattcttgcacatgatagcaattttaagtctagtaagttctctgcctcaaacatattggcagtttaaagtcttacatataataggtaaataagccaaccaacaacacataacaccaaaagaactatccaactcatccaagaagcctatgttgatccagggaacttttcactaatgaacatagcaaaccaatgcatcttgttttcaaatggaagtccatcgaatgctctagcaatatgagggttggcaaccaaatgagcatagtaaaatgatctatggacctcctcaaaaccaggaagggttttcaatgtgtcaaataaaccttctggaagcttattgtccggctcggcgacctttagtatagcagaggcaagcttgtcaccaacactagtgaatgcaccaatcagcccgtcatcttcattctcttgtgtttttgctttctttggcttacttgcagatgatgcctccgcacgatcatcagtagtggcaggaccatcattttcttcatcattgtcatcttggacatcctctgttcctaggactgaacttgagtcctttgcatactttcctgtagtgatgaactacatgctgacgatgccaatctacttctctc

SEQ ID NO: 9955 - DNA, 2464 bp, Oryza sativa
tttttcatccaaacaagcagcactcactttcctaagcctatttatcttcgagaactttctttgccatgtcttcaaatggttcttaatttgctcacccgtgagagtactattgaacctttcattgaccgccctagcacatgcattgagatggactgccttgaaaccagatgaggtccttgtgccaccagcaacaacattagctaggtgagaaagcatgaaagaggacatagctgaggtccatgaagcatgggtgcttcctcccttgccactgttgttatccatttcctacctatcataaaataaaacaaaaatgtccattcagtaatatatatatcaataaattatgcatgcaacaatatatgaactcagaaaataactattcagcaatatatctaataaaaaaatgaccattcagcaacatatcaacccaaaaaattaccattcaccaacatatcaacccagaaaatgaccattcagcaacatatcaacccaaaaaattagcattcacaacatatcaaccgggaatatgagcattcagcaatatatcaacccaaaaaattacctttcaccaacatatcaacccagaatattagcatccagcaacatattaaccaagaaattcaacattcatcaattcatcaaaccagaaattcagcatacaacaatacatttatccatacaactaagatttggcaaatggactacaacaagctgtccacacgaaataaataaataaagaagttcataatacaaatgaaatgtagcaaataaggtagaaatacaagttgcatagctacatattacactccatgatggttattacggtcagcccacatctgatcagctaaaccctgcctgaactgaaccatcaatgcatggtcattcgcttgccaagttggcgattcatcaatgtcctcacttgaccaatcagacggagctacaagctcatcaattccgtcatttatgacccagttatgaataatacaacaagctacaacaatatctacttgagttcgaaatgggaagaatggagtggcatcatctagaactttgaacctcctctttagtgacccaaatgcacgttcaaccgttatacggagggatgagtgtctaaggttgaacaactccttctcattttgcaccggattattcccccactctttcaagtggtaccggacagcacgaaaaggaggcaagaatccttgtttggctccatatccaccatcaactagatagaattttcctatcatatgatcgataagttggtcacattcctaaatatcaacatttgtcatggagaatttgataaactatagtaatctattaccttgtgggacatgaaggccattttcacgttccaaagcatctcttaaaactacagcatcatgtgctgtcccctcccaaccagccaggacataagtaaaccgaagatcaaaatctacggccgccattacattttgagtggcatgggacttcctaccacgaaaagaggactccacattcttacgaacagaggctctaatatgtgtgccatcaatagctccaatacaatcctattttgtgttcaacaacattaaaaattagggacaatacatcaatgttcacataaatataaaatgagataggaatgaatctcacaccttaaagtaaggatcccatctaggatttcctgctattttagttggagtgtccaatgaggggggtctgataagttcatctcgtagctcaccaattgcatgaaggactttgttaaaataacgacttactgtttctccagacctaccataattagtgcggactaacctatttctaaggttatgtcccaccgtatgcagaaacatagccacttgttcctcaatacacatgtggatggtatcttcaagtaaaccacgatccctaaatagcttacaaaaacgaaaaaaacttccttttctaagtctaagcatgtcaatacaagttgtatcattgaaccaaattttcgtttctaggtactcaattcttatcctatccctttcagccattgggccatatctaataccttctctccttgaacctctcgttcttttcctagaccgaataatcatggccatcattgataacaataaatttgtagcagcaatacaaactaaaagcttggtcctcttatccatctacaatacaacaacaaaaataacacatgaccatcatctactgtcaagaaatttaccaaaaaaattaacacattgttgaaataattatactacaacattcttaaaaaaaacagacatgcacagatctatataaaagaaatccccattcagggtttagggtatttttaccttgtacaatggaaactgagctctgcagtttgtggatggggatggagaagatgaggatgagcagcacctggcaatggaagctcgcgcgccgctggcttgcccttacttccacagttggcttgcccttatcgggcccgcggggtact

SEQ ID NO: 9956 - DNA, 13276 bp, Oryza sativa
  unsure (1)..(13276): unsure at all n locations
acggnaatcgataatcantggtacagtagttcatcaggaggagagaaaagagcgaagggaaaaatgagaagcggtgaaaatatgtggtggggcgcgagagttaccgcgccgagacaagtgaggcgcgaggcggaagtgggatggcgcggtccgtctctttttcccggatgaatcggtcccgaatattgaaggaatattcccttttagagccatcccatcccttctagcctctcaaccaaacacacctaaaaatgggatgatcccatcccatcccgggatatccctccaaccaaacgctaccttaggttgtgaaacccacgcacaactaggggtgaaagtggttcggatagtttccatccgtccggaccatttttcggattcggatagtttcggtcggaactatccggaaattctcggattcggaaatgaattcggattttttttctcggaaacgaaaacgaatacaataagggtactatccatctccgtcggaatcggaaaacagtcggaaactatccggatttttttcggatatccacagacattgagcaaattttagaaaaaacacgtatatatacataactttttcatgcggaatcaaacggagacaaactttatatcaatattgtagagatcgatgagatctacaacattcttattaactattttattatttgagatcatttaagggtctaaatattcattataatataccatattaatttttacaaaatctcatatctacaattcaaacgacatctgatggagatgtgttccatatcaaagttgtagagctcaacgggatctaccactttgtagtttataacatttgtatttgaaagcatttaaagtataaaacaaacattacaagtttcgaagatgtgaagtaaaataaataacatcttcaatttatacaatggtaagtaagttatacatctagtaaaaggtcttgggaatagaaaatgataatcatatttgcatatggatctctaagaggaatagccatgaaaatcgattttcacatacggttgtgggaccgtctacaaaattgacgatataaatgttggagatgttgaactaaaataataagcgatatctcttactggatccagaaactcaatttgagggttttttatataccagtaaatattcgctaccgtattcgttccatctcgtattcgctccgtatctgtatttgataatattcgatttcatttccgtatccgagttttcgattatgattccgattccaaaaaaaaaaatgaaaacgaatatgataaagctagtttccgtccgtttccgatccgttttcatccctacgcacaacctgcccctcctgcctccaacttgcccttaacccatagacaatagtctacgtggtcggtggttccaccaacgggtggtaaaaaattaaccagaaatagtaaaacggaccgaagaagtgttggttttttcggtgtttggttttgccttttgttttgtttatagtgaagctcagtctctagtttgcaaaaactaaaagccccgtataaaccgagcatgctagcacagtagcacctctctagtatgggcctgtttgggggagctttagattttgagaagcagttgtttggtagctagcttctgagaatccggaaaagctctgaaacccagcttctacaccttctggcttcttagttcatttttcagaatctgtaactacagattcccagaagctgtggactgcttggggcagcttctagcagaagcagcttttgggaaaagctgcagctgggagaagctccccaaacatggccctagccttttatgtgcgcagcccaccaccttgttgaaggctttcagcttgcccacttactaactagcaattaaaccagcacatccaccgttgccttatgaaccctagccgccactcgtcgtacactcacaaagtttacgcaggtggccaagcagccttgacggtgactgcgaccgggggaacagaggtgggaggcagacgaagatctacgtaggtggttttcggtggaactgaacccggaaaagccaaaccaacaatactaagagaatcaatttttctggacgagactccctttaggttgcaggcctgtcataattgctcccgcttgaaaaaatcgctcccctgtagatagtgaccccttaagaggccctcatgagaaaatagattttcgtatgctggcaaaggggagtgcaagtgtccccccacacattttttcccgcacaattttttctccttctcctccttctcaacaccgcacctttttctcttctccatcgcacctttttcccactccctctcttcatctctttgttaacactaaaatttgataagattctttagtggattcggttaaggaaagagcacaatcagtcgatggaaagcttatccagaagagtccaagttcaagaacgaatcataagacttgtatctattaataaggcggagtcagttagtttccttttttgttagtgtctgattaggatttgtatcttttcttttatcttcaggaaagtttgagtcgtgtccagttaggactcttatcggccaataggtataactatgtacacccaggatccctgtaatctatctctcgatcaatacaactactctcggagcatcaccaccctctttttcgagggttttatcaccgtcagaacttggcacctgacacgggctgcatcgcttcgatctccgacataggggtaagtcataagttccgccggccatgtcaattgtatcggttatgttggtgttgtccaaggctgcatcgctttgatctcttggattgctctagttcggttggtatatttttcctacccgatatttcaattctatatttaattacattgtgtttagatatgcatcgtttagttgggactgtctcggttaggtctgatcttctgtcttagccaatatatctctacaatcacaatgtcactttagatagatttgttatatccatcacattatataaatttatcgactcattgagtattagattatcatatacaatttaatgtttcatcagttaggtccaacctgctaaattgttattgacaatctaaatcttgttaggccgataggttcatgctaatgtttcattgtagggttagctgatcttatctgatgtgttaaatttatctttgatggttttactattttggttaaatttaatgcatcattaccatgatcggtgtcatattagcttattcaaatctatcaggcaattatcaaccttatgctgcatcggttaggtttgacctatcgggttgtggttgtaagttagatttttttaagtctttaagcatcaatcattgtttcatcggggtttcagctggtgagttatcttgtcggtgatatgggcccggaggtatcaggtttagagggaggaggctcccccgagggggggagtcaggcccgaggtagggtggcggccactccttcctaaagactggatggaggaggctgccccccgatgccacgtggccctcccccgaggggagtcaggcccgaggtggggcggcggccactccctggccgagactagagggagaaggctgccccaggcgccacatggccctcccccgaggggggatcgggcccgaggtcgggcggcggccgccccctcctgtgactaggggttgggctcccccgaccccctctctaggtcaccatgtacggtgggttaagtgtccacctccaggtgcccacctacccgcatttatggcagcccgagtagtcgcgccgtgccgcatttaatatggtgtgcaatgcactcaactggtctgtgaccggtcgaatgaccgatgggactggggtagtgcgcctgtgcgctgctcgtgtgtcaggcgacgtgcagcctgacatgtcccatcaaatagtgatggtgagaggttctcatcctcctatcccagccggagtcggtcccccgctctggtcaaagcaaggctcctgtttcccagtgtaataggagcccagaagtcctcacccattaaatggtgactgacaggggcaccccccgtgtcaggcggcaagatttgacaggcctcatcatcaagatgacgtgcgcttgcttcccaagtcaagagacaggacatgcatttaatgcaaagattgtaatccttctccactaagttatgtttttgggcccatgtggtaaccccttgagatataaaaggaggtccaggcctagtaggagggggggctagagcccctgatgatcaacaccttctaccccaacaaggagatcttataatttctcacaagatcagctaagcataggagtagggtattacgcttctcagcggcccaaacctgtataaactccttttgtctcatcaccttggagggggataactccctcaagatgacacagcttcgctcaacaaaccctcgaatctcacccgctgccctcggcagaactcacaaaggggggcctcacggttccccggtggaggagttcattctccgacatctggcgcgccaggtagggggcgcgttcgtgatttttgaggttctttcgagtgccggtgtgacgagcgtcgcggcgccaaagcgggggaaggcgcagcctcctcaggagtgtcgcgccaccccaggcagaaggctaggcccccccacatcctcatcgaaaaaggccagcggccaggcttttgtggcgagtcttcgaaatgtccgatggcccccaaagttccggcccagcctcactgagaagtacgacggcggcgtcaacccctccgagtccctccagatctacacgatgatcatagaggcggcggggggtgatgatcaggtcatgacgagcttcttccccatggccctcaggggccaagcgcggggttggctcatgaacctgctgcctgcctcggtctactcctgggaggactcttgcagttgagctccaggtgccgtcgaagcccgggaccccctgtgctggctcttccgcagcggctagctttggtctcgccggctggctacggtgcctgacccggctcaactaatcgtcctttcaagtttcaatggtcgcaggcttcccaaatggttaggaacccatggtgggaggccctcttcgagctaacggtttgaaaggtcgcgacatgcaagcaaggtttgtgtttgcttcattcatacaagcgattatttgctataagtgtggggggctacgattcctagctccatcctagccctacgacgagctctgggcgccgtccacgtctggggccccctgtgctggctcttccgtagcggctagctttggccctgacggctggctacagcgcccagcttggcttgatcgtgggtgaagattgttggctatggaaaatttagtcctcgcactcgtgcgaagataatcgtttgcatagaattattatggcttatatttatctctcatctcatcctcgcggtcccgcggtacccatgtgtcgcgcgctcgtttgccccccttggtaacgaaaagtttgtattcgctttatccatccaaacgattttttgctaaaagtgtggtggctacgattcctagctctatcctagccctgcatcgagctttgggtaccgtcgacgcccggggccccctgtgctagctcttccgtagcagctggctttggccccgtcgactcgctacggcgccgagcttagcttgatcgcgggtgaagattgctggctatggaaagttcagtcctcacactcacgcgaaaacaatcggttgaatagatgaagtagaacacgaacagaggttaacaaaaggcaggggcaagcgaggtacgcgacgtgaggtcgcgggcccgagagaatctaacaacgtttgctgaatgtatacagaaaataagtttacagcctaaggtacgggctggcgagtcgccctcaggctggggcgaaaaaggcgcatgggtcctagtgctagcaaagaaagaagaagataccgggcccacatatcatcagactaggagagtggcatcaaccttgaccacctggggaaagttttggttagggctaacgccgggggctactgtcggtgatatgggcccgggggtatcaggtttaaagggaggaggctcccccgagggggggagtcaggctcgaggtagggtggcggccactccttcctagagactggatagaggaggctgccccccgatgccacgtggccctcccccgaggggagtcaggcccgaggtggggcgacggccactccctggccgagacaagagggagaaggctgccccaggcgccacgtggcctgaggtcgggcggcggccgccccctcccgtgactaggggtcgggctcccccgaccccctctctaggtcaccatgtacggtgggttaagtgtccgcctccaggtgcccacctacccgcatttatggcggcccgagtagtcgcgccatgccgcatttaatatggtgtgcaatgcactcaactggtctgtgaccggtcgaatgaccgatgggactggggtagtgcgcctgtgcgctgctcgtgtgtcaggcgacgtgcagcctgacatgtcccatcaaatagtgatggtgggaggttctcatcctcttatcctagccgaagtcggccctcccgctctggtcaaagcaaggctcccgtttcccgatgtaataggagcccagaagtcctcacccattaaatggtgactgacaggggcaccccccgtgtcaggcggcaagatttgacaggcctcatcatcaagatgacgtgcgtttgcttcccaagtcaagagacaagacatgcatttaatgtaaagattgtaatccttctccactaagttatgtttttgggcccatgtggtaaccccttgagatataaaaggaggtccaggcctagtaggagggggggctggagcccttgatgatcaacaccttctaccccaacaaggagatcttgtaatttatcacaagatcagctaagcacaggagtagggtattacgcttctcagcggcccgaacttgtataaactccttttgtctcatcaccttggagggggataactccctcaagatgacacagcttcgctcaccaagccctcgaatctcacccgctgcccccggccgaactcacaaaggggggcctcacggttccccggtggaggagttcattctccgacatatctggattctggatgttgtttaagtgttgcattagcttataaggattatatacaagttggttttagccgattgtagcgaaggtttaattgattccttaatcatttggaattgatgatattggttttctagccgatgtatgttttaatcatcgagactacatttaatattatttctatatcaacatcggtcgattggttcattagatattttgcttcgttacatctatactggccgattggtacattggatatttatttattactttattattagctgattgtctttatatcattgtttatacaagtatcagagtccacatcggacatatagtcgattgttaaaaaccctatcgatatcagcttgttggtcgatcggctctttgatcatccatttatatatctagtcagttgcatgatcaaactgattggcacatcaacatctcaactataatttaggacatgcacttgagctaaatagatctcccaggcctttgtgtttttcacgtcaacactcttcccctttcctctcccccttatgttctccggcggctaaggcggagcaggctagagcgagctgagtgagaacgagctggcggcggcaggttcggatgggcaacaatgatggcaagcggtgacggcagagctcaagggcggcttatttggcaatgccaccctcgacagttactacggggacgactatagcagacggcgacgacaatagtgagctcgacgacaatagttcctccactcgatgcactatcaattacattacgcgatagtcccttagttaattgatttgccagatttaatttttagccatctggacatagtacaatgctatcactctagagtttttcagctttctgatatattttagtcaacgttttatatgcctagatgatttcatgttattgcgtgatggtataaagatcttctctttccacaatgacgtatatcagcaaatgaggttaagtcaatgggcctgggtctatattatattatactactgccgttctatcttaagttatttgtttataagatactaattgataaaattgaacaaataataaattatatattattatttgttttcaatagtaagttatatcttatgattgttatatatatcttcctcttattaatttattgatttgcctcttattttgtgccatagataccccaaagttattttgctatgtttcttggtgtattagtttgtgtgcatcagttctgtctcatgcaagacatgtttatcattaattttcttgtcaaatcagattaattcaatcatactccattcagtttttaatagatgacacgtaaacttttggacagcaatttgttttattaaaaaaatcgtacaaatatataagatatgtttaaagtacttttttgaaaaaacaacacataccaaaataaataataattacgtattttttaataagacatatagttaaatgtgtgtttaaaagttaatagcgtcatctattaaaaaatataggtaatatgctgtaagctattaattcgtgtagacactgtcattggttccgccttacactcagtggtccatctaaaaaatagtccatagaatttattgttatgcaaagtaagaaaacgctgataagatcaatcgcaatgggttgggttctatttagacctaatcatcatccaaatagtattaggacaaaatatttgttggtttttttttgtgcactattgaggttgggtcctatcctaatactctcttggctagacactgctccctccgtttcacgatgtaagtcattctagcattttctacattcatattatatatgtagattcattaatatcaatataaatatgagaaatactaaaatgacctacattgtaaaacggaggaagtactactttaaggatcttctctatacatgatattttttacctataatgtgtgtcctttgatgtgcatgcatactccctccgtcccaaaaaacctaatctaggattgggatgggacataatctagtacaatgaatttggacagattttcagttcagatcctaactaggttaggttttttgggacgaagggagtatgcttatagcttatttatagcatgctattatagaatgggtctagccctcgtacacagagtacgataatgcattggatggtacatacttgtcttacaagagatattcttgcaggctatgaagcattatttattgttggagtcctagctctagtggtggttgttgtgtagattattgtctcatgttttatgtggacaagaaggagcaatgacgacttagatcttaaggaaattgggggacctaggcagttcatataccgagatttgaatgttgcgactaacaagtttttgaatgtgattgggcgtggtgcctttggcgtggtctgccgcgggtccttaggaggctatgaggtggcggttaaaaccctaataaatggaaggaaggacttcatcgccgagctcagctcaattggtggggtgaagcacaagaatcttgtcaggctcattggctggtgcaggcaaaataggttcaacattgttgatttcatattctggtggaggcatgacaaaaagaataagcttttccttgtgtatgagctggtgagcaatggcaacctttgctaaacgcctacacgagggagtactcgaatggacaacaaggtaactaactaatatacacacacgcatgctttatatatatatatatatatatatatatttatatatatatatatggtacaacttattaaattcttttatatatatgtatattaggttcataataataaaggatatcgccaatgctcttctatacctccatgaagaatgccacccgtacatcttgcatagagatatcaagccagacaacatactcctggacaacaacttcaatgccaagcttgctgatttcgggctgtcaaggatcgccgaccccgacaacaacatagtgaagacgacagcccatgggactaagggttatattgatccactctgcatgagggacgcgaccattgaattcgatcgtagctctgacatgtacagcttcggcatggtcctgctagtggtggcatgcacacaaggcacctccagggaacaagtctggcagctgtaccaggacaaatctctcctgcaggctgctgatgacaatttgagaggccagtatgacgagacgcagatggaaagagtactcatcctaggactctgttgctcccgccttgatgatgctaccaagcggcctaccatccgtcaagcattggcttttctggagcacggcggcccaatgccaggcctggagtcattgatcaaccctcgatcgaatctctaaaaattgatgagcaagatgcaattaatagcacttaattgggtccatggatacgtactttgttatactccatttgcgtaattttacctatgccgatgcataatgtgcgacatcattgtcctcatttgttatggttactcatgcagcttccccttcaggttattctcacaaactagaaaggtatgtgcgcggggcaccttatttaattaatgttacttgaattttagttatgaatacttatgtgtggatgagtatttcttaaaatatttttttactctattctgaacatgtttttatcaataatttgtttgaggttgttgtgaacgtcgcttttaattttcttctaattacctttcaaacatataaattctaaaccaaaattatttaaaccgtgtggtttttaatttatgagatactattgtttcacaacaatagtgctacttcatatggaactattacgtgtaccatgtgtgtgtatttttttttagaaatcagcatatattactttggagttatagatgtctattttatctgtttaatggcagacttctatttacttcttctccctcctcttttttttttctcatatgatctcttatattatgtggagaaaatgaatttagtttgaaataagagcggaaataattagtatgtttagagaatttataaatatttaagcaccatagactaaagtatagactaaagtatacttttgttaagtaagttcttattatgacgtgtatttttaatgcatgaattcttatattaactttagtattgtttatattccataattaaccaaacttagtatatacaaaatacccacacaccatacgtatttaatagaaatcaaaggggataaaacacaacatgtactccatccgttattttacttattatttagggtgtagtctacaaattatacatgatttggtaaatagaattgacattttagattatccctgtatagtccgaatagattggaatccacatgataagtatatttatatgatcatataatccatattgttaatttttatcatgatttgtcgtaattctcaattgccatgcaaggctgtgacttgctacttgttgatattgtaaatctaattaagtcgagcatatttgtgaactgatatgggctgaatagagtgcacactacatagtaagcatatttatgtgatgatattagccatatcattaaattgttttttcacgatttgttataattctcaaatgccatataaagcgcaaagatatgacatgtttctggttgatattgtaaatctaatttagtggtacatattattatatccgacaaagaatatatagtgatatatactccacactgtcattttttttataattttcatgtccgtttggattacacacaaagaataaaaatatgacctaaaatataattttttatagattaaagtatagttaatatagatcataaattaagttaatggtaaataatataatttagtaaacttttttttcaatcatcttagatctaattttagttatttatgattataatgtgatatatgacactataacctgtgtttttcgtgtttttttgtctgtgagatataacacaaatggtcaaatcatggatcaaaataatatttattatttttttctaaataaaaatatagtaaatatggattgatttaaatgtaaagaatataattgtggtagaataaaaaaaattgtatatataatttaaaagttacaatagtttatttattatatttatgtactacatttatctcaaataatataggaaaaaatgagttaaggagagggaagaggggctccacattatctgcaattagtgagtatggctggttagttaagtatggtggaacttaaccacctaggtttaagatgtagtcttgacatgggtctcatatttatggctaattatttttgtagtaggcgacgttcccatcaatagcgaggtgcttgtggtgacttcactaatttgaagatatatcattggctcagtctctcgaatatgttttctatggataagtgcacacgcgtgtatatgaactcttgtgtttgtactatgtttctcttaaaaaagcggcatgcattacccttccaaaatgattatctaaaaaatcaattagcaaatttctgtcggcaaagcacgcagtatcaagatgtctcgactaagtgctcaaaaatcaactgacatcacccaaatacccgatgttagtgaatatattgtccaagagccaagagctttgatatatcgctttgttgtagaagctagtagcaacagatcagaatacgaacaacatcaccaaggagtagtataaaatgggaaaaagtacgaattacacccccgaactatcgcggtcgtctgaattacccacttgaaccacaaaaccgaacatttttcacccccgactatacaaaccggacgaattaccccctcgacccaatccacgttggttttggtctacgtggcgtgcacgtggcagtccagtcagcgttttttaattaaaaaattgtgggacccgcatgtcatacacttcttactctgtctattctctctctcttttctctctcgcgcagcgcgcacggcgaggacgagcgcggggacgggcggtcggcgacagtggctcgcggcggcgcggcccgacagtccaaggagtaccaccacgccgagcaggtcgacgagcaggaggaccaccaccacgcccggcaggacgatatgagtagcgacgcctagaagcttctgggggattgacgggggcgntagataccattccgacccctccactgagggttttac

SEQ ID NO: 9957 - DNA, 34235 bp, Oryza sativa
  unsure (1)..(34235): unsure at all n locations
ccccccgttctcccgcgcccaaatattttgagcacgtttcacccaccgcgacccgtttgggaggagagtttttatcggccaacatgccaattgggagcccaagggctacacaaatcccccggccagaataaaattaattgtcccccccaccacaacaatataaatatgtctggtgataaaagaaaatgcaaacgtatgtgaagatttcttaaagcataagccccgtactatttttttttgtgagcacaaagcagcagggaagcgggaaccagcccagctagctagtatttctacagttagaccgatcaggatatgaattttcatcctgaggggaaatctccccttgttgtcggcatgtcttccaaatagatgtaaaaaaaatttaaacaagatctccaccatagattagtatgaaatatatccgttgacatcaactgccaccgcagctttcactgcagccagtcgcagcaaatgctcttattgtcaaggacggcgtgggggtggactcgcagctagtcatcctgctcggcatggtggtaatccaagacntgtttggcaccgccgcgctcgcctcatctccgcgccaccgccgctacgagccgctgttgccgactagggtggaaaaaaatcttgggctcatgagctcagctcgggcttggctcgagctcgcttagctcagcttggcttgaatgccaaacgagccaagcccaagcttcattttcagctcggttctgaaacgagccgagcccgagctggctcgtgagccgcttgatttggctcgtgagccttagccatcatgtatttatatggatgattttattttctagtggagttattatttgtcaatatgtaatttatcatctatattttgatgaatttaatatataaagttattttaattttacatgttgataatttgttatcgcttttcttaatgattataaattatatagcttcaacggaaggctcgcaagccagctcgagctggcttgagccaggaaacgagccgagccaagctcatgtcttagctcgcttccctaaccgagccgagccaagccaagcctagcttgttgcaagccattacaagccgagccgagccaggcttggcttggctcgtttccacccctatcgccgatcgccggtccctacgctcgtcctcaccgtgcgcgctgcgcgagagagaaaagaaagagagagaatagagaaagagagagtaagaagtgtatgacatgcgggtcccacaattttttaattaaaaacgctgactggactgccacgtagaccaaaaccaccgtggattgggtcgaggggggtaattcgtccagtttgcatacttgggggtgtcagggttatggataccacatacctaatagtagttgactaaatctcggcaggacccaccacataccatgtcttatacggaaacaaccttcagatataggaggagttccgcataaggaaggatgaatagagttctacatggaaacgacaaggactacttggattgtatccatatttatttccctagttctacttggacaaggggacacctatgggtataaatataaggcctcctagaaggagaggggacacggaacaatagatcaagatacaagatcaacatacaagccaacatgcgccaagacaagacgccggatatcgacttcagagataagcatgactagtcccctacggtgtctacggatactgtcaggagagatatagcactgtctttgatctcgccggatgtggattcgaggaggaagggtaccctgttgtcgattacgagtcagcacttcggactgccaagtcgataacagttagataggctaccccaaatattgtactggtgtgattatggtgaataagagcaacgactggtttcgaccaactggagtaggattattacctgacaattcagggacccgaacctgtataaaaatcctcgtctccatcttttttactacaatctcgcaaatatcctagtaccaatgatccccatactatgcaaatatcagaatcgcgacatcaaacatcgacagtggcgcgcgcagttgggagattttggtgcttcagggtttcgatgaaatgggtttatgagatggattctccaacaacaagctactcgacaacttcagctatgaggagatctaacccgatcggagtatgtcgtccaacaagatcggaaccattgtcgtcaaatatttaatccggcgagatagaccaagcttgaagacattgccgtcgcggaagacgttagttcactaatgtcgaccgtgggattttggtccatgtcggctacttcggaaactaacatcgaccgccaaaaagttcgacgaattaccgccgggtatcgacgacatcagtgatcggtctgacgattagcgtgttcggagaattgacgaggtgtacgtatcctcatcggtttctgatatactccctccctccctaaatatttgacaccgttaatttttttaaacatatttgactgttcattttatttaaaacttttgtgatatgtgtaaaactatatgtatacataaaagtatatttaacaataaattaaatgatagaaaaagaattaacaattacttaaattttttaaataagacgaacggtcaaacatttttaaaaaagtcaacagcgtcaaacattttagtatggaggtagtattatattggcctacagcagaccagagtcaactacacgtcgttacccgccaatcaagcaactagccgactgcatctacacatgtattaagcatgcatgcggtgggacccatgtacagtaatgcatggtgtgtaccgaaggctattttagccataggtatgcttgtatacataggtaagccgtccacacgtgctaatcacggaggacaattcagattggctaaaaggtatttagtagattaattttttaaattaatatatactattttcgtagatatatctggcatatatctacacaggtacgcgatatttcataaaaaaattatcgtacttacttttctgatctatataatattgtcagatccatgatttattatgtttaactagagcatgttttttatataatatctattgtgcgagtgtttccgacgttaaaccaactatggtctaatgctacgggcttgctctattttcttatgataaatcatgcttgtttacggtttacataatccctgatatttaatctgcccgttatatcctgataatactagaagatccacgcagttttctgagtacatactcgatattatctactatatatcttgccttctagaaaatatttttcaggaatgactaagcactcgagtaggttgtgatcaagcacatgcattattgagaacgttctcgacaaatgcaaagttgtcacacccaacctaccaacgatgaccgacgacctatctcatagcactgaccatggctgggctgttcgagacaaggttgttaacggataatttctcgcgaacgttgtcagcttgatcacccaacatgattgcgaacggatatccggatatgctataagttggatatgtgagtcatgctggccacatgagatgcacatgtaacaaaccaactttagcgcccctatagacgatcgagaggcccctactcctggttctcgaaccagtatgacgaagcgatctctcgcgccttaacttccaacggtcgaggtacgacaacggcaatagcgtagcggtgcttgcaccacgacatcaaatggttgaggtacgactacggcaatagcgtagcggtcctcgcaccacgacttcagatggacgaggtacgactacgactggtctttgaccagcagcgtagcggtcctcgcacctcgacttcaatcggtaaggagataaggttgctcctggttctcgaagtagtaggccgtagctatctctcgtacctcgacctcaatcggtcgggagataaggctgctcctggttctcgaaccaataggccatagctatctctcgtacctcgacttcaatcggtcgagagataaggctactcctggttttcgaaccagtaggctgtagcgatctctcacacctttacttcaagtggtcgagttataactacccctggtttccaaccagaggcatagcgatcctcccactaccgttacttcaggtggtcgagttagggctacaactagttttcggccagaggtgtagcgattctcccactacctctacttcaataaagttgatatcaggtacacaatatcgccaagtgttttacccatagatcccttaccacgacgacacctagagttgaaaccaatcctacggtccctttacaccgccctagcaaggcctccaaggaacctatgggaacttcggctggggacgcccagagcggataaggccttgtcaggaaatgcatagacgaacgaccatgtaagatctggtcatgtaagagttctcaccgtgcgtattaaccaagccgtgtaatcggaaattgggtttccaacttcacggctgggggctagggtaagcgatttttcaaccaaggtaggtcaagggtccaagagccttatcctccgagaacgattctccgacgataaggctgggggctagggagagtgtatgactcaacaaactgactgatcgaagtcggtaaaagagaagacgctcatatacaaaaacattggtctgtaaatttaattcattttcagttttccatacatattataacatgtcaccttttaagcattcactcgggggctatttctatctaatattcttttctaagtattgatttcatgaaaattctattcgacattgttcttctcattctcttctctggaaaagtctatctgacctcccctcaacaactcccctcaacccagctcctcattctgttctctgcaaaaagtctatctgacctccctactcggcccatcttcttctcctctctctggccaagctggtaggcgataaagtccattccttctccctcttgccggcaggctcgccgtcccgtccccgcgccttgcctcgactccgcgcggccgcaatcgcgcaagccgcggcaaggaccctagccaaccggcgccggcttgcctgcgtcgtccgtcattacgaacaaaacgccggtgcgccgtcccattctcgccggccgtttcccgtggcgattaggtgggcacggtcgcccagcggcccgtgcggcggcggcgttgagcggcaacagccacttggagccccgcgacacccaatcctcggccgcaaaaataattctacctccatccctaaatatacgatgttggtgataaaaaaaaatcaaaggatgtgatgatttcttaagcataagcacctagtatttgttttgggagcagaaaggagcagggaagcgggaaccagcctagctagctagtatttctaacaactgaaactatcaggatatggattttcatccctgaggggatatctccccttgttgtttgcatgtcatctaaatagttgtaaaaaaaatttaaaaaaaattgacaacatagattagtatgaaatatatcagttcacaaagatgcaacaccaaatttcacttccgcaagttacaacaaaatgaacaaattaaaatgaaaatagttgtgtacattcgcatatatatttgttatttttgttgaaacttgtagaagttgaattttaacttgcatgtttgtggagtcatatatttcatattaatatatggcatatttgaattttaacttgcatgtttgccaaatttttttaaaaaaatttgatgactatatttaggtggcatgcatgaaacgaaggaatatcccctcgagggatgacatcactttcccaatctatcactctattatacactattgtattaatatagtaagcaagagcagtatacggaaaaacccacctattttcggcttctggcataatatatatagcaccctgggcaggcgttgtcggatttgctacagtacacaaacccatgaatgccttcttttggcatcaatcgctttgtcttccgtttcaaaaatcagtttgtcttctgtataaaataaattatcgtctcagtaggctaagttcctatcaagaacaaattatatatctaaccgaaaattatggaagggaaactgcatatctagcacgaaaaattggaacatctttttattccggccttccgagaggccgcattattatcagcagcatgaacacctacaagcaaaactcgctcgctgcaagaactcaaggaggtgaactcatcctcctggttctcaacaactacagattgctcactgctacctacccctacaacaatgctacccacagcttggccggaaatctgatcggcggctgccgctacatcgaattcttccgccgctacgacatcgggtgatgcaccgagaacatcgatccatccttgatcggagtcccagtccggcaccgatgacggcgagcacgccattgctctcacccacttggctggacactctgaagatacgttatctgctgctgttgctgtttctaatttatttgctatgctaatggagacgctgctgaggacatcgatccagccttggttgccggagtcccagtccggcaccgacgacggcgagcacgccattgatgtcaccctctgctctattgctgctgttttgtttgctacattaatggagacgctgccgaggacttcgatccagctgcagccatggtcgtcggagtcccagtccggcaatgtctggcaggagcatgccattgctctgatccggccggtagggctgttcgacgacatgtcgtcgacttcctcgccgtcggtcgacgacgactcggactcccataatgtcgcgtcgagcgcgctcgtcggcgacacccatgtcgccttgacggtttccttgttgttgagaccgcatgacttggagatgaacgggtgctgtagcagctgcgcccccgtgggacggtcgccggcgcgccgttgcaggcatccgcgcaagaagtccttcgcctccggtgacagccaccgtggcaggtccggcacggcgtccgtgtacccgatcttgtggagcgcggggaggacgttgtccatgtcgctccacggggcgcggccggtggccatctcgatgacggtgcagcccagcgcccagacgtcggcggccagcccttgctcctcgccacgcgccacctcgggcgccatgaacgccggcgtgccgccgagcaccggctgcttcgaaccaccgggcattgccaccctcgcgcacccgaagtcggtgagcttggcgcggccatcggcgccgacgagcacattactccccttgacgtcgccgtgcacgacgagcttcccgtggaggtagtcgagccctctaagcacgtcggccgcgtacgtcctgacggcgccctcgtcgaggcgacccccgtttctcgccaccacgtcggcgagcgatccgccgggcgcgtactccaggaacagctggtgctcgccgccgccgcagccgccggaggcctggacaaagccaaggcacttgagcacgtgcggcgaggacagcccggacatgacgctccactctcgccggagctgctgcctcgcggcgccctcgccggccgacttgatgacgaagagctccccggagacgtcgttcgctgccagcgacaccacggcgccggaagcgccccggccaacgctgcggaggcgcgtccatccgccgccgccgatgatcgccgcggccattggggaatcggaggcgagagctgggttgagttgttggtgtttccggattagggttgcgaatgctgctgctcgagtcgatcgaggagagtatttatttaatgcgtgaggctggcatgtgggacccgtagcgccgcgcattgcagtgtgaactgtgaaatgcactagagaagcgagggggccgacaagattattgctatagctggaaatttaccagtgtgctctgttaaggaaaggtgtgtttattatcctcttttttatttttaatccatgtggattaagaaggaaacgagaggtaaaaacaaaaggatagacgtgtttagtgtatttctttctatttttttccctgtgtaaaccatggggtggaaaacgtggagtgagaaatagtacgcttgtgagcaaattttgcgtttttgcatgatccattgtaaaaaaatgaaatgttaaaataaattattaagaactactctctctctcgtcgttatatatggaaattttgtgggtccaagactagtcaatgtggtcatcgagctaagaaattaagatctatggtgcaaaatgtgcctcatatctttagaagtgattaaatggttgattaatcatcatccagtaaagtccctgaaacatgcaataagggacggttaaaggtatgtttgtgctactttatattccattcactactacagaaccaagataaccggtcaaagtgatccgtctcagataacatgagctctaacatgtaaaaaaaaaataccattcgagatatgacaaaagggaactacctgtatatgatgtcatctatgatgagtcaaaattataaaccgtcaaagatcatatatgatgaccccacatatatggcaggtccaatcatatggcccaccagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctctttctaacatatatactctaactcccaaggactcgagccagttgttgcctccttgatccgtcctcgaactccagccatcatcgcctctggccccgaaaacgagccgccaccaccatcttcaccccctaaccccaagcaccggccaccaccttagagatgccagatccaacctccctgatatcggaggacactgaatatgctctccttaacatcatataggtggctagatccaatgcaagccaccatcccctaagccccgagtgctagtgagcctctggacatggtagtgagatgtgcccgcttgtatctcggtggcctagtagtatgacgggcacaaagatgggcttcggaggtgtgtagctatatgggcatggcatccggatctggccacccccatcttggtgaccttggtggcgcagtaccgctggggtctggcaacgatgacaaggaccatgatgacgagcacaacaacaacaatgggcttcggagggggcatgcgatatatagtgacaccttcgaatgggcatagggcataaatgaccaacatgtataggcatcgactggcttgtcgagatcgtcaagaagtacaagatcatctccaaaacgctcagcctggcctcaaccaccaattcctatatcccttccttctcctgaaccgttgggccagagccaaacaaaaccccttccccctccccttcctcctcctcctcccactctcacgccccttcctcacctcgcctgagctgacaaacaatagtagcagcttccctacaaacaaagatggggtatatacgcacacgccaacgtactactcaggcctatagaacaatatcacgcccttttgcaagtctattttgctcatcataggcttcagggtcagccgctgtatcacccccaactatagatggtcatgtgggccacccggcacggcacggcccaagcccggccgtgcctgggccgaggcttgtcgggccggcacggcccgaccgatgcaccaggctgtactgtgccagctcacgggcggcatacacggcccaggcacggcccaatactactcgagccgtgccaggccggcccgaaggcacgatgggctatcgtgcttcctcacagaaaatgtctaattttggtccctcaactctgtgtactgtgtttaaatggctggagaataagtctattttgtatactcctcacataaaagtctatgtttggtccctcaactctatgggctgtgtttaaatggctggaaaataaatctattttgtatacctcttgtcttgggccttgccttatacgattatttaagtctatttttcatctctatattttttatttgaccgggccatgctgtgccggcccaacgtgctgaaggtgtggcccaagcatggcccggctgtcgggtcgggccgacatgggcacgacctcagtcgggccgtgccatgctttgggccgggccacgggccacgggccatatggccatctatacccccgaccaggctgagggaccatgcggcgcgctcaagtgcagcaggactcgttctaactcatccttcacctctccacgctggactgcgactctgcgaggcactgttccggcctccgacatcaacaccttccatgccaataaagctcactacccttgctctgtcaaaaaaatataccaagctagtacttgattagacgtcacgtagttctatgatgactatgaacaggggatctgctctgcctagattaatagtcctaggaggcttctaatcgagtaacaagtcaatatttcggagcgaaggggactacattcgaattatcgatctgtatgaagattagggagagaaaaaggttatgagcacatcgactggggatcgagggacgaggatcatgagaacattcttttattccggcctttcgagaggccgcattattatcagcagcatgaacagctacaagcaaaattctctcgctgcaataactcaaggagatgaactcatcctcctggttctcaacaactacagattgttcactacctactcctacaacaatgctacccacagcttcgccgaaaatctgatcggcggctgccactacatcgaattcttcaggcgcattcccttcaccgccattgtcgtcggccggtgacgcgctgaggacatcgatccaaccatggttgtcggagtcccagtccggcaccgacgacggcgagcacgccattgctctcaccctcttggccggagactctgaagcttcgtaatcttctgctgctgctgtttttttttttgctatgttaatggagacggtgccgagtacttcgatccagccatggtcgtcggagtcccagtccggcaatgtctggccgccggaggatgccattgctatgatccggccggtggggctgttcgacatgtcgtcagcttcctcatcgtctgtcgatgacgacgtctcggactcccacaacgccgccgctgcgtcgagcgcgctcgtcggagacacccatgtcgccttcacgacttctttcttgagaccgcatgactttgagacgaacgggtgctgtagcagctgcgccgccgtgggccggtcgccggcgcgccgttgcatgcaccggcgcaagaagtccttcgcctccggtgacagccatggcggcaggtccggcacggcgtccgtgtacccgatcatccggagagcggcgagcacgtcgtccatgtcgctccacggggcgcggccggtggccatctcgatgacggtgcagcccagcgcccacacgtcggcagccgggccttgctcctcgccgcgcgccacctcgggcgccatgaacgccggcgtgccgccgagcaccggctgcttcgaaccaccgggcatcaccaccctcgcgcacccgaagtcggcgagcttggcgcggccatcggcgccgacgagcacattactccccttgacgtcgccgtgcacgacgagcttctcgtggaggtaatcaagccccctgagcacgtccgccgcgtacgccctgaaggcgctctcgtcgaggcgatccccgtttctcgccaccacgtcggcgagcgatccgccgggcgcgtactcgaggagcagctggtgctcgccgccggcgccggcggcggcctggacaaagccaaggcacctgagcacgtgcggcgaggagagcccggacatgacgctccactctcgccggagctgctgcctcgccgtggcggcgaccgcatcaccggccgacttcacgacgaagagctcgccggaggcgtcgtccgccgcgagagacactgtggcgccggacgcgccgtgcccgatgctgcggaggcgcgtccatccgccgccgccgacgccgatgatcgccgcggccattggggaattaattggaggcgaattgggttgagttcttgatgtttccggattagggttgtgaatttgttgcggatgctgctgctcgtgccgaggagggtatttattgcgtgaggctggcatgtggggcccacccttgcatgcagtccgaaacgcacaggggaatcgagagtggcgtgtggtaatctgactgacatgtggggccgatagggtcaattgctagctggaaatttacctgtgtgtggaactctgtaagtaaggaaaggcgtgcttgttaacctctttttatttttataatccgtgtggattaagaaggaaacgaggattaaaagtaaaaatgaccggcgtgtttagtgtatatctttctattttatcctgtgtgaacaactgagaggaaaatgcggagtgaaaaaaatagtacgtttgtgtgaaaattaaacgaggagcacaagttttgtgttttgtgttgatttagcatgatccattgttaaaattttggatatttctagctcagtgcagctacgaaagagctgcaaaatgcacctcacaattttagtagcgatcaaatggctaattaatcatcatctagtaaagttaccgaacaatgagggacagttacagtcttacagatatttgtccatgtacattgtatagcgtcaactataccgacaagttagatgcaaacactagctactgcactactacgaaaactatttttctgtacaaagatccatttagattgcatacggaacataactggtcgtagtggcggagccaggataaaattatagtggggactcctcagccttttgggccttctaacaatctcagacaaagtctattttaacacccttgcgatagatatatggatttaaattttagggggtcttaatgggggctctaatgattcattagagggtagggggggggtntaaagaccccccagccctcacgctgcctccgccactgactggtcgcgtctacgaaaatcatcctccatttttgtgtgcggttccttaagaaaaccgtacgcaaaaatcaattttcacaggcgggcatcttaacagtcctgcacggaaaaatactcaattttcacagacgggcctaataatcgacctgcacaaaaaaatgagatatttaaccatttgtcacatttagatggggcaattaactttttcccactagacccacatgtcatagacacatgtggacccacgtgtcattgagataggggtggcaaatagttatttgccaaatctaaaagtggcaaatagttaaaaatcccccgaaaaaatacccattccctctcaacctattcaaaaaattcgagtttcccttctctctccctcttatcttctctctctaccccttatcttcacctcactttcctctcctcctcttaatgttctcctcacttcagctgagctagaaccgcgtggccgcgtcgagctcgagccccgcgggccacgccgccggcaccggcgccggcctcttcgcctcctcctccggctccgacggcggtgggcgcgggagtggcgggctcagcgacgtgtgcacggcggtgggcaaccgggagcggcgggctcgcggcagtgtgcacgcgatggcgaacgaccaccccctcccccatccaaatccggcggaggcgactgctcccccccgaatctggcagcgatggccgtccctcgcccggatccagtggcggtggtggcgggcaggcgggttcggacggtggggaggcggcggatccggctaccgcgacggcgacggcgatgacggagtccgtgaggagggcggcggcggcggctgcttttgggttagggttttgcttttttggattttatttttttttagttttttatttttgcgtgtgggcgacataaccaccccgcacacgaaaaatcagattttcgtgtgcgggtgcgccatccgtatataaaaatagcgatttttgtaaatactttgttacatacggttggaagatccacacgtgaaaattgctttcgaccgtacggaataatcgttattgcaccagtgacaagagcacatctgtgctggtttgacaaaacctagcaccgataagggttttcccaccatgaacctcgagctcgtctatgcagagaatatacccggcactgatgagaccacctcttgttgaccggattatgtcattaaatggatatacagactattacatacataagttaaatattttgataaatagagtcaacaaatatcttaaaacaagtgatcaagaagtacaatggaagatatattttttaaaagaagaacatattaaaaacatgcagcaagtcatcatgataataacgtgatgaagcgactgaaatgaagactagtttagctggtgtaaacagtgtgctgcatgtggagagaatatatggcgccttttcgagggagcttcttgctgcggtagcttctcccagaatcagaagttttctcaaacagttcagtttttatccagaatctaaaaattatagaatctaaaagatgaactttaagccaaaagatgaaaaacccagtattttcagtttgtcagaagctgactaccaacagctgtttcgtagaatcttaaacttctccaaacagacccaaacaggcccatgatctgtaactgaaaatgaacggttattaggctaaactggtgctcttggctcacttgatctgacttaattaatcgctcttcctttttctatcattgccacgtggatttggaatagacacacgggcccagacctcctgatctctgggctgataaagaaataaagaaaaaagttagaatactgctaattgcaggcccactaatcaggtcttttcgacaaattcctttgacctgatggcgttcatagtatcacatttttaatctgtatgacttattatctctgtcccaaaatattactatttctaactataataatttattctaaaatgaagttatttattcacctgctatcttctctcaactaataaacaattctctttacctatttttcttttgactatcaatcataattctcctccaattatttgtacctactttcttaatttcttaatgtctgtatatctacataaaaaatgtgtatgtttccttgcgtgtaacggtcctctcacgtgagaaacagaaaaaaaaaagagaagttcgttaagaaaaattatgtgctcctttttacatcaacaatcaattcatttctaataatatagatacatcgtaatgtacgggtatatttcttgacgaccaattcacattggctggtttttaattcccatgtctctattactccctccgttttacaatgtaagtcattcaagtattttccacattcatattgatattaatgaatctaaacatatactcccttcattccaaatcgatctacatatttcataggtataccaagaccaagaaaaactaataactctctcatactatatttattctagcaacaaactcaatgcatgcaccatccccactatttcctagccaataacaaatgaagatattgtatgtgggttataaatacatgtgtgcatggatgcatgcatcaatgtttatttactccaatgcacaaataacgaatagacctaataaatgaacacaacaatgtagatcatttagaaataaacttaaaaaaaactatatgtagatcaatttggaatggagggagtatatctatatagattcattaacattattatgaatgtggaaaatgccagaatgacttatagtgtgaaacggaggaagtattttcttaatggaataaaaccatatatctagtgtaggttaaagacaacctggacagtgtcagacttaattaaacacaagttgcagatagattagtggcagtgaccatactgtttcttgtttcatttttttttaaaaagttgcttctactcgaattaaccacgaatttcacacgaaactgcaaccttgcaaaatatataatccttcccagcaaggacgcattcattttgtcgccatggccaagcccaagacctctcctctccaccgtgtcatcggcgccgcccgctgggacgccgagcgccccctcggccgcctcctcatcctcgcccacgccgccttcctcgacgccggcttcgtgcccgccgccgccgccgccgacgacaactccatccggcttccgaggaaggtgggcaggacggcctcctcgctcccgctccggtacgccgcgccgcagctgctgcactggccggacgacgccgccgccgtccagctgaggctgtgcgcgcacgggcgccacctcgtcttgtacgtgtccatggctagatgctccatgttcagggagtggttggacacgtactgggtgtgcctcgacgcgctcgccgccgcggcgctcctcggcggcgcgctggacgacacggcgcgcgcgctgcggcgcgacgcgcgcctggccgcgctctggggcgcgctcgccgacaggctgtgccggcgcgtcctcgtcgacgtgtgcgccaggaacggcgtgacgctggagcccaccttcatgtcgctccccgacgacgtcaaggcggccatcctggcgaggctccccgacggcgacgacctcgcgagggccgagtgcacctgcgccgggctccggcgcctcgtcgcggaccgcgaccgcgacgccgcgctctggaagccgaggtacgagaagctgcctttcctgctgcagctcatcggaggcggcgacgacgacgacggcgagccgacgacggaggtgagctggaagaagaagtatgtggcggcgaggctgtggcctttcggagagctctttgcgtccatgagagagacacggaggctaccgatttatgcaccattgttggacttggacttcgattcattcacacgcttttgggtgttcgatgataagccgtcgccgttgccggaggagatcactgtccctcgtcatcgtcgccgccgtcggaggtggagagcgatgccaagggacgccggccatggccttgcggcgcggggacatggcggcgacaagaagccgcggcatggcgccggcgcggttcactcgccgtcttcccggttccgatggaagcaccggtgatcgccggcgatcgacgtgctttggtttcgctgttgcagagcctttttggcttagttgtttatggatttcttttcgtttgctttgtaaatgtgctgagaatgagatcatcgtctgaaactgaaaatggttaagcctaatcacaaatgtgaatgccttgttgctactttggatctttgatccactggtgttagaacttagaactctcctgaccaagtattaagtatgaggttagtaattaaattagagaccttatccttatttccttagtaatctttttcaatagtgggtatctggtctttgcttcaattgaaactacacgcataataatttacagcttataaaactgctaatatgaaaaagcaaagaaccacacacactccacccaccgtgtacaatgacttctagattcatgtagctagtgatttctttgtagcagtaaactatgctaagtggaatccaattaagatttttcttctgttacaaatgctgacacttacgaatgctcatttaacacacagtcaaagggaaaaaattcagcaacaaatctctagactcattaaaaaatccacggaaagcttacccagtactatgtatttatgggcacaatgatttaaagtctatgagtgaaattatatactcacgactctttattttaaaccaagcacccacgacgtactccataatcacactagctaactatacattttcaattttatattttcaccatatcgaaacaaaagtataaactcaattaatggtaaaactagcttctttcgatgttagcatagatttacagtttctggatcaaacaaaaccaatggctctaactaaaaaggtatattcaccacaaaagttgcttaatatatgttcttgacaaaatgaatgttagattactgtttcttcttcctagctaaccggtggtgttccttgtcatgctgactatggctgagaacattggccatatatcatatcaaaggcataaaacagtcagatatgtccaaccatgcatggaaaggcttatatcggcaaacgatatgattatgctgcaaggcgcaatatggttcctttttaaaaagaacaatctggttttgttgttaatttctctacttttgttttgtttatggaaatttctctacgtttttttttacgaaatatttactccagctggagaaacaattttagaggatataactacaccctagaaaatgtccaatagaattatttacctcatattttggagcgaatcagggcatgtacaacatatgaacatgcccacaaattaaacctcagatatgaggtaataaataattctactggaaccatattattatgaggtaaataattctactggaacatattcttctccacagagtaaaatctattggaaccatattctactccacggagtaaatgttccaggtatgaggtaaataattatactgtaacgattgaacatgcaactaattcgtggagaaatgtcaccaactaataaatcaaaccccaggttttttttatgcaacatcacattcttacacttttttgttattaaaacaaacttgacagggtgcaggcaagcatgtataggcataaataaatacacccaaggcccatttttgcacttctctcctaggatgattaaataattagtaaaagcacagttttgtcagaaaagaaccttgtcacgaaattcagacgtaactccactatggctgtatttagatccaaactttcaactttttccaccacattaacatgtcatacacacacaacttttcagtcacatcgtaccaattacaatccaaactttcaattttggaaggaaataaaaaaagcctatacaactgcatccattccctgcaaacgtcgacactcgacacattgatgatcacttagtcgccatggccgacacctctccactccaccggatcatcggcgccgccatgtgggacgccgagcccctgctcggccgcctcgtaatcctcgcccacgccgccttcctcgacgcgggtttcgtgtccaccggcgccgccaatgacgacggcgcccaaagctccgtccgacttccgaggcaggtgggcgcgacggcctccgcgctctcgctccggtacaccgcgccgcagctgctgcaccggcaccggcaagacgccgccgcggcggcggcggcgacggttgcgctgagggtgtgcgcgcacgggcggcgccacgtcgtgttctacgtgtgcgtcaggttcgccaacccgtggctggacacgtactggatctgcctcgacgcgcccgccgccgcggcgctcctcgccggcgggctggacgacacggcgcgcgcgctggcgaggcgcgagcgcggcgcgcgcctcgccgcgctctggagcgcgctcgccgacaggctgtgccggcgcgtcctcgtcgacctgtgcgccaagaacggcgtgccggtggagcccgagcacgagctcatgtcgctccccgacgacgtcaaggtcgccatcctcgccaggctcgccgccggcgaggacctcgcgagggtggagtgcacgtgcgtcgggcttaacctcctcgtcgcggagcacgactccacgctctggaagcccatgtacacgaagctgcgttcccagctgcggcggcggctgcggtttctcggagtcagctatggcgagccgacggcggtgagctggaaggctaggtacgtggcggtgaggcggcggcgtgttccggcggcgcatgacgtgttcatgggagaaatactactgccggtgatgacagagtggatgagagttccatggatacgtaggtatccatttgtgccgcctccgccgccggagtcgccggaggaggaggagacggtcgtacctcgtcggaggaggaggcggagagcaatgccaagggacgccggccatggccgtgcggcgccgggacatggcggcgacaagaagcagtggcgtggcgccggcgcggttcattcgccgtcttccgggttccgatggaaacaccggtgaccgcccgccggcgatgaactttgcttaatttcgccgttacagattttacttagtttatttattttctgtggatgtttttctttgtttgctatggacattttctgagtgtttttgagattatcatctgaaactaaaaatggttagtactaaccacaaatatgtacgaacaatcgagaagtagatatgaggttaaatacttaataattaattagaaatttaatcgtgaaaaattagagatctaataaactgaacatgtctttaaccaaccagaaggcccgtgaaagaacataggagtattgtttaagctagtgccgataagacttctctaatttatcaaatttgtagaaagacatcgcaacattctaaagcatactatcaaaaatatattcaatatattcaatgtttatatttaatgaaactaatttaatttaatgttatacgagttactatatttctccataaacttgcttatataagtttatcttagaaaaaatcaaaacgatttatgaagtatgtattataagtagattaaaaatcaatgtttaaaataatagactatgataaaacggttttaaaattaatattttggctatggccgataaggcagtgagctgtgagcagatgatcatgttggtctttttcttctctttttcgatgacttcaaccagatgtgtctaaccatgcatcgaaaagcttacgacgataaattcaagatgatgcagctcgcaatctgattcgatccattactatttttttcaaaaaaaatatttgacgaaacaacctaagcaatttgttcttacatggcattctccagattgctttgacattatggctgtcatattaaatctccataccggtcgaaacttagtggtcacacgtcaatcgactatatcttcctctgtctagttcgtgatgcctatctaatactacctatgttttttaatacttcaccgtcccaaaatataaatatttttaaccctgacacggtcatcgagatgctattttgaccaacaatatttataaaagtaagatgttttaaataaaaagagttgcatactatgatagtttgtttaataataaatctagtaaacttcaattttacatgattgattttttttattttttctgctattaatggtcaacgtaaacaatgtttgacttgtcattatgctaaaaatgcttatatttaagacggagggagtatatgatggcattgattttttaacaaacatttatcactcgtcttattcaaaatttttatgtaaatataaaaatatttaagtcatatttaaagaacatttgatgataaatcaagtcatgataaaataaataatcattaaatatttttttaataaaataaatggttaaacgtatttttaaaaattaccgatgtcatatattaaaaagctgagggaataccttttttgggaaatcgatcgatggcgtgttgttctagagtgccgaggttttttagttattattgttgttggaggtacaccacgaggtcgttcggccggatctgccgaaaccaacaacttaggcgacgggtttggactggaggcaagcggcgaaggttgaaaagggaaccgtatgggcgaaagccgtggcttggaaatacgcgggctttgtcaggcaaggaccttgtcggcgggccgcatggccgaaggcgataaggcgaaggctttggcacagaggcacgggcttcgccaagtactgaactctgccaagatgaggcccagcgggctgttacgctctcagggggtttcgtcaaatacataggccgagcccttttggcccagtagaggcccatgcatgcaaaggacaatgtgtacccctgataatgtctctatcataagggtagccatgtaaattcccctgtaaaacctaaaccccaaaggaggaacttgtaatagagctataaatagccccctaaagctatgtaataggggcaaccaaaaagtttttactaagcaatacaattatctttcttttccaatcactgttgagagaatcacgcctttcgacgtgacacggttgtctattcgacaacaattgttaactatgtgatccaaggtcatatattatactgacaatgacagacttaattaaacatatattacgtgtgggatggattagaggaaccgaccattgcttttatttaattagttaaccatcttcgttggagacaagagattcacatttcaccctcacaatatgctgttgtcttttccttttagtaaaccacgcgattgttatatacttgacttcatctaaaatggaggaattttagagttcgaaatttgttgctggttttcgcctatttataggcgtattaggagcatatgcgcagagatgtgaatgttgtgttccgtgtgttctgtgtagtgatgtgtgtgcgtgtgtacttgtgtctgccatataatggaaaaaatagaggaattttaaaagattgaactacataatataaaaaaaaaatcccgcataatgtttttgagcattaattgatcacaaattaattatctcaggtattagattcattgcaacaactcaggatagccctcagcacctcaccgtctcaccctcgtccccaatgtttgccatcttaaaaaaaataaataaataaaagtggactagaggcaaaccgtgtcatgcataaataaattcatctcgaatttgttttttaagaaaaggccaaagacccgcttttatagaaagccatgaccgcatgagctgggaacaccggcttgctatgtaagttcggtacatatgacatccacacaccgcaggccacattccagacagtacaaccgaaagagttacaagacagaagcgaaaccggaccagcaactctaagaactccaacaaaaggaccttacagactaagaacatgaggccagaccacgtaagatcaaatcacaagaactaaaccaaccagagggggtgaatggttggtataccaaaaaccgaaaacttttagcggaaataaaagttactctcaaattcgacggatcgcggtctgaccgaaggtattgcgccagtttgaccgcctgatgaacgtcggtctgaccgatgtagatcgatcggtcgaaccgccgaagtcgcctgccgccgccggtctgaccgccgcgatgctgccggtctgaccgccggtgtgtcgccggttagaccgtcgaaacccggtgaaacacaaatcgaagaacttttaaagtagatgataattttattgattctctctgtgtttacaaagtgcatcaatagcagtccttacaaaaatttcgactaaactcgaaaccctaactcaaaactcaactcaattgctctcaaaagcaataccggaaagcctcacgctccccctctatttatacccgaggtaggcagcctaaagccacgaaccaaactcatactagaagtcctaaacaccttaggaaaccctttagtacaagaaacaaactttacataaccaatcataccaaatttggactccttccaaattcgactccgcatcccatacgcacacaatacctccatcgtatgccatatggaatcttcacaaaccatgtgcatcaactctagcctaagtatcccgcatgatctctgaccacctcggatgtcgtcttatccctaagccgactcccggtccatcatcgcaaatactctcccgaggcatcgagtcacctacacataaaataaacaaagaaaccatattccgagaccaagctatctccaacttgactcattagtagcaaacaacagtattacatatgtatagtatccatccagaagccataatcatgaaacaatcacggatatccaaacaaacaacccgaaactaaaactgacacaacgtcggccggtcagaccgcgggctgcgccggtctgaccacgcatatacctccggtctgaccggcataccctacccggtttgaccggtcccgacaaacagcagtccctgtcaatcacctgtaaattccaatcatctataaaaccacttcgcaaataaattccaaataacaaaaccaataatctccgatgccaattgttcatcacagaataataatcaaaaacacctttaattttacaatctccctcttgatgaacacattggcaaacccatcaaaatgttttggtgtttggaaaaataaaaacaaaagtggtaaaaagcacacttcgtacaaatgttacacatcgtgctcaaaaattcaaaagaaaacttctctctcttttgaaaaaaaagaaatttcccaatcgacaagctcttctcaaatcatttgtttctccaaaaatttcacattacttctcccccttttgacaatgatttcatcaagcatagaaattatgttcattaatgtataagagcttatcatacatatagcatatcatatcatgtgttgcaataaaaagaagatgaacccatctataatatagcaaacatgcattaaagtataaacatgaaccaaagattttacaattaagcttgaatcaacaatcaaaattcatgatttcatacgatttataatacaacatctttacaagcacataggttgaagaataaacactaaacgcatatacctaatgcatttatcattctttctcaaataacctttggcacaaaacaaccaagagaatttttttttaactttttcttttcttgagcctttttgctcatatttttctcttttattccaggtacgtccctgtcgtcaagactatttccagggattcgacacccattattttgctcacatcgaatacgtcagtgtcgtcaagactgtttccaaggattcggtattctttttttatatttttattctctttttcacaatgagcaattaaagctatttgaggaataacaattcaataaagcatatatgtagagcatttataaaacaaaccatatgctcgcatcaacattgcacatttgctttattcaagtatagaatttaagtgtcatgcatcatctcccttaaaaacaaaatctaaatatcatgaaaagactagaatacatataagctatgctagagacaaataaaccttcaaggtattgctagaatgcacaagaaaatactatatgtatagaacaaagctctcttttctcaatttttctcattgtcatatttttgcttgataaaaccatgaggtacaaactccccctcaaaccatgccaaaaggatgaattattcccaattcaccacgaagaaaagcaaaatgattagaatccaaaggtttgttgaaaatatcagcaagttgcaacattttgtccaaaaactgcaattcgacatctcccttctcaacatgatccctcaaaaagtgaaaacaaatattaatgtgctttgtgcgtgagtgttgaacaggattcttagcaatgttaatagcactagtattatcacaaaagagaggtactttctcaaaagtaagactataatatttcaaagtagataaaagccaaagaatctgtgaacaacagctagcagcagcaacatattcagattcagaagttgattgagcaacactagattgtttcctagaagaccatgcaatcaatgatgtaccaagaaaatgacatattccactagtacttttcctatcaattctacaacccccaaaatcagtatcggaatatccacttaagcatatagaagatgaagtagaataccaaattccaaactcaagtgtatgattcaaatacctcattattcgcttgatcgcttgacgatgtgaagcacgaggagaagctggaaagcgtgtatacaaacacatagcaagttgtatgtctagcctagaagcaattagatacaacaaagatccaatcatacttctatactccttttgatcaacagcttcaccatcttcatcaggatccaacacagctgtaaaaccaattggtgttgaaattggcttgcaattttccatcttgaaccgtctcaaaagatccttcgtatacttcatttgatgcacaaaagtaccttgaggtgtttgcttaatttgcaatcccaaaaagtacgataactcacccatcatgctcatctcaaattccctgcgcatagtctcagcaaactccacaaccaaggcgtgagttgaacaaccaaaaatgatatcatccacataaatctgaacaaaaagttgattatcaccatgcttaagaacaaaaagcgttttgtcaacctttcccattgaaaaacctttcgcaagcaaaaagttcttaaacctatcataccatgccctaggagcttgtttcaaaccatacaaagctttagacaatttaaaaacatggttaggaaactcaggattttcaaaacctggtggttgtttgacataaacttcctcctgtataaaaccattaagaaaatcacttttcacatccatttgatacaatttaaaaccttttgaaatagcaaaagccaacaaaagtctaattgcctcaactctagcaacatgagcaaaagtttcatcaaaatccaaaccctccacttgggtaaaaccttgagcaacaagtctagttttatttctcacaatcaaaccatcctcattttgtttatttttgaaaacccacttggttccaaaaatattatgttcagaaggtggttcaacaaaagtccaaactttgtttctctcaaaattttcaagttcttcatgcatggcattaatccacgattaatcagttaatgcatgtgacacatctttgggttcaaaagaagcaacaaatgcataatttgcacaaacatcatgagtcgttaccttagaccttgtagtccgctcacctatattaccaatgatttattccgacagatgtcgtcgttgaatgtgcaaaggagtagcgacttctgaagttgatccacgttctgtatcagtactggtcaaagttatagtctccggaggtccatctcgatcagcatcaacagtaccggaacccgacgagcctggccggtctaactgctcttcttgaggcggtctgaccggcggcgtgccggtggtctaaccggccgagccgacctcgtcgttgttgtcgtcttcactctcgtcttcaaaaatacgaccatcctccccctgaacctgtgacaatgtacctgcaatatcgggtctagtacctggactagcctcatcaaaagaaacttcgcaagtctcaatgattttgttagtctccaaaataagtacacgatagccacgactatgtgcggggtaaccaagaaacaatccatcggtagaacgtgcctcaaacttatccaaatttccagatttcaagacaaagcacttgcaactcaaaacacgcaaatgtgaaactttaggttgacgtccaaatcgaagttcataagaagtttttccaagttttgatctcaagaaaactcgatttgaaatataacacgcagtattaatcgcctcagcccaaaattttttaggagttttatattcatccaacatcattctagccatctcaaccaaaacacgatatttcctttcaacaacaccgttttgttgcggtacacgaggagaagaaaattcatgttcaagaccttttttgttgcaaaattgttcaaaagaagcatttttaaacttaccaccattatcacttcgaattcttttcaaagaaccaggaaattcaagatccaatcgaagaaacaaaccacgaaagtgttgaaaagcttcgtccttagttgccataaagaaaagccaagaatatcaagaaaaatcgtcaacaataaccaacacataccactttcctccaacagattgcactctagctggaccaacagtgtccatatgtaatagctgtcccggtgcatccgtcatcacagaaacaataggagcatgtgaacaagcaaccatcttagcatgacgacacggtgtgcaaaccaaatcaatatttttcttaagtttaggcaaaccacgaacaagatccaaaccacttaacctagtgagatgatcaaaaccaacatgtccaagtctacgatgccaaaacatcacatctttatcaaacttagcagccaaacatgttatcacaggtgaaacaggattttcaaaatcagctttaaacactcttccatagcgagaaataatcaacacagaatcaccacaagaatcaaaaactttacttccagttttcttacagtgaacctcaaaattttcatcaaaaatttgtgaaactgaaagcaaattgtactttaagtcctcaactaaagcttcatcttcaattcaaatttttcatataccttaaccaaacctgtagcgagaacgacacttgtagaagcatcaccaaagataatcgattcagtcttggatgcctttttgagggaggagaaccaatttttatcaccggtcatgtgccgcgaataaccggaatccacgatccacacgttctccttccttgccaccaaagcctacacacaagcataagtcgaagcctcagtactggggttagatgataataaaaatttaggaatccagtactgagacacacgaccagaagatccaataggcatatatccacgtgtaaaaatagtttgagaattttcagaaaaattcctctgaggccggtctgaccgaggtgttactgccggtctgaccgggggccggtctgatcgccgctgcaccgccggtctgaccggtgttcggtctgaccgaggcactgcagccggtctgaccggtcgccggtccgaccatgggacccactgcggtctaaccggttccctcgaggaaaaatcagatttttgccactttgattttgcaaaagcaatctctctctcgtttttctgtttatgagttaatctgaaacaaaaaccaacaatatgtccatctttaccataaaaagaacaagtatatttttcacgatgattagacacattggtagaattagaagacttagcaacacaaccaacaacaggagatttgtgcactcaattgttccacaaagttgaatatataaacgtacgaacaaggcagatgaagaggaagatataaggcccatttggtagccagcttctgagaatatggaaaagctaggtttcccagcttctggcttctagtttattttttggattctacaactacagcttctcagaatttggaccaaaagctggactgtttagagaagcttctgattctgaaagaagctgcagcagatagatgctcccccagtcgattgacgtgtgatcaccaattcaccatgttaccactgttagggaatccacaatgtggtgtaaaagtagtccataagcaatagaatattccattcagctacctattactattgtgcaactagtccatatagaaaaaatagcaaaagatacccatatgcatatggactacccatatggaataaattatattatctatctctactcctctcttctcctaatgataccttgtaggacattgccatagggataaactatttatgtgggtcccatctatatggatcactttgccatatacatcggtgatgcccttatacatattgagatttaattaatatggaaactgtaaggtcaaagcaagttggagaacgccagctggtaagagcaaaattgtttatgcgcgccctttcgtctaataattcaggaaaaacagtatggaatcagattgcgtgttgcatcatcttcaatttttcgttataagattttccatgcatgtggttagaaatatctggctgaagttataaaaaaagaaaatctaaagtgtaaaaaaagaaaatctaattagcatagtttaattactagagtctgtcaccatcctactgaattatattataaacgattactcatactctcaacgtctgtccattaacttatcaaccataggcaaaatataaattttaaaatttaactttagagtttattttaaagttgttttatcgtagtccattttcaagcattgacttttaaaccgctaataacacatatataaaagtttgtaggaattgtattcaaggtaaaaaaaaatttggtaggtgtgtgcattttaatgcaagaacttgaaaactgagcaaattggtacacctacttggttagatagtgtgcttttggtcaaagtgaatgccacatggatgttttttccaggttagcaagaaacgttatttttgttacatgtttctgctgcatccttggaacaatagatagactgaaggcccatttcagcaaatatatatcaaatcagaagcactacaagtctagatttagaattgatacaggacaccgtgatttattgatcaatttatgaaccaattcactgtaaaaaggcaaataggtgtcgccactataggtgccggcacagctaaaaacgacacctataatgcctttcctgcccatgcacccacccccacgcgccaaatattcaaaaccggcacctttatgtcgaaataggtgccggtttttaaataaaactgatacctaaaacctgtgtcagagaaagctgacggttttaaacccaccggcaccttttaatcttccccctcccacactagctgttggtgggccccacacgtaggttcggttttaagactagggtgttggttctcgtcataaagccgacacctttattccaatagtgcttttcatgcccgatggtaggccctacaaaaaggtgccctttttttgtatgacaagataaaggtgccggtttttggtctagaaccggcacctttgttccaatagtgcttttcatgcctggtggtgggcccaacaaaaaggtgccggttttttgtacgacaagacaaaggtgtcggtttttgtctagaaccggcacctttgttccaatagtgcttttcatgcccgatggtgggccctacacatatgtgctggtttttttgtatgacaagacaaaggtgccgatttttggtctagaactgacacctatgttccaaagtgcttgtagtagccattggtgagccctacacataggtgccggttgggaagacaaaggtgttggttttgggtctagaaccggcacctttgttctgacaatagtacatatatatatataatccatcccttgccactcgaactgattgagcaagaagagagtggcgcctctcgttcttgccccgagcagctagaggagggcaggaggttttactccattttttttgtggtgtttggttaaaggttgaagcctaaatgtaaaaatcaattatttctcgctccgtttaactcttggttgttgatttgaattgccatgtgctatatgcatgcatgtaaaatacactatgggtgttgtttttagggataattctttttatctttttttgtgtctattgttgcatgaaatgctaaatttgcgttaatgttttcttccatccttcgtcacggccgttagtcaaattaatgctagtcaaactatgttaaggccatggaaatgtccattgatagcttgatttatctcaaatttatgttacgggtgcccatcgatccactagaggagatggaaatggttttgctcgatttttcttgggttttggttgaagattgaagcctacaaagtaaatattcattatttctcacccagattcacacctgctcgttgaattgaattgccgtgtggtaatacatgtaaaatgcactagtcatttgtatggatccatcagtcatttgtagatatgttcttagatgtcatgctaaattttaattaatgttttattccatctacgccatcgtcgttaatgtttcacattagccaaatattttttttgcattgacgaaaaatagaattttttttatcttttcattagccatgaatatctaattaaggtgatgtgggcgtgcgcaaaaatctcaattttatcgtagggtaaaatgggcattactctttgtttttattctaatgtgcttgtacattatgaaatcctcattgtttttttccttcacgattggtaataaacgataattattgcaggtacccattggatataatggatctagaatggataactatagcggatcgtgactctgtggagtatttcaggggagtaacggctcttgttgatgcaccggaatatatttggtgtccatgccatgaatgcaagaaagacagacaacttccggctcacgggtaaattcacatctccttacaatgggttttagggacaacttccttggcgaggaggtgcacgtgaggaaagtgccggcaactgtcacgggcatgatgcggatgttggctgcgaggaggataaccaaacatgtgtcgatcacggtgaacctaatctagatcagatgctacacgacggggagagatttgacactgatgatagggaatatcgcaagttcacaaccatggtgaaggactccaaaactccagtttacaatggatgtaaggtggagcacaataagcttcaagtggtcctattgctgcttcacctaaaggcgagcaacggatggtccgataagagcttcactgagttgctagagctcttgaaagaaattctcctatggacaacatctagccagaatcgacatacaagccaaaaaagttatatgtcccctttggtcttgacatacagaaaattcatgcttgtctaattgattgcattctttaccggtatgcaaggcttctagctataagtggggagacggggatgatgagggtggaaataagaaaagagtgccggtgaaggtcgttcggtattttccaatcatctcctgtttggaacgtatgtatgcaaacaaaaagcatgccaagctgatgcgttggcaccacaaagagtgtaaaaaagatggaatgatacgacatccagctgatgggtctcagtgaagaaagatagacaagaagtaccaaagttttctcacgacatcagaaatgtgaggattgcactaagcactgatggcatgaacccatcttgtaacatgagcagtcgtcatagcacatggccagtggttgttattatctacaacctcccttctgggctctgtttgaagcataagtacatcatgatgctacttctgattcaagggcctaaacaacctggcaacgatatcgatgtgtacttcaagccgctggtagaggatcttcatacactatggacggaaggcgtgcagatgtgggatacgtacaaacaagaacacttcacatgtcgggctattttgttagggacaataacagactacccagcacttggaaacacgtcgggccaaatggtgaagggcatgaaagcatgtgtatggtgcatggcccaaacaggaggcaagtgactgaatcatagtcggaaaaccgtgtacatgcgtcatgggaggttcctcaggcgggatcacccacaccaccaaaataaaaaagcttttgatgggacggtggaaatagatggacgtccaatttttagaaccggaagtgagatcttggcggaggtgaagatccacatcgagcggtgagacccctctattcaaaaagaagtctatcttttgggacttgccgtattggaaagacttggatattcgtcatgcgatcaatgtgatgcacgtggagaagaacgtgtgtgaaggcgtgctcggggtattgttgaacacacctggcaagatgaaggacactttgcaagcacggaaagatcttggaagacatggacatcaggaaagagctgcatcctcaagacagaggaaatggctgctactacctacctccggcatgctacactcttagtgctacagaaaaaacgagtatgtgggaatgcctgcggggtgtaaaagtcccatccggttactgtgcgaacattaagagacttgttagcatgaaagataagaggttggttggaatgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9958 - DNA, 18205 bp, Oryza sativa
  unsure (1)..(18205): unsure at all n locations
gtgacaggtgagactcctctttgcaagcaatcatcaccacctcattcatcaatgccaagacaaatagaatcccatttagacaaaccatgatgcggacatcactaactcggatacacacaacaatcctccaacggtcattcaaggaccgataacaagagctcgtgcgcgacaattaaatttagaggtgagctcgttcctatgttcttctttgtatgaattcgagaatagattgctacctaatgattatattgtgattaggaataatggaggggacaaggagacacttggagaaggacttagagccatggaggatcatcgaggacgtccaagtcaaggtggaggcccaaaccaagtcgacgtcgggtgcaattcagagtccaggaccagtctgcactaaaacgggcgcccaggtcgcatacgtgctcggattggggcgttctttatatgtatggaaagctaagaagataacctttccaatggttttggtcccacatccaaattttttccgagtcaatgggaattgaccgaacaagttgacgtccagaatttattccggtgctgcatcaccgtatttgggcctttggcccgtgtatcgtgttggaaaccattagagttgcgtcgagagggggttgcatgaccctaaactctatatatcagtacccgccgccatctttaggtttttgggttttgcttagattaatctgtcgagaacagtttcgccgctagatcggtttgtaagaccccaactcgtgagcttaatcattcatctgcaattttgggtggtttctatctcgttcttgtttgtgttcttcgattggcaaatagggattagccttctcagcgaggtcatccgtgtctcgatacgggtgataaccagaggagacgtggtgctgcgattgcggggctcaagagcgtgcgcgttcaagaagccggatcgatttgtgtcgcgactccgcccaaatcgttgtttatcagaacctttcggaagatcgggaactcagtgcacatcaaaccaaccctaacctaggtcattggactggcacctttaagtcttggcttgctaactgtgggaaactttttctggtagataaaaataaataaaagaacctattgagaccacacccttcgtctcacaaaaaatcaagcacatctccaaaactagtctagattcatcgctagaatttttttcttctggaacgaagagatgttatagtggcatacaacttcttcatccttcctacttctttctctcacccatctctttccctcacctctctctccaacagggcggggagcgcgatggtcgagctagccatctccaccctgcgacccccggacgaccccattggtcccagtcggtgcttcatggttgagttgtcatccttgccttgtggcccacatggctgagctcgacgtcttcaccccgtagaacccgacggccccatcaatctcatcggccttcgtcgttgtctggccctttcatgggacagatgcagtggaggctgttgggcggtttgcgggaatgaccccttccaatctagtggcacgatgacgagtagcaatagcagctacgcgatgctatgcctcagggcgtttcggcctaccagagacaaggtggtgaagatccaattccaccccacgcacccctggctcgtcgccgccaacgccaatgaccacgttttcgtttaggactggcggtctggcgccatttctctctaagtcactgtctcacatgaacccactaatacgtgggtctcactattgtcttcttgtttgactgacgtatgagcccacatattttttttagtttttaagtttgctcttttttttggatcaaactgccatgtaagtgtcacgtcaatgccacgtgagacgaagacctagtcaaataagccacacatgcgctatatcaatcaaaatactgccgcgggatcttgtttgcactggttttgtataagtcggggacgaattgtgtctggtttttcagtttaaagacgacaatcggattgatcgtcaaattaagggacatcaaatgaacttattttcgcagagaaaaatacggcccagcccaacaggacctcctcttaccaagcggccacactcccgaccaatctacaccatccgtccccaatccaacggcgacgcaaccgacaccacccccgcggacgcggccgccggtcgcctggtccgttcgagccgcctncagcctataaaaaccccggctccctctcccctcccccctccccttcccccccaaggctactcgcctagcgcccgccacctaggccggggcctcatcccccccaccttttctgctcctctccccaataaaattccccgcacgaatcgatccccccctcggatccggatcgcctcgcccaccccctttccgccgctcgtcgatcgcgatttttttttcttcgccggatttttttttctcccgatcggtggggagggctctctctctctctctctctctctcttcaccctagggttagggggagcgccgccgcatttcggtccgccgccgccgccggagtcgaggagctagggttttcgtcggtcgggggggggaaaaaggtggggggttgagattgatggaaaagaagaaggtggcggtgccgctggtgtgccacggccactcgcgcccggtcgtcgacctgttctacagccccgtcacgcccgacgggtacttcctcatcagcgccagtaagggtaagtgagcggcgatccgaccgcccgaccgcgatttgatgccgttttttttatggttttcctgctgcgattcgtctggatcgggggcggtgtgatctgatgccgccgcttttttagcgcgtggttctaatgtttgtgtgtattttttatatttttctgcggaggctatgttaatcgtgtgattttttaccgtgaaattgtggctacttttgtggagttcatgtctcgtgtattaatctagtttatgccgctgatcactgatgcagtttgggcatgattgctgtatgttgcgttgctagtcttctaatgcactatcttagtcatgatgaaatgtgttggttctatattattatttgttaatacgtgatcgtatgagtttattgtttgatatgtaatggtaggatatttgagcgtggttgtcaatggagtgtaccacaatgttactctttaacatacctagtgctgcatgttgcaatctagccggggtatgctatatttggacagccattttttctggttttaactcatatacgatgtgtgccaataagttgaggtgcgagaatgtttaacaatattggtagtcactcggtatgtgaccagagttttacaaggttgtaaattgggatagacggctgcctaggcaagtttactttgagcatgtgctatttggataggtggtgtctggccacaatatacttcctctgtcccaaaatgtagctacctagtgcagtacctagtccagattcgtagtacaagataacgtcatatcctgtactaggtagctacattttgggacggaggaagtaagtacatgttttaaacattgatcgtaacagtatagcaacatcttgccttctgtggtgcaatgttttatttaagacatctattcttagactggaagtgagctgtcaattctgaagaattaggcaggaccacctacttcattgatatttgtatgttgaactgaatcaaatatgccacagatcgttgatgcagtttgggcatgattgatgtaggttgccttgctagttttctaatgcgctgtcgtggtcatgcaatgtgttgattctgtgttgtttgttagtttggtcggaagtaggatgacagctgcactacatgatcacatgactttatcgttttatgtgtaatgggcaggatatttgttcaaaaaggagctagtcgatcggttgagtggcgcctagcaggtgcctaggtcagaccaaatagtcaaatccaagaaattagcaagcatattaaataaaaactagacttcattacactaaaatagcaacaaaataccacccaaggtagttcagctgcctaatgcaccatctaatgcctcattgccgtggctatcagaacactgcatggttgtggatagtgggtctggtgtacctcaatgacactctttaacatagctagtgctgcatgttgcaatatagctgggatatactataatgagtgggttgtatttagaggacagagccatttttctgaagtttcaatccatatatggcgggtgccaatatgttgaggtgatagaatgtgtaacaatatcggcagtcactcagtacgtagccagtgttctagaaggttgtgactagagctaagtcactgagtaagttgtggtagatggctgcctgggcaagtttactttgagcatgtgctattttgaagggtgatgtctagccacaatctaagcaatcatctttaaacattgataacagtataacaacatcttgccttctattgtgcaatgtttaatttcaggcctttattcttagactggaagtgagctgccaattctgaagaattaggcaggatcacctactttattgatattctttcaggaagtagttctttttgggggttaagataaggttatttatttgtttttcagacaatggaagaatgacattcggtctctacacctgaaggtgtacacagctgtgtcatgatgaagttttgcgacaatcgaccttattgatctataaaaaacacgacagttaaagcatccaattgattcaaagccaattaagctaccatccataactccatgatttgctccaaacatttgctcactgcaatggacactaattagtgctctttgcgttgaagtagagaccagaatcacaaccagttggagcacatgaaattactgtataggattaacatttttctttttgttaaatgcaatgtcattaggacaaagccaaatagaccaaaaaagggaggctatatagacaaattgattgtaacgtgcgaggtcatttaatgaatctgcaaataagtaaaccttatcggttatatactttgggcatcatgtgcccagggttttgagcaaatctaacatggttgggtattagcaaaacaagtggtagtatgaggacccatcatttttgtcataatagcatttttggctcattattgatatcgcttattattagcagggagttgcatatgcctagtgcatatggctgattagttggactaggcgacaacctagacatgctaagcattgactaggcagctagattctatgtagaatggtgatgcataggcacaaccacttttcgaatgatgcttgtaactataaagcaatgtacgagctatattgttcaaccctatgtgttggaagctagctgccctttttggccacaaacacctacttcatttatatttcctatgttggtaacactgtttccgggttgcttggacatatgtagaaggtagttaatgctttgttggagtggtagttaatatagtttgattaaggaggagatccttgtaaaagctgcatatttgtatccatgattcgaaacaagacaggaaactagcgtgtgttctgtcatagctgttgccttgttgccatttcatttttggagggttaggtttaattcatgtttattagtatatggaattacataattgcattatatgctctaggttttcctccatgggataatatgtatagcaagcgccaaccattcaatgctttaaatacggcataacaatcagctgctaataccttctttttgatacaagtcttagtgttgagctttggcatgatgactaatgtagtaactaaatgactttagttttacttgagaacttagtgcaaaatgctaacatttgagaagagcaccataccctgtcatagggtttgtgcgaactttgattagtattacttttggtctgaactacactgacttcactttgcaatgcattgtagaaatctaattgttttttagattgatgtttattatacaaaaactaatttgggtataaatctaattgttttttagattgatgtttattatacaaacactaatttggtaatattgtatgttttgatcttagatgggaatccaatgcttcgtaatggtgagactggagattggattgggactttccaaggtcataaaggggctgtctggagctgctgcctagacacaaatgctctgcgtgctgcatctggttctgctgacttttcagcgtatgacattcaccctatgaaatttcagtggtgtctattttaattatttatctttgacaaaaatggaatgtgcatgcattcagtgtatttatatttttattacaattttttttcatccagacgtgctacttgcaggtgtaattataatatattatagttcagttctgaatgttcatggtatctagtgtatttcttttttgcctttggaaaagaatccatcaaaaacttcagatgatgtaatatttgttcaaagcttgatttttacttaattttctctagatgagaagaaaaatgattgttatggatctagtcattaataacacatattcttaaactcgtaataaacatataagcatagtttagctttagcatagcactgttcgccttgcagaaattactgaggataaaaactgaatttgttatttctgctttcttccaaatcttgtgtttctgcgtaccattttgattcttttttgcagcatggagaattggatcttaagtatgtttcaaaatgaatataaatatcagcactgagagttctccaaagtgctttagacttgcttattttgtgttctctgctcttgattacattcatgaaataccaaaacataatggattgattactcaacataaaggttatgtggaaccaaaggaaatctgcatctcatatactccctccaaaagtctaagacattattttattttctggtttttccaaatgagttgggcatatttgtagtctctatgtactaaattaaattgttgacctgaacccaagcagccatcttaatactcattggttgcatgcattcatctagttccttggttttgtcacatggggtggatgagttaattcctccttggtcttggtgacaaaaaaaatatgccttagacttttggatagagggagtaatataaaacaatatgccattaatttgtgcctaaaagagtagaggatgcttgaagctcaattttggcatgaagatttgcatagtaaaacaattttgtaattttagcacatggcttacagattagtatgttgaggagtttggaattatggagaatttatggtgtatcctgaagttggtggttgtgcataaattagttatgaatgattgaacgtaaggtacacccataagtcatctcgtgaatgtgatctacagtaggatgctgttttgcaattctaagttgcaacatttagaattctaagttgtgatctacagcataatatatgttggttttgaggccttgcaacacaaataaataacagattgttgctgctcaactaatattctagtccttgagttagtacttacgagttatgtccattacaagtttattttgctcttataatagatgtatgttgatttttttccagcaaagtttgggatgcactaacaggtgatgagctacattcatttgaacacaagcacattgtccgtgcatgcgcgttttctgaggtaatgcttccagaatgttttaatcatcagtgctagctttgtggattttctctttctaccctatagaaagtgtatgctgtccttcttttctttgaatatttttccagacactctggactgttaaactaaggtctggtggccttatgcctgtgcacagatcatggactgtcttaatgaaaatgtatataccaaccttctgatatcagtatttaatcacttgctatgaaccaagtatttaatcacttacaattaactaagtgtatatcagtatatccatgtaactgttatagcttcttgctaccttatctgcagtatgttgcagcatttaatttcaaaataatgctgtcctttgtgagcagtttgaaatctaattaaatggccattggcgctgtaggatacccacctgttgctcactggaggcgtagaaaagattttgcgtgtctatgatatgaatcgtccagatgcagcaccaagagaacttgacaaagcacctggtaacgtgcgaactgttgcttggcttcatagtgatcaaacaatactaagctcgtgctctgatatgggaggagtaaggtgtgtctggaaaaaatatcttcattctataggaagagctgctaccatttgttcctagtttattgtaattttgttcctcttatttaattgttatggcactgcacagattgtgggatgtgaggactggaaaaattgtccaaactcttgaaaccaaggcgcctgtgactagcgcagaagtaagtcaagacagcaggttcatcactacagctgatggctcgagtgttaaattttgggatgctaatcagtacgtattatttctatcatcattataccgttgttctgtgtcatacaaaattattaaatcctttgcaacaaacattttttgctggttattttgcagctttgggcttgttaaaagctatgatatgccttgcactgtggagtcagcttccctggaaccaaaatctgggagcaaatttattgttgggggagaagatatgtgggttcatgtatttgatttcttcactggtgaagaaataagtaagcattatatatttttcattcacttgtccttcaaactttaatgcagtttttcttttcaaaatgagaacattacgttccactgttgtggcttgaagagcatttaaacatgttgaacaactgtaacatactattatttgcttagatactgacctcaaggcttgattgcaactgataatgtgtagctaaaatcctgtgttcagaagttgggtcgtacttgtacttagaatttctaacagtccttgcacatttatgataacagttatgcaggggacagtcgtttccactgttgcagtaactagcttatcgtgggaaccatgagtcactagtgtgatcaaacaaatatttttctaacttttttgccctccattaattaatgcataatggatatgaaataaataattcaaatttcaaaaagtttgacccaaagcttgtcctaaatatcaaattttatgactggaaggagtacatggcattgccatgctttttttgtcatatagttgcactagttttatttcagtcctaacctttaggaacaatttcctactttagttgctcggctctttgtacttgtattatactccctccatttccttttgtttgacgttgaactaaccacgtcatacatttggaaatagaggtagtatattgtgtaacctttttaatagttttttcggtgggatatttctttgggaaattgtagaattgttcaaatcagaaattccaattctctttaatcatactgacaaatggcttttatttcattgtaatctctgttccaattaagctgattgttttttttttaacaatgtgcagcctgtaacaaggggcatcatggtcctgtccactgtgtccgctttgcacctggcggtgaatcttatgcatcaggatcagaagatggcaccatccggatctggcagctgagcccacctaacgctgatgacaatgaggcggtcaattcaaatggcaaaccaacagttggggtaaatgaggttgcacgcaagatcgaaggcttccacattcccaaggaggaggagcagcagcagcagcaggctgaggggtaggactacaaggttggcaaacatggcagtgcttggtgcttactgggagatgattgcttgtcgatgctcctctccttcccgtttctcccttgctttgttgatgcccttggttcccgacgcaaggggggagagatcttgtcctccgtgaccaaaacggtggatttctgtatggggccctcaccaaatagacagtgtcagggtagtatctatctacagtgccaaaataaaccaagaggaaagcaagttggtagtttagtatcgttgattgcattcacagaagtgaaagtcttgtattccgctggtggccgtgatacagcagatgccattgtgttcaccggtttttgcctcccctacccttctatggactcttttcttatcaggaattgcttctttttattattgccgctgttttgacttctgatgcatctgatgctgtcgtctattctttgtcgtttcatttgtcgaccttgtccgtactatctcaatctatagacgatctcttcttccctacatctactacatgacatctagccctgtttttatcctaaatttttttcctaaaaacatcacatcgaatctttgtatatatgcatggagcattaaatatagataaaaaataaaaactaattgcacagttatgggagaaatcacgagacgaatcttttgagcctaattaatccatgattagccataagtgctacagtcacttacatgtgttaatgatggtttaattaggctcaaaagattcgtctcgcggtttcctggcgagttatgaaattagtttttttattcgtgtctgaaaattcattccgacatccggtcaaacgttcgatgtgacatccaaaattttcatttcgcgaactaaacaggatccaaactgatcacggcaagtttcctacctcaagcgaggctacacatctactccctctatcttaaaatataacaaaatataatagtttctagcttttagatttatctcaacttttttacctacattctcttcttaaccaattataattttcttcaccaactttttttaatacgtgtccaatccaaaactaattatattttggaatgaatttatgaatgcagtggtagtagctcaatcatgctgctgcagtgtcgctatgatcagtaagatcgtgcagtatcattgaccaaattacctgatctttcgttcgtgcaacactatattcagtacatgatcttctcgtcgtgtgaataattcgattctatgagcgttgtgaaggggacaatttggagttttcgacaatggcatcgttgcgctgtgcgtgcgtacgtcttcctcgtcactgcacctgcaggaggaatcgcttcacatgctcatgccatgtgatcctcccctttgcaaatacgcggcctttctgctgcgcatcacactgacccccggtatcagcatcaaccggtgccaaccatgtgaagttgctctttggattattagtggcagccagactcatgattggtactagaccgtgctaccaataccaggaggatctgatggtaaaatcccatggacatatgtctaaatttcatccggcttctgtgatggtgaatatacgatcaagaaaatatcactttttaaaattttcgccaagttggtttcttgctaaacctcatgtgttcatttttttatccgcaaaatgatttgctgtcaacgaactcgtggtgaggaagaaaggttggtcatagcagcctggatttgtttcctgcgtgctagcggcgcctcaatcaggctcacgtgggtgctagtacaggattattcattattgtaaaggcttctgttttgccacttgctaatatgataagtatactttcagaatggtccatttggttcagtctgcagaagcggtacccaaagaaaccgatttctgaggataaatctgaataattatcccttgaagtttattccttttaggacggagaacgtagtagtttggcaattacagccaagcagatgtcctcctgcagctacagaaggcagcagcagccagccacccagcccagatgcattgtgctgaccgctccagcacacacttgcattggcagcctggctatataattagatacatatgtgaatttggtgtattttcactgtagatgagcatgcacatgtcatggtatttggtgtttctgaatgatgcagtaaaccagatagtaacatccaactatttcagtattcttgaaacatcccacaagtgccatggcatgccaccattcaatatccttgacacaagactacaattactactactcctacatagcagtaatggacagcttgcatattaactacaagcttaaatgcagattttgacattcatttctccatggccttgatcattctggcagcaagtccagatctatagagaggatgttgaatgtttgcttgcacaaccacggcattcagacatatggcgacatcgcattcagtggcacacgaactcggacgaacaacccaagcaaacccaacagaagaataagacaacactatcatgttaaaccaatcaatttaatgagataaatttaatgagaatgtgacagtgctacaagggcaatcacaatcaggcaacgatgaataaacgtcacatgaagactccaattgttttctccaatctgaataaatacagcattatcagacagccctaagtgaagaaaacacaccctttttctacctaattgaatcagctacagttttctttttaaagttcccctcacagatgctacaactgaaaaccaaagaactcttgaacaattgcaaatggatttagaaccctgaagatgaacttcctgccctaccaatgccaatgcacaatgccactcaacccaccatactttttactactcttgagacaaacaaggcatttcatgtcatgcatttccaacctttgatatctttggaacttcaaccgggaagttgtcaatctcatccatccaggggttcttctccttcgctggattcactgtttgcagcgccttccagactgcgctgttgcacttgaaaccagatccaaatgcaatctgccagatcctgtcccgcttcctgatcctccccttcgcctcggtgtacgccagctcataccagagtgagctgctcgatgtgttgccaaaccggtacagtgtcatcctagatggctccatgtgccagtcagtcaactccaagttcttctccagctcatccagcacggcacggccaccggcatggatgcagaaatgctcaaatgccagcttgaaatcgggaatgtatggcttgatcttcatcttgaggaccttcttggcaaccaatgtggccatgaagagcagctgctccgacaacgggagcacgagcggcccgagggtggtgatgttcgtcttcagcgcgtctccggccaccgccatcaggtccttggagagcgacacgccgatcttgccgatctcgtcttcctcctgggtgacacagccaaagcacttgtcgttggcgcccttgtgcgtgcgcacggtgtgcacaagctcatacttggacctccggcggtcggaccgcctgttcgacagcaggatggcggcgccgcccatccggaacaggcaattcgacacgagcatcgaccggttgttgccaaagtaccaattgagcgtgatgttctccatgctgaccaccagcgcgtacgagtttgggtgcacctgcagcaagtccttggcgagatcgacggacagcaagccggcactgcaccccatcccgccgaggttgtagctgatgacattccccctcagcttgtagtggttcacaaccatggcggacagcgacggcgtcgggttgaacaagctgcaattgacgacaaccacaccaatgtccttgggcttcacacccgtcttctcaagaagctggtcaatggcgccgaacatgacggtgcgggcctccttgcgggcctcgtccatgcacgggttgggcgggacgcgcagcacggcgggagggaggtaggtgtcctcgccgaggccggagcgctcgaggatcttgcgctggaagtcgaggttggcgtcggtgaaggagccggtgaggctggagcagcgcatgaaggtctcgcgggtgcacttgcgctgggggtcgggcttgtagcaggcgaagtcgaggaggtagacggggcgggggcgggtgaggaagtagagggtggagaggaagacgaggagggtggagcaggcgacgacggagaggaggttgaagcggagctgctcccacaggtcggcgatgtcgcccggggacacggtggagagctgcacggccaccagcgccatcagcggcgacagcagcaggtacatgccgtgggagatgaggtagtggtaccccagcttcacgtacttgagcctcaccgactgctggaagtccggcagccgacgccgctgctgctgctccgccgccgccgcgccgccattgggcgccgccgccgccgaggtctccatctctggctgatgcaaaaaacaagaaaaaaacaagaaacaagaggtttaaaaaagatcgcagatttgcgccgcgagaagcgaaatggcgagatctccgagggtctaggaattgagatgagatgcgaaatcgcgaaaagaaaccagatttgcgaatcgaagagaaggtccaggcggccgcaatgcgggggcggagaaaagggggggatttttttgaggcaaagcgagtacatacataccgaggcgggcttggaggagggaaagaagggatctttctccggtcggatgcggcggcgagaggagaggaagacgactactgccttgattctctctctctctctctcttcctccgcttgaatacggcggcgagcaccacggggagggacgccgccttttaataagcggaggaagagagggaaaaggtggaaactactggaagagggggagaaaattcgccctaaatccttgtgctattttgcagtttcaacctcccaagtgtttgcattttgtttttttttatttggatgagtaaatctcacccctcaattcctctcatgcttgcgttctcaacttccagttatcttatgttttatagcaaggtatttagtgcaaaccatatatatctagtgaaaacttagaaactaccgttggatttagaaatagacacataagatttgtccacgtcaccgagagtaaaaaaattactcatggttgaatctgggagtaaaattttactttgagtgcagtggataaatctgaagcgtttatttttagatctaatgttagtttacaagttttcattatatatgtgatttgcactatatgttttttcatctttatggacaagtaaatctcaccttctattcctctgctatttacaattccgacttccaattgtgtttgtgtttcatggatgagtaaatctcaccctcaatttctcttatatttggagtttcaacttccagttgtttgcattttgtggatgggtaaatttcaccttctttgatatagcatgtagcaaatgcgtttatatggttatatggatttggcaaacaattgataactggtataaacggttttatattatattagaatatattgtttcctttttgtttgtggactgcataacatctcttcagtcttgtaacaagcaaaatcatttggaccatctaattatggcttttggtagtgtagttttgatttgtttgtctcacctcttagtttgcatggaaaacttcatgttgcaaaaggaaccaaaaacagaaacaaacacataaaaaaactcattttatgtactaccactaataaaaattttgggtggtggtgtataccataaataagatttggaggtagaggggataagattaacacgttgcaaatagtttgaaaattatactttctccgttttaaaatataaatattataggtccatagtacactgtggaaacacatcacctagttgaggtataacttcgaattccaaaagcaaaacgagtatcctaattgcaaaacaagcaaacaacacaaacaactatccctttctatgtgtgtaattttgtataaacacaaggacccaatgcctgtacatgtacgtgtaattttctgcaagcgccaggacacacgggtaaaacaacacacgttttcggctattttgtgcaccggaaatccagtgccggtctgccagatcgacggccactatctcgttgggatccaaatggacggctgggatcaacttgtatcagcagcgatggtcacccactatttttttttcggctcgcatgtggggcccacatgggctggaaacgctacattgctgaatatggggccaaaggtggggccagttgttgtcctgaaaggctggaagtgaataataatagtttttttatatgtggaaaccttttccttttaagctgaaaataattttgcaaggagtacttttctcaagcccttttcaaggtttacaaattttgaccggaattgaaccatatgtccatattgttggtctgatcttttgactgaggatgggtaaatgcaaatatataccactggacaaattttgtgtttggagatacaaaaatttggcttgtgttgtttttttactatcttcacataatcattttttttcatatcaaaatatagtcatccgtagtaaagcacgcacacctatgagctaccaaggccgagcagataagttgtgaggttgcattctcttgaggtgttgggatgaactatttctttgattttaatgggcacacttcctaagctgttaaactatacttttctaaaaaaaattagctgccatacaaaaacaatgtttttattaaaaacatccatagagaaagttttttaaaataatcaaatcaagttcataattcatatttaattaatcatgcacaaattgtctgttgtgtttttcatcctagattaataggtcaaccctccccaaaaaactgaaacaggcttaaggctaatcagcttagcgatttatctactttcctctttttagtgtgtttcaagaagttttcttaaaaatcaacaaaatctattttttaagtttgtaatagttaatactcaattactcatgtgcaatacttgtcttgttatgtgtgtaagaaaaagctcaaatcaattcctctaattaacttgaacgcagctgggggcggatccaacgtggatgttggatccccttagacaggagagaggaataagagtaaagtgcaggaggagaaaaatgaagatgagtcccctaatagattatcctatatccactcctaaatgcagccttaagtctatcctaaatttaaataggaagcttcgatcaatggctacattacagcatgaaaactacaatgaaaaaagattccatagttcataatacaagagtgcaacttacttagttgtacccatgaagaaatgcaccatcacatataacttggtagcgtcaagatgatctagctagcattgggtcaagtcaaaaatttgtcgacaccccgatcagcaatctacataccgtggtctatttgctaacctgcagagatgagatccacttggttgacagcgatgtgttttgcgttaggtgagccggtgagccatataattttcgccgtcaaacaaactcgtacattttcgccggtcagccataagaaaatcaaggccaaaaatagacgaccagccatggatcatcgagatattgcaagtgcacggaagctctcgaaaccggcacaagttgccaacgcgtacgttgtacggcgtacgcttatttggctttcgcgtagacgaaatgaaaaaaaattaacgtgcatgcacggcacatgacaacgcgatcgagcagctatcgcgttattatctctttatcgatgaagccgtcgatagcaagggaaaatatatcgtggaaactatatatatagcgaaaaactgaaaactaccgttcgattgaaaaataaacgtctgagattcgataatgttataacgagtaaaaattttacttacaaatttactcatgataagtaaaagttttactcatggtaaattttttactcataaagatgtaaacgaatctcagacgtctattttttttattcaatagtagatttcgggtttctgctatatatgtggctgcttgtatattttccctcgatagcatgtactaggacttcgactagctcaatggctgtagctagtggtttgtttagaaggtaaattggaaccatgccattataattttgtaaagtttgagatatgccatcggtatctcaatgacatgtaggacccacatgagtcaatgacatgtggctcaggataacatatctcaaattttacaaaattataatggcatggttccaattttcccttgtttagaacagtagccagtggttgtggttgggccgggtttgtgagagatcgagagagagctagctatactttgagagaagataaatatgaactactgcagagaagcgatctaccaggnntcaaagcca

SEQ ID NO: 9959 - DNA, 3093 bp, Oryza sativa
  unsure (1)..(3093): unsure at all n locations
ctgattagaaaaaaattaggggtaataaaaacgtgtaaaggcggtttacaaattcaaaagataagacagacctggtttaagatttgtatcagaggtggctccggcgaactggatgaatgaaaaacgggaaagctctaaaagtaggttgggtcccttcttaacggagtaagaaaaaggttggttttataggttaaataaagatgccggaattaaaagcaaagggcgccatgattaccggcctggaaagccgaaaccgagggatgcttgtcctctcagaagaagaagtggcagtgtccgagatcattttttcaaaggttccatggtggtcattcgattaatctaatactagaaaattaggaatgtgtattcatcgatcgacacccttaccacttgcctggtagggaccatatataacagtattgtattgaagagcttatatcaccagtataaactagcatggtggtccgcgcaatttgcgaggctagcatcatatatttttctctcaaataaaggcataatgttttcccattaattaatcaaatatatttaaaagacagataaacttgtaaattttgtaatactgtccaaaatacaaatgtgtaaaataatattgaattttatatacgtgtaagtaattaataattataaatatcaaatttgagtatgttgtaanatagccacctcccccacgtgggccccccacttcttcctcccttttttcaaaaaagatgtttcacctagtgtatttacaatgtttcactatttataaatctaatgttgcagtgaatgaaatattccattgcaactaaaaacccacatattttggaaacccctattaagggaatttgatttattttttgttccaccgaaaaatgtttcacctagtgtagtcacaatgtttcactgtgtatagatctaatgttgcagtgaactgaaacattctttcgctatttgctaaaacattgtttttatataaggtgaaacaacacccgatttaaatgagtgaaatattttcgatcacttagtgagacaattccgatatacctggtgaaacattgtgcaacattttaaaaaaattcaataataagctaattttttttcgtcggaatatatccatgtgtggtcttgttttgaagatttaattgcaacgaatttaatggtgcaatcggatcatgatttggataagtaatttaagagaaaaatcggttcaaagtagttttgcacgtaaatcgggcgctgacgtcagcgcccgatttcccagcccgcccgatccgtaggcgctcccacttatgtgtaagaatatactctctccatctcataaaaaccaatttagtaccgaatgtctaaatttatggtactacaatgtgatacacctggtactaggttggttttttaggacggagggagtagtatcattctattcttgccatggtttacttggtgtattacaaaaatttcagataaaaaaattgtgaggccggatgatcatcattgactagttgcatgaaaacaatataatgatataaagttgatgtaatttgtcttgtcaatcgatcgtattatatactcccttcatactcataaaagaagtcgtttatgacaatatttaaatcaaatcttggaaatataaatcataaataactctcaagttgttgagtttgaaaatgtaaaaattatatgaatagatttgtcttgaaaaatactttcatatatatatatatatatatatatatatcactttttaataaatatttttatggaaataagaagttaaagttgtgttttgtagactgtgtcgctgtccaaaacgacttcctttacgagtacggaaggagtaagtgcttgttcggagtggtttggtatgaagataaaacttaccctactcaaatgttaggattttaattataaacagtaattctaataatttttagtttgctaccaataccgcatataccatatatatatatatatatatatatatatatatatatatatatatatatatatatatatatatatatatatatatgctgataagatattggtatcactcttttcagaaagaacttgcctatgatttgaagttgctaaattttttggcatcggggcaagctaaactagcccttcatatcatatcatgtatttacgtactgtgctagaactataattagtgagttctgttggaaagcatgtattttataggattttcgcacaaattagttccattctcgcgaaattccttttcaaaaatcctccaattaatcaaaataagaccatagactatataagaaaaatgttgaagtggtttgaaaatgtgcatatgtatatcacttcaacttttttcttgaggattagctgaatctacaagctgtcctaattaaggaccattaggacaacgacactacacatttataccctcttgggacagggagtttaaggctggtcttccctaactaagatacatggggtaccccgttattggcctccccctagcctagctatcaggttcgcttgaatgcaacgaacatccatgaagttgacgcttacgctacatgcctagtactataatgatgtatgtaccatacaaccttctagctagaagttacactacctgatactaagaactaattagcgttaggaccattagataattaatgattagtatgaagtatgtactacctcgcataggcggatctagcactactggaaaaaccatctttggtcagtcgaccaaattccacaatagtcccgattgtaataaaaaccggaactaaagaacatctttagtcccggttcaaaaggttagagctacttttgatttttagtacccgttggtaacaccaaccaggagtaaacatcatttttagtcccggttcaaaaaaaaatacaggtggtgtcagacccctcatttatctttaatcccggtggtaacatccttagaccaaccgggataaaaaacgacatcaccgagaagcatgtgtcaaaccccctncttatcttnagtcccnngtggtgtaacaacttgggactaagaataaattntaggcccggtgggtgtaccacccgaaaaaagtatcgcggatcagttataan

SEQ ID NO: 9960 - DNA, 1724 bp, Oryza sativa
  unsure (1)..(1724): unsure at all n locations
ggaaaaaaaaacccaaggttcccaagcgtaatccaattctacctctcctcctcaatataggcccatcccctcccctcccctccccacttctcagccggcggccggacgggaggcgcctcctcctcccatctcttcctctacctcctctcctctgtatccgccccatccccttcccttcccacctcacttctcaggcagcggcttccggatgagaggcgccctcacgcggcaaccgggcggcggcggagccggcctcgcacaccggtggtaaggcagtgcgcgaggcgcgcggcggggccgcgccggatctcctctcttttttttataatttgtgattgagagatgtataattccttttttttttaaaattgtgattcattgcatagatctgagatgtataatcgatctgtgatgcatttgatttgtgtgtaatttttttttagatttgtgatgtatttgatttgtgtgtaagtaacttaggatttgtatttgtgatgtgaatgatttgggatgctactttaatttggggatttgggtatatacatgacactcgatttgaggatttggtgttatatctggaatatacatctttctcgatttgggagaaaataaaaaaaaatagaccaaccgagactgcccctatcctctctttagtcccggttggtactgcccctatcctctctttagtcaccaaccgagactaaagattcctctctttagtcctgattggtgttaccaaccggcactaaagatcaatctttacttccggttatttcacccgggactaaagatagcgatctttagtcccggattcgtagtcccggttgaaaaatcgggactagagggggttataaaccgagagtaaagacggattctccaccagtgtaggggcggtctcgggacttaaaaaaaattctagcctaatgcatatatgtacatatatgaaaataaacttttgagaaaaaacccttatgaatatattatgatacacatttgatcaatttatacaactaacctggttatgtttagggtattttaaaaaaatatataggttggactatccatttaaaaattctaaatacgccactgccacctctcgtgagaaaaatccacattagagatactggcactagtactgttcacttttctctctccaatgatccatcaagtactcctgcttccctatccaactatccaagatatataagctgcattttgactataagtatgcaaaagtctaatttttctctaagtaacctccattcctgattcccctctcacattgtctccctcccacccagcgaaaggttgaaagcggattgtaagcaaaaggtccatggcaacggtgtaacctcttttatacagatcggggtgcatcatgagctaactatgagtatgggcaacgcccaccctaccgagcactggtttctttgacgatgatgcctcaagtacaaagatgacagttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggnnnnttctcaagtggngttccattcntacagcc

SEQ ID NO: 9961 - DNA, 1233 bp, Oryza sativa
  unsure (1)..(1233): unsure at all n locations
ggctggacgatagatacgcgtcgtctgcaagcagctcatcaattaagtatttttaaagaacacgtcaacatcttaaagttagtttggtgtggtgagggaaagtgggccggcatggggatggtgtggtgagcacctcctcaagctcctatgtcgtcacgggttccatcccttgtttatcaacctcctgcggcgaggcagccgctcggagttacgaggatggtggacaggtagacgagctcgaagtagcttgccggcaacccccacattgctccacttggttgggaaaagaaagagttgaaagaaagataggggaaaagaagagtgggtacttacatgtgggtcctacagtagccctatgctaactccacaagtctgaccacggtcaatttgtcacgtcagcataaaccatgttccaaatcaccgaatcgatttgcactggtttttgaagttggagaatgcaacgtatccacttttacagtttaggatacgattcgactgaggccaatagttgagaaaggtgaaataaacttattcctactctataggggtaacacaagtgggctataaagtgggcattgtgaaatggaaggagtaccgagctgaatcattagcccaatttaaattcttctcctcctcacaaattcctttctctccctccgtcctaaaataaatgcagttttagcactattcatattcaacgtttgaccgttcgttttatttgaaaaaagattatgattagtatttttattgttattagatgatacaacatgaataatactttatgtgtgactaattttttttaatatttttcatatttttttttaaataagacggatggtcaaagcgctaaacatggatattttatgactgcacttattttgagacggaggtagtaacatatttgtcgttgaattgccaacggatggtccagatttatcataagtgggctgcttgctaagaagattgcttgtctggttgggccgttctctatttgctcggtagcgacaacgcagcccactaaactccaaagaacagagtactctcatttcaaaaggaaaaaaaaaaaaacaaacaaacaaaaaaaaagaagggattgtctatacataaatcttgcaaattctggaccacccgattactttaagatttgtgcaaagaaaccaaccctaaaaacctcctctcctctcctttctnnnnnnnnnnnnnnnnnnnnnnnnnnnnnnnnnnnnnnnnnnn

SEQ ID NO: 9962 - DNA, 1089 bp, Oryza sativa
  unsure (1)..(1089): unsure at all n locations
ccaggcnnanatgagattcggcttcgtctgcaagtagctcatcatcgaatgttttttcttattttattagtagtcttatagtagtcttagattttacattttgatgagcctcgttttaaagaattcagattataagacttttctactattgcccacattcatatagatgttaataaatctaggcacacatatatgtctagactcattagcatatatatgaatgcaggcagtgctagaaagccttataatatactccctccgtcccaatatattaaaacataggacatgatgggacattttctagtactacaaatctggacagactgtctgtccatccagattcgtagtacttaaaaaatgtctcatactatcctaggttttaatatattgggacggaggaagtataagtatgtcaaacgttgggctggtgtctttggaaaccgaggatctcaaattctcaatccgcgcgcggtcccgcgggtagagacaagcaaaggaggagaaccagcgccacgccaacgacgaccggtcgatgcatgcccggatgcaaccccaaccccctcgcgctcgcgcgggcgggcgcgccgcatatacacgagcaacacatgcgcgcgcgcgggagcgagaggggaaggcagccaggccggcatcccgggttcgcacccgcgcccccgcccccggacacgcggggtgcaccaacccgcgcgcgtgttccgcgccggcccgcccgcgcccgagtacgtcgtcgtcgccacacgcacgcagcagcagcagccgcattttcctttctcttcacccccgcgcgggcggaccgcgcccgatttggcggtgtcgtccgtcgcgctacgctagcttgcgtgcggcgcgcgcgcggncacccaccacacgtngcgtcgaccggtcgatctacgcctgcgcgcgcgtcgtctcgtctcccgtcgcgtcgcgtcgcgtccgcgctgagctgagctgggggggccgcgcgctgctgtctcgttacgccatcattcatatgcgtcgtcgtctggcgcgcgcctgatctgaccgaaaggctgncgtttttgctgacntgccgncgggncgtccgcg

SEQ ID NO: 9963 - DNA, 30780 bp, Oryza sativa
  unsure (1)..(30780): unsure at all n locations
gagggaagcgtctaaccagatggtacagtacagtcatcaagtgaaacattgtgactacactatgtgcaacatttttctgtggcgcaaaagataaaaccagatacgctgacagggggtctcaaaagacgggcggtcttagctggcagggcatgacttattcccttgcccagttgatttatcaatggtgtaacattgtacatacactggagcgaacatgttttttgaaaaaaggtaggaagaagatgatcgcccacatgggggaggggcgcctacgtaacatcgatcctctcgtttcgttacctgcgctctccttttccgaccgagatataactttccacgaaaagaaaacgagctttctctacatggagttcaactaccctactactactactactactagactagtatgattacatgctgaattgctagtgcttctagtagcaacataattaatccaagctaaggaaccatttgaatagaagaatagaaaaacactggtttattacaaagtattgtaaaatacagaaaaacacagaaataatcatttgattaatttaacctttttttcgcgaacgcgtaaaagattgcacgtcaatatatttgaagaaaaagagtttaagttacatgagccaatcagccagaccagcctattctaggggaagggagaaaaagcaaatgaaaaaaaaaactgaagcttagggagactacggcggctaaaaacagactccaagcagggggaaggggccaagccacgctagactcccaacaaatccccaaaagcggcgacgccagctaaagaccacagatggcccttagagtggatggactccagaaccactgagaccgaagagagagcggagtcgaaaaccctagagttccgctccttccacagatgcaaagagaccagacgcaccagggagtcgaagttgtcgcggaggtgctcaggtaagcaggccctggaggacggccaccagtcctagaaccagctgccacggtggggagagagggcagcccagctaggaggcgacaacacccgaaaccagacctgccgagcgaacacgcagtcgaggaggatgtggttcgccgtctcaagatcctgagcgcaaaaggggcaggccgagtgactatcgatgccacgcttctggaggagatcagccgtccagcagagctgctggaaagcaaaccaaagaaatgacctgaatttggcaggaccctttgcattccagagaagatcagcatatgcaaaggaatgctggccatagaagaatgcatggtatgccgaatgcgctgagtagcgctggtcagccgtccaacgttaaatgagatgatccttgacacccggcgagagctgtacatgaagcaccgcatcccaaataaggagaaattgggagatgaccgggatagtgagggcaccgcggatatcagagacccaagagttgttgctaggccagaagcaactgtgcgcgaacctcggagacactggggaacgacgaagaggagatctagagccaaggacgccaccgagcggccgtcgatccgttggtcagaccagaagagcatagactcaccatttcccagcaaaaagaaggtggatgccatgaacatgtcggagacggtttgctcgactggggccttcaggccatcccaataggggtgccctgagcactggagccagagccagcgaacatgcaggtcaaaccctgccaatctgaggttagggatccccaacccaccacaagttttggggcgacaacgttcgtctaggacacccgacactgcccaccatgagccgagtccgtacctgtccacaggaaggcgcgacacttcttgtaaaaggccttaataacccagactggaaggccgatcgccatagatacatggaccggaatggaggagagaactgtctggaccagcacagaatggccagccagagtgtaagtcgtcccttccaaggcaggagtcgatgggagactttatccacaagcggttgcaagctggccgccttcggcaacttgcgaacggacaacggaatgctgaagtaggtgcaagggaaatcagaaaccgcgtagggaaagcaggactgaaccaactccaggtcctcagccgagcaacggatcggggtgatcgaacatttggcaaagttggtgcgtagcctggacgcggcaccaaaaacataaagaataccctggatgaactcgagatcctgatgaatcggggagaagaagaggaccagatcatcagcatagagggaggcgcggtgttgcaaggcccgatcattaagcggaaggaaaccaccggagtcggaggcgtggcggagcatcgcattgagtacatccataaccagaatgaagagcatgggagagagaggatccccttatctcggaaagtcaaaaatctaacgagagtccctaaagcacaaacatttccctaaatgtttgggctttctagctattgatgaaatcaaaacctcattggtcaataagatatgctgcagctgctgctgctactagtaccagtaccatgtgaagaggagctactccagcaggcttcggttacagattctactcgatcgatgaatgaatagattgtcaacacaacaaccacaccgaccagacgctagaaaggagaggagcacaaggctggaataccgtgtacaaccaattaatcaaatctcgatctctcccttcctctctctctctatgttttcttttttgtatgttttttccaaatggaattctcctttgctgtgaagtgccgggtgtcccgaatcaaaataatcacacccctgtacacaacacacacatacaggtacatgcattgatcgatacatacaccagaatccacgcgaaggagaagagaacaaatggaagcaaccgagcagtggatgtgtggggctactgctactaccctactactgtctctcttcttctcttctgagagtttctgacccatcaaatccctaaaagttgtgctctgatcgtaccactagtctgttagcgagggcattttcggaatccggccctgcccctgccacgggcagagccttttgttagttgtctcttggccttttcctgtgtcactatgcacacaacggacaggggctttcctgtcttttcctagctagcaatactagtactcctacctagtaatagtagctaattggacggctgagattggcgcggccggaagatcaacggcgcgccgtactgcgggtggagcagcatcagcacggtgggggcgtgcacgtaggtgggcgagagcgcgaggtcgaagcgctggaggaggacggccatggtgagcttggcctcgaggatggcgaggctctggccgatgcacatgcgggagcccagcccgaacgggatgaaggcgagcgggtgcttcgccgcgcgcgccgcgccgctggcgaacctcgccgggttgaactgggccgcgtcgggcccccacaaccgggcgtcgtggtggatcgccatgatcgggacgagcagctccgtgtcgcgcgggatatggatgcctccggcgtcgccgtcgccaccgccgccgagggtgacgtcgaacttggcgcggcggatggtggccaccgccggcgggtacaggcgcagcgtctcgttgaggatcatcccgagctggaagaagatgacagcgagaaccaacaaggtgagacttttgtcggcgtggaattacgggaatacccccactgggccatggatatggtttggtgtgcgtaccgtcttgagcttggggaggtggtccttggtggggagctcgccggcggcatcgccgcagacggcgaggacctcgcggcgggcgcggtcctgccagtccgggtgcatggcgagcagcacggtggcccatgtgagcaggttggtggtcgtctgcttgccggcgaagaagaaggtcttgcactcctccaccatgtcctccaccggcatcgtcctgtccacgccggcattgatcatgagccccagcaagtcgttgaagccgctgtcctgcttgtctttgagctcggtggtggtcttgtatttctcgccgccgtcgccgccactgcgccggccgatgagccggaccaggccgcgcctgatctccctgtacaggccccacgacatcctgttcttcttggtcggcaggaacctgttcgatcgaattccggcgccaaccgtgagcccaatttcggcgagaatgggcgaatcgtttgggagttttttgggttgttcgtggcgtgtaccgtacctgtatcccgggacgagcaccttgcggaaggcctcggaggcgaacgccatgaggcgggcctgcaagcggaacacgacgcggccggagtcgtagctgcggccgaacgtggcgcgcgtgatggcctcctccgccaccgcctggaaccactccgccacgtccacctccacctcgccgccgccggcgcacgccatggcgcgccacctctccgccagcgccgccaccgacctgccgacgtgcggcaccagccgctgcaagagagagacagagacagagcacgtgtcagccatcgtcgtcgtcgtcatcgcgggtgcgccccgatcgatcggaggatgaagaaacagaggagagactcacgttgaggttgtcggggtagaagccgggggtgaggacgcggcggtggtgagcccacttgtcgccgtggaggctgacgagcccgtcgccctccagctgccggaccacggggtgcgcctcgtagcggtcgaacgcctcggcgcgcgtgaggaagatctcccgcaccatcttcggctccgccaccgtgagccgcggtgtcggcccgaaccaaatcaagaacgtcggccctgcaaccgcgacgaccgccattaatccatctgatcagacacgagcaagcacacaaaatccatccgtcctcaacataccgtagatcttcctccagtagtggtagaacgcgagcacccttgggagcgcgttgtgcggcgcggcgggcggcatgggcttcgcggtggcctccgccatgagcgccaccatctccctcacgcacccgacgaggaaccggtacggggggccgcgcaccccctgccccgcgaagtgcgcctccagccgccttgggcgccaccacaccgagtgcgccaccctcgccgccacgtgcagcagcagcagcaccgccgccggcacgggcaccgcgctcatcatctcctcccctgtttcttgaaacagagcacacaaacgcagagagatcaggtcgccgccggtggttgcgccggtgagtggtggcggcggttgggttgggggtttggattcgaaatgggaaggcgaggatggcgggaggaggcgggggttatatagcgaagcggggcggcggaggtggggcccaccggcccagcacgatgatctgttggtggtggctgcttggtaaattcagatgggatggagagagaaaggggggaggcgtcaacgaggtaggtgaagtgtgagaaaaccgccttcagttcagctgaccgagcttgggggtgctgacgtggcattttcattctcttttttgtagaacaacattttcattcgttgcagttgggaaaaatgagaggaggggagtgaaggcaaggcttttgcttgcgtgtgctgcttactcttgagtgatcgaaagtttgtgatgtactctctcagccccaaataaacccaaataaacgcaggcataagtttttttttcaactttgatcatctgttttatttaatttttttataataatattttttattgctattagattataaaatataaataacattttatatgtgattatattttttagtgttttcaaaagaaaaatttaaataagacgaacgattaaagttggataaaaaactcatggctgcacttattttgggacggagggagtacttattatatgtgtctactatgtacttatgtcagctttatagtatttagtgcaaaaaaaattatattctaaaatttaaactggtttatctggtttttaatgtttaacattgtttattgactattcattatattgaaaaaattacgtgattattatttatttttgttgtgatttattttaataagatctatacttttgcatattacataattttttaataagataaatagatattttttaatgccaacagtcaacatcttcaaatattaaaaaccggatgaggttttttttttattatgtgaaagaatacatacatcgctattcgcacacacccgcggatacatcttctatcatctgctaaataaatgaaggtcagcacctctcgtctctcaatttctattgaaaaagcagctgcttccttagtaagtaaaaaataaaactactgcaccagagctatacaaagagagactaatcagctacaattaggaatggtgttaatacggttttcactgtaaccatgagaaacacgttccactgtttagtgcttgaatatatatatattggaaattgttttggatgttaatgtggtagggtagttcagaccagaccacaaaacttagtatgacccagcttgtccctgcctgtttacgcaggtcagaacacggtttgagcaggccgcttaatttgggatgtcttcctcctacctacatgtcctgatatgatgtggtttcttcaagatgcccaatgattgattcttcacctgctaataataattattaactctttgaagttgtgtgttgattgaaaacacccgatcgaataaatcttttgcttatttaaattatggatagcgctgtaccgagtccagtgattaggcatcacacttccattattagaaaaaaatctcaggtgctaattaaattctaaacattgtcccagtttggtcaacatctatggtaaattgattcatatgagctcatataactgagcgtatgcgcagatttggtagagtcgtatgtgtatgatttcactcgacaggttctaaaaatattaaagacaacaaattggttgtgttcattcctaattagcgcaaagacacaaagtttatacttgtattaaattatctgaaaaaaaacaaggtttcaaaattcaaatgataagtaggaactgtctgatactactagtatgcattttcttttcgcttgtgcatttaatcaactaattgttgtgctagtactttgcaaagtgacctgcatgcaaggacaaggagctctcaacaaagagtgacccaatataaatgtgacgtgcagcactcatttaatttttgtgcgagtacgtccagctttatttttatcgatcaaaattaaatctacgtcaaaaaatagctttcaaacttttttgtaggaaagaagctaggcattattattttctgcagaagacaaacagatcttcaccatcaaaaaggtcagagatgtcgacaagcaatccttacatacgagcccacatttttccacttcaccataccgtccaagtcacgctaagatcgagcattggagattttggtttcttacgcccccaaaaaccggacgagcaaacgtaagcatcaacaaacctcttaaaattaattacttctcgatgaaaacttatcgcccactactcacttttgctgtgaattaaatgtgcatctgttcatgtgtccaaagcaacatgtttttgagggagttcgttgaatcgatcgatcgattatatgtgggcaggttttaagaaaggattaaatgtgaaggccagtacagagaatgattcgattttcagtttggacaggtaatggccgttgcaggtagaagctgactagccatcgacgaggcaggcagagccacatgcagctcgagctggcgaggcaaccgtcgcatgcatgttcgttctaatagcttccatccgcttcgtatacaaattttgacaatttgaccctttgtaaaaactatttttataaataaatcgtcgccaaaacttattttaaaactgacccttttgttcagcgtcaaatcgtgtggcgctgaactttgcgtggcacgctgacttaacctcccatccgtggtggcacggcattcaacgccaaatagcatggcgctgaaatgaacattggcacgctgacttaacctcctatccacggtggcacggtattcagcgctagttgacgtggcgctgaagtgtctacgctcagcgccacacgatttgacgctgaaaaaaggatcatttttgaaataagttttggtggcggttcatttgtaaaattagttttttcaaagagtcaaatcgtcaaaatttgtgcgcttcgtaactcttgacattttaaaaaggaaaagtctatacgtactaactttttcttactaaatttttactaacactaatgtgtcgtgctatgagtacgtgcgtctagatttttttataacttccatctaataaaatcaaacggcggctgagatgatggttagtaaaagtttatagcagtgctctttacaaaaagttcgagatctttaactatcgataacttagaaaatatactaattagatcaacatagatttgtcttacaaaatactataataaaaataaaaatatttctatttagttatatattataataaaaaacatagttaaagtatactccatccgtcccaaaataaaccaactcgtactagaatgtgcaacaaatcgatatagagtatgtttaaatttgttgtactactagattgatttattttaaaataattgtaatactccctccgggctgggtttattagtcgttttggctcggttagctgtggatgagaaaatttgtcgttggagcatttttcccacgcatgagacgagattgcccttgtgcattgatggcgttattgttcccagataaccttcttgttactccttttaacgcttcgtttccatctcatttaattttcgcatgccctcgcgcgctatctgtactgaagctgcatgggctacactcatgcatggtgccatgcaaaattgccaagacaaaaaaaaaggtatgtatctagagcagaaatcgaactcaggtcccaagacaccaatatgaatgcactaaaccaactgagagagtagttgttggttgtttgcatgctacacctaaccgtttttaatagggataaaataggaaataagaaccatacttaatgacttcttggtttttgaaatcctgtccgaaacgactaataaacccagcccggagggagtatttttgtagatcatgtccgaagaaactagcttctcatactcatagaactacacaggtccgaacaaacctctctgaactgttgacgaccgaccaagtacacgcaatgacaccaaaaaaaaaatttatcaatggcctgtttcgtttggcccagaagtacacaaccgcgcgcgatgattgaccggccggctgcatatcgctgccgacgtcaacgtcgcgagctaagctaataagctagtagccaccacacgcactatcacaaaatatgtgatgcattgtgtacatttgcagactaaaattgcctacgtctctaaaataacaccagaaactcgtggaatatataacaacatagtccatatatctgtgataactagctttcttggttgaggccgaattaatcctctcttgaccaatcatcacggacgcgtacatatatagaagaatcatacttgtacacgatatatattggacacagacgcatgcctgtaaccaccgttctgatggacgctgctagctaacctatacccgtgtctgtgtgatgaacgttaaccccgtatgtaatcaacgattctggctgtgttctttgctcagtgttatcaactcatcttcctcatgttacacgcgtacgcttttcaacatgctaaacagtatgttgttttaaaaaatatttctatacaaaagttgtttaaaaaatcatattaattttttttaaaaaatagttaatagtacttaattaatcaaatgctattaatgaatcttttcgttttctatgcgcaggagaaacgaacccagccactgtgtgtggtggagccgtacgtggatcggtggatggatcgggctaagccggtgtgtgtgggcgtgcgtacgttgcgtcgcgcgatccggcgtacgtttctgcggggggccgtggaaagaggcgcgcaccgcggaacggtgccgggagggcgcggcgcgcgggcgggcacggagcaccacggttgggctccgcgccgtccgcgcgcggggaagtatattaaccaggcatacggcggttgttgcttgcggctgccgcgagctaacttgggcgaagttgcatgggtgggctgaacgagacagagatagatagggagagagctagctaggaacattcctgtgcatgcacgtctctctctctctctctctggttgagacctggccggcctcgatcctagtagtagacaaaccagcaacgagttgtacatgcatgcatgtgtgtactttgtatatagacgacatgatcaatacatgggggtatgaaacgatcgagtaacatgcaggataccatgtattgtcgtactaggtcatagtaatgccataaattaagttatgtgtctttgctactttgagatagatttcgttgcagcgacattttttttccgggggtgaggatatgccacaattgtccacatcttctttctcttctcccccctttaacatcggacatctctccattactagctttcactacgattgtcggcatccatatcctttcgtgtccccttccttttccacacctgcacccagtggcgaagccagaatttagggatagggggtgctggcacgagacgtaagaactcaccaacgtctcggtagacaatggtatggatcttggtgctcagatcctgcagagtggcagattggcctcacccagttgccttttgttcgctctaatatgcgtagtcacccctcgtataattatatttagaattttgtggttatttgtcgtttgcactaatatatacataaaatgattgttgatatgattttggatatatttcagcacattcttctagatttatatataaaattgaacttattatagaatggagcatgtatgttccgagtccgaatttactttaatatagcataacaagaaccatttttaaactatgtcactaaatagcaccaactttactcaatacttgaatgacacgatcgacatcatttctatttattctttttagttttggagacttgcaaccatatcgcttagttacgttaattaactcaggtgaacagctagatatatgctcaacttgcaactaattaatgagctaattgtatagattagatggctaatcacccggggtttgcatgtagcgcatggggatgggggtggcttcgccactgcttgcaccaccaaactcaccgctagccgctccttcacccttgcacggtgaacatgcgtggttttgcatacactatccctcaagttactgactccacgtctctcgcctcctgataatcggtgatgtgcttcccaggtgtggccgtttatgggctatactccttccatatatatagccattcgttgtgcgcctctcgggtctttcctacctcttgcatgaggaggagctccacacttgcattgcctcgagggatgatgttaggtgtgcgagtgtgacataggcgacagaagtcgtcgtgtttcagtggtgaattcgggcgctgtgctggtcaaagttgggcgagatggtggcaggagttggacgttgaggcaaggtgagaggaggaatattagtaagaaaagaaaacatgagtgattttggtacatggcattcagagtaaaagagagttatccccctaaagtttgtggtatttcttcacaaaatgaacaaacttcatggcaaatgagcaattttccattgtttaaaatatgcgaaaattccaacaaattaaaattaaagtagatgcaacaaacacttcaaaaaggagaagacaacacaaatataactgtgtgcatgtttgattgttactacggtatatctacttgattataggaaaaaaatacttttataaataaacataacaaaaaatttaaacaagtgaatctaagatatataatagaaatcaatacaatataagaaagctttttttaaagaaaatgtatttttcggagcatgggaaaacaatccatttcaacaattcgatcaatagatgatatgataagaacggagttatacttgttttgtaaaaagaatttgcatatagcaaaggatagatcaaggccaaagttcatgggtcggcgcaccaaatcaaataccatatgtcccgaataatttgtcgaccattgttgcgctatcaaaagtactcatcaatgacattcgaatattccatatgcttatacaacatgcaaatgctaggtcaacccattaaattcctccaatatgcagcattattggacaaagaggacccttggcatagggtacttttcacttgtatatcaagtcttgctatcaaactatcaagattcatgccatgcactaactacggttctcacgtagaaaggcacgaataaaattagtgcattctccgtccattaatctcagacgatgttgcgatatgtgtaatcaatgcgttcataaggatagaatatgcttgtgtataatggagtacctagatcaatttatttggaaagcaaataaggatggtttttttacggttaactccatgtacaaagtgcttatatataatgaagtgatgcctcgaaaaactttgatttggaagctcagaattctactgaaaattaacgtattcttgtggtatcttaaaaagggggtaattttaacaaaagataacctagctaagagaagatggagaggtagtctaagttgctgcttttataactctaaagagtcaatacaccatcttttctttgactgtcccatgcatggctaggtacatttagagtgcatgtttctttactttcggaattagccaaccccgtagcatggctcatatgtttggaaattggttgaatggtgttgaacctagacttaaaagacaaatttatatgggtattgcggcaattttgtgagctttgtggcttaataggaataatgtaatctttaatggctccaatcttatttatttcatgcaggtaatcttcagggggactcattgggcaagactttggtccttgcttctcaaagaggacgatggagatgctgtctaagtttattgtagaattttggagacgcgagtaatatagttttatgctacttatggctggaattttagaagaaaaattgaagcttaccttgctatgattcttaatatgggttatatctttatgtgatgttacccatgtatcgggatgagtcttatgtaaacttcgtaccttgtgttgtcccccatataacgggatgagtctcatgcactcttagaaacttgtttggctatgtacacctcataggtgtagttagggctgtcaacaagccgagctcgagcgagctcgtcagcctaggctcgagctcgatacaagctcgagccgagcctataaaatgttcgagctttccgacaggctcggctcgagctcaatcaagctcgagctcgactaccgagcttgatttttaagtaaaaaaatatatatttcaaagataatctttaaaaaatacttaatttctagtttatcatattaatagaagaggaagaaaaataaaataaatatattatgtcaatataagacatagaaataacatatttgatctcctaatttattaaataacaaaaaaatgacatattactaggctcgttagaagctcgagctcggctcgacaaagctcgcgagcttagggagaggcttaggcttggctcttctggagctcgagccgagctcgaatcgagcctaggacgagccgagctcaagcagctcgcgagcatcgagcttttttgacagccctaggtgtagtggccgggtttaatataaatccattattttaaaaataaggattgaatatacgtatgtgtattcatctacatttatttggtgaatgtgtctatgtatattgtgtttgaaaaaaaataaaaatattagctcactaggtagtaaacaggaactttttaatatattaattaatgttagacagttttaatatgcttaacgacatcttagtactctccctctcacaaataattagtactccaacctcgttttgagtttttttttcatgtcattttttttaaaagtttaactaagtttataaaaaaacgcaacaacatatttaacacataacaaacatattatcgtaatatattcaatgttatatctaataaaactaattcgatgctgtagatgttactaaatttttctatagatttagtaaaccctaaaaaagtttaactgaaaaaaaattaaaataacttaaaatataaaacagaggtagtatcatttcaaaacccgtgcagctaacatacatatgttcgctttgaccatatttattgtttatattcgtgtaatgaaaataacatggccaaatttgttactataacaaagcttataacacatacgtgactaattttttttatttatgcaaatgaattatgtggttaaattaagttatgtttgattgacttaaaaaaaagtctaaaacaacacttatttatgatcggagagagtacgaacgaaatacatatcacttatttatacagtatattaaaatttcgtactttcttgtgcgggtcattaaaaaaaacttatgcagtattataaatagtggagggtacgctgttcagggtacgatcctgggaacaaatacttaatcatccagaaaggccattcactttaatgagtgcatgacaattcgaggaaccgttacgttggaggatcaagaacttgttcttgtgtagcagtagtattattagtaccttctttgctgacttctgacggcattatattcagcttctgtagcttgtcaagctgtaacgacgatatgcaaagcctttctacgcgctatctgctttagctttgctttcttggccggccggcagagatcagtgtgaaaagcgaccaaaatgggagaatctaatctaattaatggccattttgttgattaattgattgtttcctctcgtaatgatgcatgttagctaatcaacgacaaagaaaaactacgtcttttgactcgacgacgtaaagtaggggtgtaagtgtaaccactactacgatgtaggagtacgcatgcaccggcagcagaaaaatgcaaaaggggaaaagtttgagagagagcaacacgctgaagaaacccatctgaattacagatacgcacataagcatacagatcagatcatgcaatagcctagccacctttagattagatgtacgaaataaaaacaaattcttttttttcgtaaatttcagaaatattttggtgttcagaatttcagagcttgtttggaaaattctgcagtggttgaatatctatgttaggtcagatgagaatttgataataaaccaagtttgactatggctgatgataagaggccattagcaatttagcagttttcttttgaatcaagaggtagcaccccatttccattaacggaaatgaggtacctacgagggatatatacttgcacgcatgcacctaatgaatcaatcgaattaaacttaaacctcccaaacattccaaaaaggaagacaattaattatgattaaacataccatacactgatacagaaaaacacgcgatatattaaaaggcattggcatcctacgcgtatacgcgttatattttggtgctacagatcatgagatatatatacgtgtagggccccatgcgtgcaagcagatgaacgaccggtcgacagaaagcgcagagggtcggcacgtatggacgcagcatgctggaatatcgaccgcacgaccgacgttaattaaccacccgagtccagcgttgatctctatctgacgacacaaaaaacatcggcatagtgcgtagcagcagtatatgtaggaatgtcgtgcatttggagtcaatgatctgcctgttcaacgacagcaaaatgccagggcatcttcagggatcaagatttctggtagcttagactactcgtgattctcgattttatagtgtttgtagtacgttctgcttgcataaaccgtgttaggtttgtgtctactttaggctgctttcgtttatatgggttcccaactctcctatttttcacgcgcacacttttcaaacagttaaatgatatgtttttttgtaaaaaatattctataggaaagttgttttaaaaaattatattaatcaatttttcaagttagttttagataatacttaattatgttttttcaatttttcgtgttggaagggaaggtttcaaaccgtagggtagaaaagtattgtgtacatgaaaaatacaagaatgtgaaaagaatttagatggagaacagaggattaaaaattaggggaattttaaatgggagcctcttttgatgggcattggaaccaagggaaggattctagtacgtaggaagtaaacagtaattcattttacgtatcttgatcattttgcgcctttgccccactgcttcgcaagccaatagcgtgagtagtgagagtctctgcttcttcgcctctgttcttcactgataattgcttaatgcttagcgcttgatttcctcgatcttacaaggaagaaatcgaaaaagatcggctgcttcccctgctctcatgcatccttctagggtcatttctctaccgcaacagcaatctaaaatgttactaatttattatattattaaaggaatagaaaaaaaagtctccacgttcgctctcatggcctagaaattctcacattaatcagagaaaaagaaaaaacagagtccatatagaaatacaatttagaaatagctgaaattcggaattaaaatataaggaatattagaagaagagactagagtccatatagaaatacaatttcgaaatagttgatattcggaattaaaaaataaggaatatttgaagaggagactagagtccatatagaaatacaattaggaaataactgaaattcgaaattaaaaataaggaatattagaagtagagtatagagtcgtagaaatataattataaaataactaaaattcgtaattaaaaataaagaatattagaagtagaggatagactctatatagaaatacaattaagaaaacaaaatagaaatttagaattaaaaaataaggaatattagaagtagagtatagagtccatataggaatttaaaactaactaaaatttggaataaacataataaaattaaaagtagagtttagagtccgtataaaaatacaatttataaataactaaaattcgaaattaagaaaaacatgggaagaagagtttaaagtcaatataggaatacaatttagaagtaactaaaattcaaaatttaaaattaaagaatattgaaagatgagtttagagtccacatacaaatacaattagaaataataaaaattcagaaataaatataaataatattggaagaagagcatagagtctatataaaaatacagtttacaaaaaattcggaattaaaaaattgaaatattaaaagacgagtctagagtccatataggaatatatataatttacaaataactaaaatttgatattaaaaataattaataactaacacgtatataaaatacaatataatattacacattagtattttgtaaagttattacaaaatttaaaattatattgtcattttaatatatttgaataatataatgagaaaacatatatgctattatttgagagaaaatataatgatgctagccgcgcaatctgcgcggaccaccatgctagttaatactgatgttataagctagtcaaaaaaatactgatgatatagggtacctagcaagcaatggggtaaggttatcgatcgatgaatgcatatcataaattttcaatgaaaagatagagcgaaaggatcacgatgtaaactcgtgaagagaatgattcgtgtacattgacacgtctgaattctgagaggaacaggcatgccatcaggtttcggccagccaaggacaggtaatcaaggccatctgtagtttttaaattctggacatttttaataaaactgaataaatccaaccttatttcattactccagtaaagaaatttacacagcagactagaagagcattcgcgttgattcattcatccagtaacgccaggagcaacctcagaaacaaatactaaaccagcttcatcctactctactgaatttcttaacacggccattaacaagtctatcatgatcacctaaagttcgagtcctaatctaagcatggcctccgatgagctcagtccatcagtccatcctcgtcctcgtccgggagaggcatcgccgcagcagcagctatctctgtctcaatcctgcgcccacaaagaattttgccagcataagacgaggaaaccaacatcgcagacaattcagagaagaatgatggtgagataatcttcgtgtaggagcacgctttgcaaaatgtttaactcacttttgctgcgcgatgaggtcgatggtgacgtcggcggggaggagggccaactcctcgacgaaccgaaggttcatgtccctgcattttgcaatcacacatcacccatattcacattgtcagacagattgttcagaatcagtgtagtgttaaaatcagggtaaatgtgcaatggttgtggtctgcaacaattaatcggagtgacaacaattaactatcaattaccctgtgagcttcctggcaaggtagaggaaaggcttctcgaagttgtagttgctcttggcagagatctcgtaatactggaggttcttcttcctgtggaaggtcaccatcttggccttcacctgcctgttcttcatgtccaccttgttgccgcacagcacgatcggtatgttgtcgcagaccctgatagacagatgcaagtctcgatcagttcaagacactgaagagaagaacaatttcaggatgatttgggagaagagagagctttcacctgcagatgtccttgtgccaggtgggaacgttcttgtacgtgagacgcgaggtgacatcaaacatgatgatcgcgcaatgaccatggatactgatgaaaaaagcaggagggataagtaaattctggttctacactgtacacatgagcaaaacaaaaataattctccgatcataataacatcatggcactaaattttttgagaagtttatttatgccgacaaatctagttccagtaaggatttctactgcttcttacataacattgaagacatttctgtcacttcgagagaagatttggggattaacagtcaagctatcgaggctactgaaaacataattgatctagatcctgagtactgcatcatgttcctggattatcacatactccatttgctataagagatgaatgttttgcaactaattaaaaagatctaatagtaaatagtcaccacatcagatcaacattcagtaatcaaatttccggggattcctatgaccaatgtgatttttcatcatggctgtaaacttgcagatacaaaagaacggtttctgctgcttcttgcatacttcctccgtttcacaatgtaagtcattatagcatttcccacattcatattgatgttaatgaatctagacatatatatctacctagattcattaacatcaatatgaatgtggaaaatactagaatgacttacattgtgaaacggagggagtaatatttaagtcatttcaatctgcttaggctgctcaaaacattgccgatataagatcccgaatacttgcatgcatattcctgaattaccagacaattgctaaaagatgaatgctttgcaactaaattgaaaacattcaacagtcaccatcctgatcctatggtcaatgtggttgttcacaggaattcatcatggtttcaaattcgcagaggcacaaaagatatgattgaaacgtctgaatctgacgcaataaattcttactagtatccatcacggaggccgccgaacttctcctggccggcggtgtcccagcagcagaaccgcaccttgccgcggctcgtgtggaagtccagtggccgcacctccaccccgatcgtcgctgcaaacaaacagatcaacaacaacaacaacgttaacaccttgccgcacgatgccacgatcgatctctcctcctcctccttcctcccaatccgacacaacagaatcaagcgggatcgacgacgagatcgcgcggtggtggtggggaagtgagccttacgttcgtagcgcttctcgaactccccggtgatgtgcctcttcacgaacgtcgtcttccctgcagagcaaaaacgggttgattaatcaggacgccgggatgcaaccgccgatcgaggcaccggaggagaagaagatcgaagaagaggaggagcgtgggcggctcaccggtgccgccatcgccgacgaggatgagcttgaaggaggggtaccccacggccgcggggtcagggagagcctgcgcacgcgacatcacatcacaaggaatccattactaatcaccacaagaacaacctcacaacaaatcaatgcggatcatccgaaatcccccaatcactcgcgatcgagacgaatcaacgatcccattatccaaaccccagcagcaagcagacgaatcaatcgaaacaaacccaccaaacaaaaaacatccatcacagtagagagagagagagaaccgcaccattccgaaccgagaaaccttcgcgagaaacctcttccgatcgatcgatcggcggcgacggcggtggtggcggcggcgacggcggtggcggcgacgaggcgggttggggcggcgaggcgagacgacggcgaggggttttatacgggcgtgggcgcgtggcttgcttgggttggacgcgaccaaccgccacgggggggtttagcttgaggtctaagcggcttctccgtagccgtcggatgtgcgcgtgggcaccgtatccaccgtacacgtgtccacctggtggaggcaacggtagcttttaccttacgcggcggagccgtttggggaagagaaggtggaggttagcttcgaattgacgccgagagatgtgggtaaacgcgagcgtcgcgccacgtgggctggccgctgactacgcggccccacatggcagaggcccaccaggagatccacgtgaatagatggcttttgggccaggattagtggacgtgggttttgggccacatgaataagggctcattttagatgggcggttcaagcccggcccatccatatggaccacatctggaccgggattggtatcatcacatgttaaggtgaactttctttaaaaaagaaaagaaaggtttgtgtcaaacgacacgagagattagctgattagggagagcgatattttatatggtggaatataaataaagctcgtttagttgctcggttcaatattggtctgtttgcaagagcttatggcagctcagcttttcatctaaaattctaagaagttatagtcataataagatcgagaccaacttgagcttatggcagctcagcttttcatctaaaattctaagaagttatagtcataagatcgagaccaacttctcaaaattttaagcttcccaaatatggccctgtttttctttcaaaataaaaactatttaatttgtcccccggatctaaaaaagaaaaaagggcgtggaaacagatagaaactcttgaatgaaaattgaaaagaaatgtagccccatttccgcttcggaaatggtaagatctttggcgcaagaagaaggggcgacccatattagcttgttaacgaaaacattctccattgtgatattggcagtttgatccaatatgggcgtaagttggcaacttatcctgatctacaaaatctgggctaaattgtgcacacacgagcagagggtggaaccaatccagtgaacaatatgaacttacatcacaccagcgagagattgatctaaaccttttcatttcacatcttgataatccaatgaaggaattctataactttaaaagaagctactgtaagatgttgaacgtttcccttctcgacatgttttaaggaatttacagcgatcaatgcatcgctggcgctgtttagcttcagctgtttaggcatatgacagggatgtcgagatgagagcttccttcacttccagagcttgcgcagggacatgttcttttcggtatccttcttcatcaccttcgccaccgccatcaagaaatcctcctggttgacatgaacccttctctcgcgaagggcaaacattcctgcttccgtgcagaccgcctgaaacccagaaaggtgaaaatcaaggtgagtaacttatgtacagtgatatagctgatagcatcaatatggagcacaacagatgcaaaatggagtgcattgtcatgcagcactaaaacaatgagcagactttttcatggtatttagcagttctcatataaatgttggttgtaccaactatatggatcaaaattataactgggcctggatttgtttcagttcatgatatttgtatcagcttgaaatgagaagtattttagaaaattggctcataagtgtcaactatacacaccttaagctctgctccagatgccccattcatcttctctgcaatctttttcagatcaatgccacgcatcaagttcatttttcttgaatgaatcttcaagatatcaaagcgggactgcaggagaaaaagatgcgattaagtaactaaagaactgatgacgagatgaagtagcatgaactctgctgcttgcagaaaaaaaaaagaagtgattgccacttacatcttcattcggatttggaaattcaatcttcctatcaatgcgaccaggcctcaggagagcttgatccaaaatatccatcctatttgtcgccataagaaccttaattttgtttgatgcttcaaagccatcaagttgattcagaagctcaagcatagtgcgttgaacctcactatcaccacccccagatcctgactgcattctagcagatccaatggagtctatttcatccataaagattatggatggtgcatgctctctgtcaaaattcaaaccaaagacgtcagcctactgaatagtgtaaagcaatgcaagcatccttcccaatgaaggattttcagatcccattgaatatatggtaaatttcaatgtatcatcaacagaaaatgtttacctggccatcacaaatagttcacgaaccattctggaaccctctccaatatacttctgaaccaactcggaacctgacaccctaataaaggtacagtcggtgtgatgagcaactgcccgagctagtagcgtttttcctgtacccggaggcccgtaaagaaggacaccctgcaaaaatcaaaggtgaatattttccactaataatgacagttgataccaaacaaaatgcaaactgataaacaagttctaacctttggctgggcaattccaagactttcaaacagctcaggatgcttaatgggaagctcaataacctctttgatctccttaatctgctgatcaaggccgccaatcatatcataagtagaatcaggaaccttctcaaccttcataagattaaccaatggatcaactttgctgggcaggataagatgaagcatatagctgtcatttcgaagagcaactcttgttgaaggcgagagctttgtaatatcaatacttttatcgacatcaacaacatattttccttctgggtgcacctgaaagattgcaattgatcaattaacacagaaagatttaccaaatgtttgatagaattactaaaaatttctgctctcataatacccacacgatatcgttgtgttagtgcaataattgcgtacattttaaagctattatcactatagtatgtcatatgaagtgaccatatagcacttcttcaagatctctatttaattgactgagtataaataattgcatctgcacactatagagtaaaaatatttctgctatttactattcgcaatcatacttttgtaaagctccctttcgggtgctaccaaaacaaatcgcagcttctatccaaatttaaaatatatgcagccatgatctgactaaaagaaaggtctcaccaacaaaatattatcttccccgattatctccaaagcaacactcatgtgcacaaatactaaaacacagcactaagaaaaggcaagaaagcaaaggatatgtaccttcactagaaccttggacttgcccataaccttgacaacctcaccaacatatgagcccggttcatggagcaccttcaactcttcccccagcgttataactgcaacatcaaaatcgcaaggagggaaaataaaataaaaatattagcacattataccgcaaagcacgaatcccaatacaaagaaagtctagaatcctactatcactacttcattcaacggcagaaacggggacgacgaacatagaaaccacataaaagatagaagtcttgatacaaaatcaagaacctctgagggggggattcacacgagacgggaaactagggttgcgagtaaacgcggcaagattaaaaccaaaccacgagacggattcgactgccccgcgcgcggggggagggggtcgtcgtttaccttgggaattgaggacgttccgctgggcctcgaggcggctgaggttgtccgtcccttggcggatctggagctgcaggtcgtggatgcgcgactggtagtacggccgcagcccgtcgccgcggaaggcgctccccttcgccccgtggccgtctgcccccgcagccgccgccgtcggcgcggaggaagaaggccgccaagacgtccgccgtcgccattgcttcgagttcgagggtttcgtttcgtctcgtctctttcgtcggaacgctgatcgagctcgcgttttgagagggccgctctcgacctgtgtttcgttcgtgttgggcttcgtgggcttttctcagggtcggtatttattgatgggctgtcacgccgacttggatgcgcagaggattggaaccccgatctccgtgcggttcgttttcgtttgggagaagtctatttgggctccgaatctgattcgtgttgcccaaatagaaaaccggatataacaattccttcaattattaaaacgatatgaaatgatttctaaggtagtattaagggtgatattgaatgaatgatgtggcgtctatatgacacccaatcactagataaaactaaaaagtactccctcattcctaaaatgtttgatgccgttgacttttttaaacatgtttgaccgttcgtcttattcaaaaacttttgtgaaatgtgtacataaaagtatatttaacaataaatcaaatgatagaagaagaattaataattacttaaattttttgaataagacgaatggtcaaacattttttaaaaagtcaacggcgtcaaatattttgagatggagggagtagatgtgagacccatatattagcactctttattcttctatcccctcttttttttcttttttttttctaaataaactacgtcggcagggtcacaagggatatatcataagagcagtggggcttgagccttttatcgtacatacatgcacggagggctatatagttttatatagttttgtttagtttgtttaaacccctgttattatttttttctgtatccaacactgcacgtcgttattgtggcgcacactcaccatcatatagaaagatcagacgttgtcgccatggtactcagtatagaaatggtactcagccgacaaggtgcgtgtcacccatcaggatagacgaacgggtatacttctacaaatatttctgaagatgggttactcctgcaaaatctctatacaaagaatgaataatttgaaaaaaaaagttgttggctctcttcagaaatactactaaaaaagatcataaaagaagtcccatgtggctacatcagcaagccatgtctaagctgacgcattagccacgtggagcagtatgtcacatcatttgataaactaatagataaatatacattagtgtacacaataaaattagcatgggttagcaaatatatttatcttagctaattttcttttcttattagtgcgattaatttaaaaataattatgataagatattattgttaaaatatatgtttatggccaagcttgagctcaaactgagcttgcttaaaaaaaagtggaatagcaatggctcgaacacggctcgagcttgagtggagcttgatggtcaattacgagcttgctggatctcggcctacttctaccctatattttttttcttctaccctataatttaccaattcatcttactcatccttcactcttatctaccctatctaccttataattcaccaactcatatactcatctttcactcttatctaccatataattcaccaactcatcttactcatctttcactcttgtacaatcttgcattcatcaacgtggtcaattttttctaggacgagcctaccgctcgggcgcccgatcgatttggagtaaaatcggcgtccgatttacgtgcaaaactactttaaattgaattttctcttaaattacttatccaaatcatgatccgattgcaccattaaattcgttgcaattaaatcttcaaaacaagaccacacatggatatattccgacgaaaaaaaattagcttattattaaattatttttaaatgttgcacgatgtttcaccaggtatatcggaattgtttcactaagtagatcgaaaatgtttcactcgtttaaatcagttattgttttaccttatataaaaacaatgtttcagcaaatagcgaaagaatgtttcagttcactgcaacatttgatctatatatagtgaaaaattataagtacactaggtgaaacatttttcggtgaaacaaaaaataaaatgaattcccttaatagggagtatctaaaatatgtggttttttttgttgcaatggaatatttcggttcactgcaacattagatctatacatagtgaaacattgtgagtacattaggtgaaacattttttgtggaacaaaaaataaaccaaattcccttaatagagggttttcaaaatatgtgggtttttttgttacaatgatagtggaagcagaaaacgcggtggaacctagagcctgcatgcacgcacttagggggagggcgcgctgggggagccgcccgatccagttcccccgcgccggttgcccggatataatcattctcattttttctatgttggatcaattaagcgaatgaaatctacttgttggtactgtttgtaccctttttatttggtagtatgatattaattgataagctatttaatatcattttcattttagtcttggtagcacggttgacaaaaataattatcggtcggtcagtacttggttctgtggtgatgagtcgtgagtcaaatagcatctaaaaaaggattctgcctaataattttcggaatgatgtcctgctctaatatttacccccattttttttatcccaggtttgacctctgtatttgagtgctgtctataattcattaagctacttttgcttacccttgtctgtctcttttgattgctgaaagttgatgtcctttttaaggccaagaaagagttcattctatctttgctgatgttggcactgaatgatgccattatatatgacaaggtatggtctctaagtggcttccttaatttacaactgaaccctgtccatatctctccataaatggtctaatgtaattaatttaactgagtcagtcagtctaatgggatagaagcactacaatactgtgtaatgcgtggagactatgaatcttttaagtttgatttttttatgttttctatggagggcatactaccatctatgtaatgtgcgaagacctatgaatcttaacatgtatttccgtaaccatctgtttagcttgctgcttgaaaattgtttttttcttcagatagaaagattgcaaatttatttcttgctgacatatgctatcctctgttttgatgcatatgtttcaatttcaagttctgcctctaaaattaaactgaacttttactatttaatgactatggagtcctgatagctgtcaaaaagttaaggtgttataaaaaatgctacctgaactatagggtgagatcagaatgtttaggtcatactgcttcattaaaatttcaaagatgtaaagaactactgataatgcattaggggatttggctaggatttggagaagctggttcttgtgaggatttggtttttcctttgaatctggtgaaatgtgataagagatttggctaggatttggatttctatttgaatttgttgacatgttatggagattttgctaggatttacactgatattctcattttgaaatgcctctactcaaatcctcccccccacccccgctcactaaaaccatgcaattttggacatacgcttcctcgtcgatattaagtagtgcatatcaattgttcctatatttaaataataggatgtaatttcactttgaattaaaatatacgtaatttcctaaatattatttatgatattttgttactttgcttagaaggcttaattatttttttgtgcatcaggacatgaatattgtatgcgggagttcataacctctcaaaactagaaaagaaacccgcgcacgtgcgcgggcaccttatttgttgtttatagaaataatgttaatataattaagtcatatatcactatatgcatataagaaattatagatatgtcttatataatacattaagctcactatattaagaatatttatatatttagaaagaagagttgattataaatatttaggtatgtatgtagtggagattaatgttttatgtatgaattattaaaatggcatctgcaacaatgataattagtaatggtgacaataggcgagtttacgtgtaatctaaacaaaagttatttttgtttgaatagaagaaacattttatcgtttattaaagtctacggtctatttcacgacatatatctttttaattataaggcgaaatctataatttattttatgcatatagtgagatatgacttaattctattaacattatttcaataaacaataaataaggtgcatgcacatctacacggccttcctttctagtttgttttcgtcacctattgttcataatgggtccatcaatttaaataaaaatcgatggtgagattacgtagtgccacgtagcagtctaagagtgcttgtagaagtgcaacgtgaccatatttgtgaagcaataaataaattttattttatagtatagaaaattctattttaaaaatatcgtctatttttccacgatggttctcacatgtacatatatatttttgtttaaggttttatatctttttataccgtacgcacgtacctttttttcaaatgaacaataggtaaaggtttttttttcccatcgtacgtttttccggtaaacagtacgtacgtctttgcttttttttttttcaaatgaacacgtaaaggtatactttttttcccatcatacattcatacgtttttcgtattctccttttttaggtaagtaatcggattctgtgtacacacagaaagcataaacttattttaaataaacgatacactaatttaaatgaaaattgacggtgaaattatagaataccacgtggcaacctaggagtgctggtaggagcgtcacatgacggcttaggagcagaaaattaatgaacttttagtatataatagatagatagactagaaaaatacccgtgcattgcaacgggtaaatgctaaatgctattttaattttattattgttatacggtttgtctagggtaaaattcactctgagaattcgctcggttattttttcagaaaatcataagctgcagttaggcttccgtatttcatctcaagttagcatgcgagtttttttaaaaaatttcttatacgaagcttaaaatccaactcaaacacggatctgtattttaaaaaatgaacgagcttaaaaaccgattcaaatgcggatgacgtaccaaaatatcgacaaaaacatcttcaatctttacctagaaaagatacccgtgcattgcaacgggacaacctaaaattaaatataaagatggttatagtttatttttgtgatgtgagatctttaagaaacacatattcttcattgaatgttccagtgccttaatatattcacctgacctcaccacatcgaatgagatcaatcgagaagggaggaaatgcaaatagacaaggagagaatagcgtcgtccatagatagctaagcgatacggtcgtgtggaagaagagagacagggtgattatatgtcagcagaggaagttggcgccatatgtggagagagcaagaagagaggagaatattacagtgataagcggggatgtgccgatgacagatgaagatgtaccagaaattaagaaaataaaaaaaaaagaaaaatatgtgctagctatttttttaaaaaaacattattacatatgcaacgggtgtatcagcgaaagaaaaataatcaatagctaaaagtggtttagcgaaaaatgcacaacacaaaagtcacatgaaaaatgtatgtgttgacaaaattatcaaatttaccatacatatataatatctcatctaatatgggttataccaagatgattggtgaatgtagagaataaanntaatatgaannaatcgtaggcangtggngcatgcaagagcccaagagcatatgnctatgccgtgtgtccaaagagaaaatagctgtgatggagtagagaacacgctgtatctcgagaagacgggcttgcatgtgcgaagccgaacaaaaccgcagatacgagaa

SEQ ID NO: 9964 - DNA, 26442 bp, Oryza sativa
  unsure (1)..(26442): unsure at all n locations
gacgggnaatgattgccncctcgcagnagcncatcactcggagaggagcgtggctgcgatgtgcggaaagccggaaacaaaaaccgacacgatacggagaaaattaatcggatgacgtatgaattttttttttttgacaaaaacaccttgaatctatctatctatctatctatctatctatctattatattattaaaacagctttaaaaggaggcaccacgttcgctgtgggagctagaaattcccacattaatcagagaaaaagaaaaaaaagaaaaggagagtctaagtagaagtacaatttaaaatagctgaaattcggaattaaaaataaggaatattgaaataagtttccatataagaatctaatacgagattaatcaaaattaaaaacaaaaataatataaaatccaaaattagaaaaggaaatgagagtacaagtaggaatacaatttaaaaatagctgaaattcgaaattaaaaataaggaataataaaagaagagtccatataagaacccaatacgagattaattaaaatttgaaataaaaataaataaatccgaaattagcaaaagaaaataaaagaagagttcatgaaggaatacagtttaaaattagctgaaattcagaattaaaaataagcaatattgaaagaagaatccatataagaacccaatatgagattaattaaaattgagaataaaaataaaataatatctaaaattagaaaaaattaaaagaaaattcaagtaggaatacaattttaaaacaactaaaattgaaaataaaaaataaaaacattaaaagaacacaatacgatattaactaatttttaaaaaaaattctgaaatttgaaaaataaaaataagatttcaattagttatacaatttataaataactaaaatttgtgataaaaataaagattattaaaagaaaagaccatataaaacacatgacgagataaattaagtaacatgcctataaaggagtagagtggtggcggttgatacgagatataacaattgttaataaaacaccaaatagaatcctaatgacaattaaaagaagggacgtcaggcatgccgtgaagcaaacgagtaagacggttgcctggacttttagaaagtaaaaaaaaaaccccattgataatcatattcaatttttaaaatctcagtgacaataaaaaggagaagcagcgggcggggtgtataagagtatagttgcagagccgccgacggttgacgggacttctagaaaataaaaaatgaattcaaatgatagttatgtttgatttttagaatcataataacagtaaagagttggtggcggacgggctgtagagggacatagtgacatcgtttgatgggacttctaaaagttatgaaaaatgaaactacaagtccaatttttaaaggtttggaacttccaaaaagtaaaaaagaaccaatggtaatcatgttcgattttaaaatctcaatgacaataaaaaaggaaggcatagggcgagccgtagaggagtacaatggcaaagccgctgacggtttggcgggacttttagaaagtaaaaatgaacccaaacaataattatgttcgatttttaaaatctcaatgacaataaagagaagagatagtggacgggccgtagaggagtataatggcaacgtttgacgggacattttgaaattataaaaatgaaacccaatgtgacaataaactctaaaaactataaaatccaatttttaaaggttccaaaaagaatgaatagaaataatggtagatcgagcaagcaaataaagaaggagatgatataaggggtagcaattggtgtgacttttaaaaactatataattagaaacatgaggatgataaggtttcgtctttcaaagtcttaagacaatgagataactatttaataaattttaagtaaaaatcatacaaaaaaatatatgattttgtttgggtgctagccgcgcaattgcgcaggccacctagctagtttttataatagtaaagatatggtctcagattatgtcatacttattgactttcactgatgaaatgggtacatcttatctgatttgggaacacagtaacacaatattcgattgtcatttgtataaagctgatagtatgcgccgggtatactaattgatttttttgtggatgggtgcataaccgcagtctacaggtcatcagcagatgtatcaacgaggggagtctgtcctaattttttaacgggcgcctcaatctgcatatcaatggccttttgaaaacctttaaatcttcaaggataggaagacaactgagcttccaaaataagaggatgctcncgtgctgtacgctaagtgatgatgggaatttgcacaagggctttgagtaattcatggtttgttttctgactgatgtgatgagattaattaagccatatgtatttgtcccttctgatggccatcaacaactcaagtacttttgccattgtgagctctagcatcactcattcatgtatgttcttggttgttttatgcacactgcctaaggccttaattagctgtatttgttatacttagattatacatgtcagataatggggaccacttcattccctgtcttgccaatgaggagcgtggattattttactataaaagtattgcctggatttctcgatgtactgtaaaatagtatcgcttgtgtactattttgtcgagaaacatttatgtattttattacgctggtattacctgactactaactgaaaattgcttgaggctatcccggtgaaaaagtgaatgctaaagctgattgcttgttttcagtttcgaattgtatatgcaaatgtgtgcataactctctctacaagtttgggggtcttcagacataaactgtagcgtgtatttctattataagtaatataaggtttcatggtcgtttggcacttaaattaaacactacaaagaatttgataaattcaacactccgagcaatatagataatttggataaattaaatactccatatcagaattgagtaaacaaatacacgtacttaccttcctcgccacatattaaagttttctaaagtttattgtttttacatcattctaagcttagttgtcaaagcatatattgtcttttgacatcaatatagtcacatcgttagcacgtgcatattaactagcactagtgaatcacacaagcaatacatcgacgtcaaccacgtagaactgtcactcgtgcatcgatgtatattttgaaaaatgtacattaactaatgtttgtagaacttacattgaggcatgatggagagggactaatccaaatggctgagatgtggcagagaggaaaaatctctagctatgttgcatctcctttggaaagaaaagaaaaaagtcaggttgttccatttgcacccttaaattttaattagtcattataataaatgcacttacctaccaggttgcttccatcgaatcctcaggctttaattagtagtatatgtatgtatatgtaaatacaccacatactagtttttttattactctaaacacattttaattactctttactccctcctttctactcagagagtaaaatataaggatttttggatggatgagatttacaaatctataggcagatatgatatgtcttgtctatccaaaatcacttatttccttcgtcttaaaaaaaaagacaatctaggtggggacctcttctgtgtccaaattcattgcactagcaggatcatatctattttagattgtcttttttttttaaaggtgggagtatatttaggatggagcctggagtgaccttggaaacccggtaaggtagcaccaactggcagctgttatgtatactaggtccctctcagtctctcaggggtcccctttgttaacaatatgccatcgatcgagttcgtaatagtatacagcaaatgtccaacacattaagaattaatctctctgcgcgcctccgcctcttcgatcgatcgacgcaattaaaaacggggaaagtgagaatgtggaggtcgttggataacgtaccagtgcaaacctagctagccactgcacaggaccggccggatgatcaaattcattgttgttgttgagctcgcctaattaataaagcgatcatcccgcactaagagctggtttaatagtatagccagtaacgggctacagaaactccaactcagaaaaaaaatattttctcacagtctattctctctcattgaggatattgggaagcgtgcaaatggtgagaaaagtttgcagctgcagcatgcatggacgatgattggtcatgatgctttttctacggctgcagcccggcgatagattaaacgccagctactatctctcttctattttctcactcttccacgtaggatttatgttagatgaatagtacacgctctaattattgtacctgctctaattattccagatcacaacttggtacacgttccgtctcctagctaggcaccgacgcacctggcactgcagcatatatgaagccttatttaattagcttgtatatgagctgtgtgtatatatgaaagtctttactgcgcctatatatatgcactgctcacagcgcatgactgcatgtctctgcatgagcagctagctaacgcatagtatatagctgatccaatggctgatggggcgatgcgctaccttggacggaggatcaacaacgaccagcaacagggtggacgcggcgccgtcgcgtggattgtccaccggcgccggctgctactcgactccggccgtgccatgatgctactcggcgccatcgtcctcactagccgccagctgatcatcaccacgagcagcggggccacgcacagcgtcgacgccgagctgtatcatgcgtacgacgtcgtcttggtggcgttcctcctgtggctgctcggcgtggcgctcgcgacgctgtcgctcgtcgcgccgcgcgcgcagctcccggggctcgcgttcgccaacgccgccgtcgcgatggcgctccgcaaccacattcttcgcgacctctagttcctcattcaccacgcgccatgtatgataatatacttgctccgtctctaaatatttaacatcgttgacttttttaaatatgtttgactgttcgtcttatttaaaaactaatgtgaaatttgatgcttgtgaattcagtttgtgtagtcttttgttgcgggtggggtaatatctggggaatgttgtgttcctgtgagatgtctgcagggtgtgcaaatgttcctgagagaaccagtgctctgtgctggcgtttgttttacgttctgttcgtagttttctttctgttttttataagactctgtatgttgttttgggctttcttctaaagtcgggtcaatgaaaatttgatttgcttaaattttttttattgtgaaatatgtaaaactatatgtatacataaaagtatatttaacaatgagaaaagaattaataattacgtaatttttttaataagacgaacggtcgaacatgtttaaaaaagtcaatggcgccaaatatttagggacggagggagtatatactacctccagtttttaatatatgttgccgttgactttttatcacacgtttaaccattcgtttattttttaaaaaatacgtaattataatttattttattgtgaattattttatcacttaaagtacttttaagcatgatttatatcttatatatttgcataaaatttttaaataaaataaatagtcaaacatgtgtttaaaaatcaacatcatcatctattaaaaaacggaggaaatatttaaatatgggcttcttgctaattagccccctgatctactcgtttcatacttccaaaattcaagtcacatgccggtgtactctaataaaatactccaagtgccatgtttaattttctctgtttagctacatgtaaacaaacttatgttgtttccattatttttatgcctttcaagaataagtaccttcaactactcttcaactcttacgttcccctcgattacttcttatagtttgtctcctaataacttcaaaatcaggtaatatccaatatatatactctctcctttcatatttatttgtcggttttgatccagagtgcccgatcaactttaatcattacttttaattggtgtcaaatcgaataggtttaagtgtaaggtattagtaaatcacttgagattacaaacaactttgatgctaaaataaatatttaaaaatattgttgattaatgcttgttacttcaaaatcaaaactaacatttttttctgaatggagagatgtgacatcatagttcaattaggatgtggttttttggttcatgagtacttcgtgcactttattagtgccacagctgagaaaaagttgttaacgcgaaaaacacgaaggccatgaggcgtgtcagtcagtttgattttgcatttgacaagatgaataaattgatgatcaaaaagctgatgggccaataagtcgatgtagcaatactagccaacgtcgacaaagttttgaacaatcggctatatatctaatgtagattctaacatttaaataaagacaatggaagaacttgaacaaacaatctaatcagccgatgataatatgatgaagtagacgtccaatgaactaatcgaccgatattgatatacaatattaaatataggcttaatggttaaagcatacattggttggaagtccgacgtaaagataatttattagctagcactctgataaaacgtactacctccgtcccacaatagttgtctttctaggattcaaaatatgtcccaatatacttgtcactacaaagtactagttttcccattcattccttcatattcaaatttcttccttttctacccttaaactactactccactcctaaccatacaccatttaatgtggggtattatagtcttttttttgcaaacattagtccatactaaactacctagaatgacaagtattttgggatggagggagtagcataaatctataaacttagcaagacttaaattataagcagtaatataagatcgaacctaactaaaacagttttagattacgtctgatcaaataagttagataaatcgatagatctatgttaacgtgatggatataacaaatctatttaaaacaacattatgattgcagagatatatcgactaagacagaaatttggacctaaccgagatagtcccaactatactggtacgtctttaaacacaatgcaattaaagatagcattgagatatcatgtaggcaactataccaaccgaatcataccaatccaaaagatcgaagcgatgcagccttgaaaaatgccaatataaccgatacaattgcgatgcagccccccgacaggtgccaggttctgccaatgataaaacctcggaaaagagggtggcgatgtgccgaaaataatatggaataaggtcaaatccaattaatgggaatgtgattatgtttaaaatatggtcataattcggtatattttaatccaaaatagcgataataaacattacattcgcaatgtgatttgatttagtgacattgctagatgtaacaaacatgagcatgctttttataatataagcattaacatagacaggacaatgcaataacattgtgactaacagtagaacaaatggtaacagaaaagaggaatctaacattagaacttgaagaaataatgtaagaaggttataccccgagaatggccctctgataaatttatactcttaaaactatcagaatttttattttttgttatgactaaaatataacaaatttgaggttgatactttataatcctattaaaagtatttgtataaattttttggaaaaatttgctatatgatatcaaaaaaatgtgtaattagctgggagacaccgcaagaacacgtatctgctataggacaatgtaaaaaactggtaattagctgttggacatccattggattattttattatatccagaggaattggagagagaagcagctatgttagtacgagtctacccttcgatttttttctttttctttattcttccttattcttttctctctctcattctttatctttctctctctgctctttctttagtgagcttgagggagagggggagcgttggcgacggcgccgccaggtgcgggccggtgcaacacctcggttggggcggcgctgcgcgggtggccaggctcggcgggcacaaccacgctaggagtgtggcggctccgggtcagcttcgggaggctagaccggatggtgccaaggtggccaccggtggcggcacggcgaggttcaagttgtcgccgcgggcgctcttcttgtgcgggatctttagcaccttcacgtacctggcgtcagctcgatggtggcgcccaacaactatgtcgtggcggggatgagtgggacatgggtggatcgggcacgccgtgcaacggtgttgtggcggtgccgatggttgtggaggtagtagcgtcgccggttgtggaggcggtggcaccggcggtgaagctgagtagtcatcatcaggagcagaggaggcaacaacatcagcaacagtgcagaggagcgtcaggctgtcatcgtcgtcgtcttcgtttttggtgtgagcaggaggtggtggtgggggtacgatgtgatgagcgcggaggagaagttcccggcgggggaggtggtggcggccctgcggatggtggagagggggatggagtcgacaaccagggtggtgccggtcgccatcgtcaccggggttgtggtgtctgtgcaggagccgacgatggcgaggtttgcggcaaaggtgctgctagatgtgggggcccacgttggattcatttgagccaagagcaaacttgtctttaatgattgtttctctctactattcccccgaaaataataaaataatgtcacgaatgtccaacagttaattactatttttttgcgataccctacctaattacatgttttttggatctcatgtaccaaattttaccaatttttttctagattttgtttgataaaattttttaatccatgtgcatgatctgtccaccaagtatggttaatggacaatccatcacttttatcaattcacccccatccccatatacgctctcccccccttctcctccccttctcctccccttcttatcttcctactacaccataaatttttaaaaaataaaaaaacaaagttgaaaaaaattatgtatagaaatactatttataaaacatatttgaatttaaatttaaatttaaaacgggtatgtaaacttttgacttataaactttgggtctataaactttaggtgtataaactttagatgtatagaaatactatatataaaaaatatgtgaattcaaattcaaatttgaatcagatataattcaaatttaaatttgaatcgggtatgtaaccttttgacttataaactttggatctataaacttaggtgtataaactttagatgtatagaaataccatatataaaaaatatttgaattaaattcaaatttgaatcggatatataaacttttgacttgtaaactttggatctctaaactttagatgtataaactttagatgtataaactttagatgtgtaaaattgggatgtataaactttaggtgtataaatttactaaaaatagaaaagtaatatggtaaaaaaaaggaaaccacatgtaggaagtggtaatcgatgtgagggaggggaaccgatcgctcaccgatcgcctcttaggactttcagtgtgcacaggatatgtttcagggtaagatatagaatggcgcgtgacaatcactttcaagatggatcttatgtaagggcctgttctgtacccatatggccgatggctataaaaccacagccgctgcactgcaacattcatagcatagtttttctacaagtcactgtagatacagctacaaccacagccacaagatgatgaaccgaacaagccaagggtaaatgcataatggagcggacaagcagtgtctagcgtggttctgtcccctcccgctgattgcgtttatatgtcgtatgaaattgcgttgtatatcaaattttttttcttctaatatattgacgtgcaatctttttacgcgttcgtgaaaaagaacggataagcatgagtacattttgtattttttacacttattctgagcacaactgtaatttaattattcaaaagtgtccaatcccaagtttagctatttcgggcaacactctattaactcaatagccacacaagcgctgcctgcagctatggcagatgaggggcacgagggccagcggccgatctacagcccggtgacccgacgaggcacaggatcattgggtaaacgtgcaatagaaattgaattttttcgataagttaaaaacaatttatttatagtaaaacgcatgataaaataagatttacttagaccctgaatttttttctggatctaccactatacgaggcaatgcgctatctcggatgcatcaaccagattgagatcctctgcaatcgacttcaccatgcctttatcactaatatatgggtccgacgacacatcgggcccacatgtcagtgacaaaagcacggtgcattgactgcagaggatcctgatcccgcatcaaccaccacaagcatcgtcgccgcgccattgcaatcaccagcggctgctgctgctgctcctcctccagctcggctctggctgtaccttcacgctgcaatgcctgtccacgccgagccctaccgtcctcgtcgtgctcctcctgcggctgctcggcgctgcgctggccatggtgtcgcttctcgccgagcgatgcgccccgctctcgctgtagccaatgccgccattgccacggagccgcgcagttacctgtttgttgctagcctcttgcctcttgtagttcagccatccgccgtttccagcgatcatagttctctccgctctctgctgtcttgagtatgaaaatgaaaatgaaacaaataatatgccatatgaagtgtacacatagcagttcttgaaggttctgttacgagcaatagtgagagggaaagagagataggaagtttcagagttagaattggaaagaactgggttagaacagcgaagaactcggacttgatttcagagagaatattgtttcaatacagttcaatcctccacacacacatgggcttcctatttatagactcagccacactactggacccaatcctttcccttcacacgcggattgtcgcgtctctctcgcttgggccgacctgtatcagatggcccacttggcttgaaccttgtcttcgcgcaagaagatgatgtagtagcttctggcgtcacattcctcccttcttgagaaccagcttgaccccaagctggcgctgccggaaacttgtgacgcaactcctcgaaattttcccaagtaatggctggagaagatgcaccaacccactcaacctgaacttgttcaataagtttggcacccctctatcgaagacatcggtccagcaccttattaggaacagcaaattgaccaagttcagaattcaaagtaggaagagatggctgcactttttcagctggagccaatgctttcttgagttgtgtgagacatgaacaaccggatgaatgagactagtgacaggtagattcaacttgtaagccacactgccaactctctgaacaatttgaaatggtccataaaacttaaaggacaacttccgattagcccgtgtcatgacagattgttgaacatagggttgcagctttaagaacacccaatccccaacagcaaacgatctttcagagcgatgcaaatctgcttgatgtttcatacgctgttgagctcggagtaaatgatgatgaatcaaagcactcatattattacgatctgtcagccaagctgccaaactatctggagcatcaacagaggcaatggataacccaaaatacgaaggtttatgaccaaaaagagcttcaaaaggagtcatagcaatagcagagtgatatgaagagttataccaaaactgagcaaggcccaaccaatgtttccattgccgtggacaagtgtgaacaaaacaacgaagaaatgttttgagacattgattcacacgttccgtttgtccgtcagtttgaggatgatatgatgagctcatgcgcaattgagtaccagccctcctgaacaattctttccacaatgcactagtgaacacgcgatcccgatcagatataatagcacaaggcaaaccatgaatacaatgcacctgatccatgaacagttgagcgactgacaaagctgtgtaaggatgtcgaagtgccaaaaaatgtgcaaacttggaaaacttgtcaacgatgaccaagatcacattgcaagaagctgataatggcagacgttcgataaaatccatcgagatgatctgccaagcatgatcaggaacctccaaaggttgcagcaaaccaggcaatttaacatgttcagattttgctctttgacaaatatcacaagtctgaacaaatgagtgaacagattgtctcaaacctggccaagcaaacaactgtttcaccctctgataagtggccaaattccctgaatgaccacctacagcagcagtatgaagatttgctagaatctgttgctgcaaaggaatattatcgccaatccaaattcgtttcttaaagtacagaatctcagactgcaactcaaaattagcatgatgcttcccattgtttgccaaggatttgagaatacactgggtatcagggtcagtgacataacctgaaggaacatcctgaagccaggaaggaatgctgaccgacaaagcagaaacctcaacagtatgggccggcaattggcgagacagagcatctgtagcattattctccaaacctttttttatatacaatgcgataacgcaagcccatcaacttggtgagtgccttttgttgccaagttgtagacaaacgctgattctccaaataagccaaactgcgatgatctgtcctaataacgaattctgcatgttgtaaataggaacgccagtgatccacagccaacataatagctaaactttctttttcatatgtggaaagacactgtgcgcgaggaccaagagctttactcaagaacgcaacaggaaggtcaacttgcattaaaactgcactgattcctttgtcagatgcatcagtttcaacgacaaattgtttatgaaaatctggcatagctagaactggggttgatatcaaggctgattttagagtaagaaatgcttcctcatgaactgatgtccaaacaaacaactgtcctttcttcaacaaatcagtcaaaggtttgcaaatgatgccataattacgcacaaatttgcgatagtatcctgataaacctaagaaactccgtaattctttgactgaagatggtgtgttccaatttttgacagccacaattttctcttcatccgtagccacaccttgagcactaatcacatgtcccaaataagctaattgaggttgagcaaaggaacacttagattgtttgactttcaactgatgctcagtcagaatttgcaagacacagctcaaatgcaattcatgatctgccaaagtctgactatataccaaaatgtcatccacaaaaactaggacactttggcgcagatgtgtggccaaaccagagttcatcacaccttcaaatgtagccggagtgctagtaagaccaaaaggaagaacgcgaaactcaaaatgaccatgatgtgtcttaaaagctgttttgtgttcatcattaggatgcatttgaatttgatgataacccgaacgaagatccaatttagaaaaccaacatgcaccagctaactcatccaataactcatcgattataggcaaaggatatttgtttttgactgttaaagcattgagatgacgataatcaacacaaaaccgccatgaaccatccttctttttaaccaaaagaaccggtgaagaaaaaggactggagctatgtttaatgatacctctgtctagcatgtcagcaacttgtctctcgatttcatctttttgcaaaggagtgtatcgatatggccgaacgttaacaggctgagttcctggaattaaaggaatggtgtgatcacaatcacgagttggtggaagtccttgcggttcgtcaaacacagcagcaaattcttgtaacaattgctgaatgttagcaggaattggcatggactgacttccttctgattccaaagcctgtaaccgaaccaatccttcaatggatcccgacaagtgaagttgatgtaactcaatagcagataatactgaatcagaagccacagatggaaccactccacataaagtcactagctggtcatccatatgaaatcttataattttctgttgccaatcaatatccatgggactatattgttccaaccaatccatccctaaaatcatatcataactttgaagtggcaacactttcaaagtagaagtaaattgttgaccttgaattgaccaaggtactctagccaattcagactgacattgaagtgtttgcccattagccacctttacttgaaaaaatacatgcaactgtaacagatctaacaaatgagaaactacagatgaactgataaaactgcaagaacagcctgaatccactagaataagcacagcataaccctgaataacatcttgcaagtgcattgtttgagccacagtagtgccctgaatagcatgaaccgacaatgccaacaaaggagtagtatcaagttcatcagatgaagaattaccattgtcactgtcatcttgatgaagaatcgcaaacacttcctgaacagcattcaattgcacagagcctgaacatttatgagatggagaccatttatctgcacacaaatagcataagccctgtgctctccgaaaagccttgagtgcccgcaccttgtcagtaattaaattggacttgatagattcagaagacaatttagcagcaatggagatgattccacttttgatggtggtaaaggcaatggataagctcccttaacatgctgcacattatcccccactttgcgaaattccttcggcttctgagtttccaaccattcctcctgtaaacaagcaacggcaagagcagtctcgagatcgcggggtcgttgtaacataacagcatgatgaatttcagatcgtaattcctcagtgaacctatgcacaatcgtaagaggattgtacataggatcataggctagcaactggttcatcaaatcatcaaatcgctcataaaactcttccaccgaccccatttgcttaacctgctctatctgacgaattaacatctgatgcctatcacgatcaaattttctatccactgctaaacaaaattcagtccactccccaaaacgcaaatgagcctttgaagaacgcaaccacgatgctgctcttcccatgaaaaaaatggtggccacacgaacccaaagcataggatgagtaccataaaccccaaaataatgctcgcatctcatacgccaattctgcggatccaccccatcaaactgtggaaaatccaacttcggcacccgatgattataaccccgctcctccgaaactccaatctcatcccgagaaaaagaatccatagcagaacgagaattaaaaggagaacaggtcgtacccgtgaccggaggtagcacagaaggagtaacaactcccagtgctttcccccggtgatttgtggcaacgcggtggacatctgggcccgaatcaccagccgacgttaatgcgatgaacgacgcgggcgtgggaagcagaggaagaggtctatcaacctcgtcgctccgcctctgtgctgatgaagctactacacgcgacatgttcgacgaattgccaaactcgccgcgaaatttttccaggatcaccacttgattcttcagctcgttcatcttagctcgaagtcccttgactgctgcatccacttgtggtcgccgactggtcatcgcttgatccaacttgagcaccaccgcctgtgtctcgtcctgcttcaacaccacggcgtcgatggcgttctggattccctcgagcatcttctcgaattccccagcttgcttctccatggcgtccacttgaagttgcaaccgagtctgaaactttggcttctccgggatggaaacggctctgataccaagatgttacgagcaatcgtgagagggaaagagagataggaagtttcagagttagaattggaaagaactgggttagaacagcgaagaactcggacttggagagagggggaaaggattctgggatttcagagagaatattgtttcaatacagtttaatcctccacacacacatgggcttcctatttatagactcaggcacactactggacccaatcctttcccttcacacgcagattgtcgcgtctctctcgcttgggccgacctgtatcagacggtccacttggcttgaaccttttcttcacgcaagaagatgatgtagtagcttctggcgtgacaggttcctgcttaattcactgattactaatgatcgcatctgcagattacatagggagaaaaacaacatggctatttactttcagcatatcatatttctgtatagctcagctcactttcggatgatgccgaaagaaagcacagattctatccaaatttaaaaatatatgcatacatgatcagactaaaacaaagaacaaagggttcactagcaaaacatatatgtttttccaaattatgcccaaagcaaaactgatgggcactatatagtaagaaaaggtaagaaagaaagggatgtgtaccttcagtggaacgttgaacttggcaataaccttgaaaaagccatcatcatctgaaacgtcttgaagcagctgcaactcttcccgcaacatcctaactgcaacgccgaaatcacaaggaagaagaggagtacattatgtacaaaagcacaaatttaccgtatacaatcacagaaatatgtttgctaagtcgctagtaatctcaatacaaaagaaaaaaagaggctgttagaccattactacttcatccaacagcgcgaaacacacggatgctgaacatagaaatcatatacacggatgctgaacacacggatgcgccgcttgtagtacagacgcagcgcctctcctccgccgacgccaccgccggcggcggacctccccttctccgccagaagcggtgcggaggagggctgaccactgggagatggccaccttcgcggcttcgccatcgctctcggttcgatcgctcaccccgctgatttttttttgagaagaatgacggcaggagttctgccggaatttaaattagggaaaaaggccgaagcccagcaaagagtttaccgagtttacaggggctgtaaaagagatgaaatacagcttaagaagtaaagcaaatcaggggggcttgaaagctaatttgcgcaaatctaaatcttgcttgataaggtgtgctacatcatttactgagaggcaagaattttgaaaaattcttctgtttctttctagctagatgttccaccaagtagttagtagcgagcctctgataacctgcatttgaactttgcttcccgaatggttggttccattccaccaagtttcaacgtcgggggggggggtgtgaggaggttaaaggggtcaggttttggaactggcagattagactccaagtttgcctggtaaaaacacattcactgaacagatggtttgtgtcttcgaaggcgcaagtgcaaaggcagcaaatccaattacatggccaatgtcttcgaagtaaattttgcgcggtgagagttttttgatgaaggactagccatccaaagaatctcattttgggctccgccggggacttccagagtgaaaggtaatcgagtttaccaaaggatccttcaaactggtaaagatacacacttctggctgtgtaggtaccggaatcagtccaattctaggtaatgttatccggttcttgggatagcaaaaccatatgaattaagcctcctagatgtacaagctaatgaatttcctccactgaagtaaactgtctgaaagaggttagccatttattgtttgtgagttcaacttgcacagatctttgttttctctttgccaaactaaagcatcttggtgcaatgtcttttgggcagcgattttgaagccagatgtcatgccagaatcttgttttggcgccatttccaaccgcaatagtcgttgcagcttgaaagagcctatggtcagaatcatcacaaggcaggcacatgcccactcaaagcttttcttcatccttccaattgaaccataaccaacgaaggcgcaatgccctggaaaaatgctctagttcgagaagaccagcacctcccagaccctttggtttacatacggtttgccagttgatcagactatctcccgggtttgaatggtctggatcttcacccttccatagaaaagatctcctgaaacgatcaattcttttgaaaacccactttggagcttgtaggacagtaagatgatgagttggcatagcacttagaatagatgaaactagggcttgacgtccggcagaagtgaatagtcgccctttccaacctggcagtctagacccaatcttgtctattaaaggaaggaaatcaattttccttagttttccgagatgaagaggtaggccaaggtatctgcaggggaattgttttatttggcccggccatccaacaagaagattttgcagatcaatgtcttcgcatttgatggggtagatttcagttttgttgatatttgtatgtagcccagatgcttgcgcaaagcatacctgaatatgtgaaagggctgacaaatcttcttggttcgggcttgcaaaaaccgcaacatcgtcagcatatagtgagcatctgaatcttccatttcttaccccaaggggagcgaggacattaacattttctgcttcttttagaattcgatgaaaaggttcgatagccaagatgaaaagcattggggatagcggatcaccctgtcgcaggcccctggcatggttgattttttgccctggggacccatttaagagcacctgggatgtggaggtagagaaaagattagcgatccaatttaaccatcgattaccaaaaccaaattgtcgaaggatctctaggaggtaggaccagttcacagtgtcaaaagccttcgctatgtctatcttgatgaacaagctttgttttttttgtcctgtgaagcaggtttaccatgttttgcacataaaggaagttgtcatgaattgctcttttgtgaacaaaagcgctttgattttgggaaatcatttcgttgagccgaggggctagtctgtttgccatgatcttggcaataattttggcaaagctgtggatgaggctaatgggacagaagtgttcagcaccggaagcatcatctttctgtgggataagacagatataggctaaattcaagtcagctaactgcgaggtgttgaggtgcatgaaggatataattgctgctagaaggtcatcttttattatgtcccatgcagctttgaaaaaagctccaatgaacccgtctggtccaggggccttttcaggagtaactcaaagacagttcattttaattcctcttctgtggcatcttcttctaactcggtgagatccaagacgggtaggttcaaacggggccagtttaggcttactgtccttggagagatcgtccccagtctatctttaaagaacctgaaaagctcttcctctttgtcttgatgagatggctattccggaaggtgtttggagcgaatggatataattttttctccgtcttgaatttgctttgatatggaagaattttgagtttacatctccttctttgagccacgttaatctcgatctttgcctgatttgtattttattaaggactgaaaggcccagaaatcttgatttaggatttgacagaaggtgacgctcaccatcgctcagcagtcttgtttcttgagctatctctagacgaaggatgacttccgatgctattgctagctgtagtttaatgtcccctacctgagagcggctccatcttctaaggtcacgggctaggcgacgaagtttcagacgcaaaatcacgagactattcgtggcaagaattggtttttgccaggaactttggacttcctccaagaagccagggatacggagccaaaaagattcaaatctgaaatttggaaaatttttcctttgttcatttccaacaaggaaaatgggggcatgatcagaacacgctgaggatagaggataaagacatgaatttgcaaacaaggaatcccagtccgtagtcgcaaaagcacggtcaattttggtttgagtggggtttgaaccatcacctacccaagtaaagcgccgacctgggagattcagctctttaatttggattttatctatgagtcccctgaaacgctgcatcattcttctgtttaagcgatcgttgtttttgtccgaagctttataaatgaggttaaaatctccaatgatgagccaggccggtttcattaaagattgaaggccttctaattcagcaaggaaagcaattttttcagtttctaattgcagcccataaaccactataattgaccattgttgagcttcttctcgcatagttatggttgcagagacagagaaacgtcccagatgaacatcagagattgaaaagaagttgtcatcacaggcaagaatcactccacctcttgtgccttcagctggtaggacagcaacctgacgcgcaaaacgttggccgagagtgtttagaattatttggtcagacacaacagcaagcttggtttcttgtaagcaaacaatagtagcgctatgttgttgaatacagactttcacgaaatcttgcttggccttgacattcaagcctcttacattccaattgaacagatacacattatcctgcgacatagagtaaatggtctactatcacagcccaattggcagaaacacagccagcgcagctggaagaaacacagccagagagggggtagggggtagatctcatcagcaactctaattcatagtaggcaggagaagcagcaagcaatatagtgcacagatagcagcaatctaaaggacaagtacatctgaagagctaagtctttaacagtagaagatatcttgtcatcgatgagcaaaagcttctacttctagtcggcaagagtcagccacagtggcgccacagatgccttcttggatgccttcagcctgatggccttgcatcctcccttctccactagatcagcgattgtcttcagtgaagctggggagagcggcttcttgtatcgctgcaaatacaactttttgacgttatcatcgaaagaagcagaatcattcatgataccgaacttttttgaaagaatttcttgggtgaaattttcaaattttgcatttgcacgtcgtttatagagcagccgttcactgtgacgctgagcagaggcgatgacagggattttcaccttaacgcgggaaggcttcctcacattcacatccggagctgggagaagaggtggctggatcgacgttgcgatgtcattgatgaactcagtgatctgtgaatcctttgctgcagccagaggtgtcagagttggagccgatgccggtcttgcaaaggatgtcacaaaaacagggaaggaaacacgaggagagtttgtatccggagagtacatagagtgattcaccgccgcctcatgaagcatgggatcgagatggctctccaggatttcgagcacatcctctcgaccctgcaaagacaggagagaatcagcctggtgagtagtctgggccgacgcagaggtgacaatcaagacagcagcagcatctccatctggactcgggttgtggagggtggttgggagtttgcatggagaggccgaagcaggggtagaggatgagaggggagaaacaggcgtgtgatctacacgagaatcagactgggagggaaaaggaggcctcacctcgcttggttcacaagaatggtgggagcggcttctatggtcatatcgttccttgtctcgcgatcttccccttctttcctggtcgcggcactggccatcgcgccggtctggctcacgattccgaccggaagagcagccactgatcctgtcccagagtgaacggcttctatgacggcttttggagtggtcctctctatcatcatcgtcatcgtcgggccccgggcaaggtctggctcagctctgcaggggagagggtactccttgaagcggataccatcatcctgaacttcatagtcccatttgtaagcacgagccttgcgggtgtggaggtcttctagagtatcaacgtggaccaggacattgtaggtccagcccttctttggctcggaaggtagggggttgcggaggggatctagctctggcaaggggatgtccgtgggcagtccttcctcatcggcgtcagtgatggcgaaggtgccaccacggggaatggcccttggctcgcccgtccacacccacatgtcataggtgcggttgtagttgccgcgcctagagtactcctccacatagtggatagcacatttgcggccaatcaccttcgccgccgcttcatcagttcgcctgtgcatgggaacgccctcaatgcagagccgggcacggtagcggtagcgagctgggatgccatgcaggctttcatcccaggggcggaaaaggtataccctgccagaaggagcagtgagccttggctgacggaggatggcatcacgatcactttgatttgagcaggtgatgaagaaaacttcggggtggaatttggtgaactgaatgtcagctctcctgatgtggaaggcagaacgcatgtcatcagcaaacactccaatttcaaccttgtccccaagggccccaacttgccaggctaccagggagcgggcagagaaacgttctctgtgcctctcgatttcaccggtagcagagatgactacagagtcaagcaggggtcgagcagtgagatcatccatggcagaaggagcagagagggatttgggggggaagtggaggggagcaagttctgggaagtttgctgtggagagaacaggagggttaagcggggttttatagcctgggcgcttgcgacagtttgaagccagatgacccgagttcatacggaaccagcagcggatgggttctgtgcaggcagaaacttgatgtttggtgctcagacagcgaatacatttaccatccatatgcttcaggaacttctctcttcgagattgaatgcgatcctggttgttgggtgatttgaaacctggagatttacgccaccaatgcttcggtctgacttgttcccaattgctttcagcgaattgaaggcgatcagaagtcttcgacaggactggaggattttggattagaggagggagatcttgatgagacaagacgaggcatcgagttcgcgttcacgttcgccccgctgatcaagttcgcgttcgtgttgggctgggcttctttctgggttcgtggcctcgaggggttatggcctctctcaattctcaagtgactcggatgtcaactctcaagtgactcggatgtgcagacaggtggtgggttggagtcggatatctgatgataatgcggttcatttccgtttggtacagccgtaactttagcttcatctttttcgaggctggagctgaaccaaacagttttagctccattgaagaaaggagttatactgattggaatgctcttacagtaaaaaaaacaaggaagtagagctggattttagacagttctacaactacactctaggccctactcttagagttaaatttaggagttgaaactctaccaaacggataggtaattggaattttggatgatggtcttttaaaaactcgattgcaggaataaaattttacggcttgaaacttacaaaatgattagaaaagatagcatgtctgagcgatttgtaaaaaagtgaacaaataaaaatctacaataccactaaactattgctttattttgcagacattgcttaccattgaaaaaataactaaccgtaaataagagcacccatgtcaaatatactatcactgataaaataatcaatcgtaaattcaagcacacatattagtatagtactttaactcgattggatagaagaaacctaactaatttaagctatgcctcacacaaaaaggtataaattttttaaggcttcttttttttttcttgcgtttgctagtttatgcttttaagatgtttatactttttactcccctcattcactgtttaaatacaatgggaattagtgaaatcaatgagagttcaaacttcgaaacactgaatacatgttattttggattgaaatcaaatcgaatcagtcaaattcaaatatgaggaggaacataggcattcttcctttcttcagcgggcaccattgaattcagatactgcttcgcctaagtccctgtccaagacttcacattttctgatggtgatggggaactctgaaactataggaggaagaataaaatgaagaatgcagaaatgaatagtaattggtgttttttaattcttcttcaattccaccttaggatccaacttcagtccaaatccaaagtaatgcaactgccactagatcaggctagagcttcaaattcaactccaaaaacctccgtaaagtggcacacacagaggaaaaatccaggattcgtcactgcccatcaacatctgctttcgcctcccaattcctgctttcttgaaatctgctttcgccgaattcatgccttcttgaattatgctttcttagcctcccaattcctgcttttcttgtgtacttgtgaattgtgggtgactacgactacgagtgctataaatagaagagaccaatagagtgcatcagagaaaagtactcctagaagacagccacacacactgagacacccaagaagttgcctccgatggcggattgggcgatgcaccactacctcctactagccaaccagcaacgccaccgagccctcgccgacgtcgccgtcctccgccgccagctgctcctcgactccggccgcgtcttcatgctcctcggcgccgtcatcctcatgcacctgctcgccaccggccgcggagcatcgtccggctgcatccgcggcgccgaaccttgcgtcgccctcctcctgtggctgctcggcgcggcgctcgccatgctgtcgctcgtcgccggccgattccccgttctcgcagccgccgctgccaccattgctaaggagctcggtgatcacctgcttggtgatcatcttcttctccgtgcttttgctctggagttgagtacggattgcgtgtattgcatccttgcattctccctacatgttatgctttcgaaacatcatctttttttcagtatagttcaataaatttcagctcatatttgtcctccaagacgagttctccatcaaacgaaacttagggcatgtacaacaatctttattagtggtctctctattgccatgcaagtaaatttgatgacatggaagaaagagaaagaaatatggttgttatgcatgacaacggctcagagtcgactcttagcatttattagagcaaattttgttgtatagtggtaaaagaaaggaaagaagagtaagaaaaagtatttttatgcattaatgattagagaccatattgcctctaactgttgtaagatgctagtctctagataacatagagctcatatctgactctacctttgtacatgcccttatggtgttccgttgtttgggccgattttatgttggaaatgtacagatttcatagtattgtgtttcttttttcggaattgctaagcatctgtcgacagaaaatacatacccaaatcttgcaaattttgaatcaccggatgtgcttcgcgattcgtgctcgaggtgcttcttctctaactccggcgacctcctcttcttctctggcgccggcgaattagggtcccggggcgggttggggttggggtggnaanccaaaataccctcactcataatatatatttttctgtgcttctaaggtattatttcttctctaataaacaaattgtattacgcttgaaacattattcatcttggtctattctaatttctctctagttctcctttatgttctttctctcttctataataaattagcgcgggtcggtagtttatttttattttacgtgttcatatttttttatactcttcttagaatatacttgtctcgtacgagcaactaaaactctgtgggtgtagctgttttcatttctaatgttgaacattatatattatccttcctcatggtatgtaatattatttcgttgtggcgttacataataatttctctcgaggacgttctgaaaattttacatacttctcttggtagtgataatccatctatcatgtccgccgaaaca

SEQ ID NO: 9965 - DNA, 20013 bp, Oryza sativa
  unsure (1)..(20013): unsure at all n locations
nnnnnnnnnnnnnnnnnnnnnnnnnnnnnnnnnnnnnnnnnnttcggggtcttaacccatactttgaaacccttgtcccacgtaccaggactcttccaccattggtcattttgtaacacgtggtttgacaaagggaccaactagtgacctcttttaaatcaactctaaaaatttgcccccaagggatagggggagtcgaacccaaatctggtacagtgatctactagagttatgatacattgacaagtgctactaagttctagtacagtggtaagtactactagagtgctgcaactgctaggctatagacccgttctagttctaaagaatggagtatttgatttgttgttaaaataaacaccaccaaatttcactattatttttttagaaacatggtacaaacgtagatgcccacaacatgtacaccctatcttatgagcacctctaaaaaattgagccggtatatattgaaattgacaaagtcaccatgggtgtcttgctgtcgacgagtacatcgcttactactaaaagaataattcactgtaagcattattattattattacgtgtcaagtctagaatttgaacttgggtaggctgtttccactgcaagaaatctaactagttaagctacgcttacttcacattattattattattacactactactactattactactagaaaaaatgcccgtgcgttgcaaagggtgaatgctattttaattttattattgttttatggtttagctaggagggaaaaaatatccgtgtgttacaacgggtgaatgttttttttaatcttattattgtaataggttttagctatgatatgaaaaacactgtgggaattcgcttagatattttttttagaaaatcatgagctgtaattaggagtttggctttcatatcaagttagcatgcgagttattctaaagacatttctatacgactgcttttgtatttcaaaagcaaacgaacttaaaattcgactaaaaaacggatctatattttaaaaagtgaacgaacttaaaaccaactcaaatatggatgacgtaccaaaatatcggtaaaaacatatttaatttcaaaatatcggtaaaaacatctttaatttttataatagtagagaagagattattattattattagaggtagagagaagttgatctatgtttggtttgaccacttacgtagtttcttagattttgagatagtacgagagttggtttcaaagtcaccgaatttttgtatgtttgcgatgattatagtacgtttggcttttaaaggcattattgttaagagacgccgtgatttaggaattcatgataatggacagacgtgaaataatggtgatgtacccgtagaaagtcctctgatttctctaaaaaaaaaaagaaagtcctctgacgaacgagtctcggattcgattcggttcgttcggatagggccgggcccgtccagacagctttgacgcgccttccctaaaatttcgccttttggagattagcgtcagtgagattagtttacgatacttgccccggcgcacgtcacgatatcggcatgtcacataccgaacagcttacagctcacccgtgactaaaatgtgtacgtgcgactaaataaaatgtacatgtactgtacgcgatctataaatacaaagcggaagaagataggtgcatatgccacccacacaaagcaaaccaaagtcatcataagctgatgatggcggatcgggcaattcgttacctcctgcgcggcgaccagcggcggggccttcggcgtcgagcccagctgctcgccgccgccggtcgctaccaccgccgccgccgtctgctcctcctcgactccggccgcgtgctcatgttgctcgccgtcgttgccctcctgcacctgctgacggccgcctgcactggccaggttgagttctacgtcgtcctcgtcgcgttcctcctgtggctactcggtgcggcgttcgccgtgacgtcgctcgtcgccggccagttccccgttctcgccgccgccgccgccgcgaggacgctccgtggctggctgcttggcggtctatgaaattaccgtatattatgttctgaaaccgtcgccgccattgctatggagctacgaaatttcacgcttcaataagaaaaggaggaattggttagtgatctctctactcttgtcatcctcaatgtccagtgatcatcttcttccctagatcgctatatatttcaataaatttttgttgtacaatgttccatttatgcaaggaaagaaacttacgatgttccactgtttgaacggattatttcacgctcgaaatgtacaaacaacgaaagtgctctgttctccgcagtttactttttttaataatggaatgaaataacatcccgacctttactcaaaagagttacaaccaattattacaaactagcactctgtaaaaaaggaaaccaaactagacaaaataatattattccagtctattggtaaatccccatccatgattggcaaacagttgcataatcgttgtttcaagcttacgacatgcaacaattaggaaatctccatcttcatcacacttttgtaactgtgcccacagacgaagccaatatgttggcttgaaaatgacctgcatataagtaacagtaggtgatttgtcaaaaaaaaccttatcattcctactcaaccataaagcctaacacaaggcagaagctccaagaagtattggtttgctctttttgtttacgactccctgaagccaatcataaaaaatatgagatatgctagtatgaatatatatataaaccaaaagaaaactgaacggctctccaaataaactttgcaaaataacaatcaatgaacaaatgtccattttactaggccgttttatcattaccaggccgagttctgatgataaaagagaatacggcccaacccgccgagaaaattcttaacgagcggcccacattaaaaaactttgatgtttaaattaggaataagtctatttgtcttccctcaacttatgccccaggttaaatcgtatccctgaacttaaaaccggctataacccatccttcaactcccaaaaccattgtaaatcgcctccccaagtggtttcggaggtggttttgtcccatgtggcatatttgaccccgttgacccgcatgttagtgaaaaggataaaaacgaaaaatggtaggcctactatcagtggctaccgccgtcgccaccccccacccttatctcaacggaagacggcagccctcagcaacatcatcttcgccttgaccttcattagctatcgagcaggatgaagggggctcgaaacaacccgattaccttacatgatggcccgaaccaccaatgaacaagctgtaggcgagaaagaagcaaaagcacgcggcaagcggtcgagcctttgagaagcctagggaggcagagatagagtcaaattgcgttttgtaggaaggaaatgagctgagccgccggggatatgtcgctgccgcccagctcgccacactgcctcccaccattgccttgttagtgccgtcgagaagacttggaggaaagatagtagatagagaaggaatgagagagggggacgattacatgtgggtcctagttgtctattttaatttctttgatgggtaggctactatatatgtagacgctacatccgagaatatcacggtcaatattgtcttgggggtcatttttacacaattttaatagttggaagagtcgttataaccgattttatggtcgagggataaatattaaattttttactagaaagaaaagaagagagaaaatctcagtcaatcagagagagaaaagaagaatctaactagaaatacaattcccctgaaaaattagaaatacagtttaaaatatttgaaaagaagagcccatatgtagaatatgatatagattaattaatagaaaatataataaaataataatttgattaccacacaaactccaagttaactaaaattaaaagtacaaaatacaataaaaactagctcgcgacgctagaaattccatctctttggacaatagaaattcccacgttaatcgacacctttgctctagaggctagaaattcccctgttaataggagaaaaaatatataagggtttaagtaggaatgcggtttaaaacgcagacactcacaacgcacgcgcactcacccctgtgaacacgcgcacgcaaaccctacccctatgagcatcttcgaagactggaccggcaaatcctggagagattgacaaagtcaccacaggcgcctcgctgtcgacgggtacgtcgcctaccactgaaaccacaacgccattaaatcctggaaaattcgctcccatggggagtcgaacccaggatctcatgtgctattgaggctcctgtaaccaccaggttacaggccctttcgcttgggtcattaaaatttaaaataaaaatataataaaaacttgctatgaatgttagaaatttccgtgttgattgaaggaaaaacatagagagtttaagtaaaacttaaaaataactaaaattcggaataaaacataacgaatattgaaataagagtccatccagaaaaacacgagattaactaaaattcagaataagaaatcaaataaattcctaaattcaaaatataaaatagaacaaatgttgcaattagactccaatacaattaaaaacaatacagctagatgttattatttctattcaaattagtacacttatatattccttaattaccaaccaacgcatccatgaatacaattgcaatcggctcctccaatagtatgatcactgtggctgctcaacagagagatgccgttgtgtcatctcttgcgtctacatgcatggagttcaaggagggagatggagtggcggcaatagcaggtcgcttggcgggtgcctcaccgcctctccagctctccccgacatggcaactgtttcgcaacgcttctagtagacaaagagttggctggaagaaaggatgactttgttgccggttcctaaacttgcgttgcgttcgagcgagagagaaaggtggcagcagtggatctggtggctgcagagctgagagagaggggatgtcacactacaactgctctaccaaacatctaggtggtggcgagagagaggatcgtgcggggggaggggggtggttaaccttttgcaaatgtggcttaggtcgaacgatctatcatcagtttatctttctttacttctagctcacattaaaagccgcaatgttatagtataactacggtttttaatacggttgacgctgattcttttatggctatttttataggctagaaattctcacgttaatggataagtgtttctatggtagtggataaacaacaagtaatcatatctcaatgaccttttaacgggcttttttttgcagttgatcagttgttttggtggatcaaagcttatccttttacctatatatgttactcaggattattcattatttcaagttattgccaatgtgaggtaatataaaatgtaaggaaatcaagaagcacaaatgcgcgggctgtcatgttagtttagattatcaggtaaattatttacttgattacagaaacaaagtaaacatttaaaaaaataaagttaacaaataactaaaaacaaatggtaatgcggtatctctgattttacttttcaaaacgtgagcaaatgagcgggaaaagccttaactgtattgagaaaaaaaaatgaggcgtttgcgaaggggcgaagtttgtgtgatgtctcaatcgcttagctcggggggggggggggggggggcgtactccagcgttttgtacgtatgtccgatgtcttcatttgtaaaaagacaaaaaagaagaagaagaaataagaatgtatacccacccaatgtctccattaactcgatccatattggaggcaaagctataaatataaatataaatncaatggttgcaccggagagcagcgcaagattctgctcaaatcagacaaccagcaacactgcaagctgaggcgttgcgctagccacacacgcaaagtgcgtacgtgcaatggcagatgaggcgttggcgctacgacatcaacaatcggatcggacgacatcaccgccaccgccggcagatcttcctcctcgactccggccgcatcttcatgctactcggcgccgccgccattatcctcctcacgagtagcgcaagctgttggattggatgccacgcgcagccacgccgtacgtcggcctcgtcgcgttcctcctgtggctgctcggcgccgcgctcgcaatgctgtcggtcgccgccggccaattccccgctctcgttgccgccaccgtggccattgctacgcagctgcgcaattacctccttggtggtctctagagactctttctccaccaaccgtgcacgcatatatatgtgtcatcttctttttctgagctcagctgtagggcagaatacgcattgtatattcgattcttgctcatttatataggatgctacacctatgtattcgccatactgtccaatcgtcgttctcactgtacttcactaaatttcaatttgtactagtccattgaaatggtgttggaaatctagggactaatcggaatattttgatccaagatacattatactaaacatgatatgtgtgtaatacagtgatccagtgatagtgttaaacattaatatgctaataataataataataataataatagcatcatttagtaacatatttaattttaaaataaagagaaatacccggaaattgctctggatccagagacggtggcgttgtccttcccagtcccaccgttctcgttcccgtttctcggtgttgactttgctggtcaacatcattcgaagcaaagttgttgatggaaaggaagtacagatggccgtatggcctgaggcccgatggcccgcccaaggcccggcgactttggcccggtctagacacggcacggctcgactccgatcgtgcccgtgctggcccggcccaacagccgtgccatgcttgggctgctacctcggcacgctgggccggcacggcccaacctgaagttcagggatgcgatacagacttattctcaaccatatgtaaggcacgtcacaaagaatagggatgaaaaatagacttattatatgagacggctcaaagagtagggatgtaaaatagacttatttttagctatatatatgtcacaacccaaagagaagggagaaaaaaatagacttattttaaagaaggcacaatgggccgcccgtgccttcgggacggcatggcacggcccgacttctgatgggtcgagcctagacttgaggtgcaacccgtgagccatcacggcacggcccgaagtgccgaccgtgccgtgccgcccggtcaccttgggccgtgcctcgcccatgcctgggctgggccgtgtcgagcaggccttatgggcatctataaaaggaagcagtgccgacggtgatgcagagaaagcatagagcagccgcacgaagaacgtgcgctccaaaaaaaagtgattgtccacctactcgtgtaggtactctggtggacgtagttccaaaggcctgctcgtcacgaatacccgtgcaggcaggtactcaggaccgaggaacaatcgaagcagcatagaggcagaagaacaggaggtgtccacccgagagaaccagacagaagaagggacagagagaagactgatcgagcgtcttgtctcggctagaggtaggagtaaagtcacacgcgagagatagggggcattacgacgttaaccgtgcttgatggtgtaaaacaatgtatatcttatcttctagttagttgtgttgctagctagataatagggtagttgagatggataacatccgttgttaacaacctgatcatatccttttgtaagtgccacgtcaagggctgttcttgacaatataaatacaatcatgcggccttctctgggaggtgagaacgtttccaactttacatggtatcagagcctctctcttctcgccatggtgagttcctcctccacatctgtgccggctgcactcggtcctccggtgactgagaagctcaccagggacaactacgttctctagcgtgcacaagttctccctgcgcttcgcggagcgctgctcactgactacctcgacggcacggctgtggagccggccaagatgaggaccaccgtcgacaagaacgacaaggagatcgtcaccaagaacccggactacaccaagtggatggctcaggaccagcaggttcttgcctatctgctgaattccctgtccaaggatgttccgcaacaagtggcgactctcgacacttcggcgcaagtttgggatgccctcaccaacatgtatgcatctcaatcacgcgcacgcatcaccaacctcaggatcagcctcgccaacactaggaaggggtccatgaccactgcagtctacttttccaagatgaagggactggctgacgatcttgcgtcggttggcaagcccctggatgacgaagaactggtgtcgtacatcctcgtgggcctcgatatcaactacaatctgctggtttccaccgtggtaggtcaatctgatccaatctccttaagagatttgtattctcagatggttagctaagacaaccggatggatcatctccaaggaggcggacaaatccaatcttctgccaacgccgcctcacgcggacgtggcaacagcaacgacaacaacttccgcggtcgtggtgccggcggcaatggaggtcgtggccgtggcaatggcgaacgcggtggaggtccacaaggaccacgtccggtctgtcaactgtgtggcaaaactggccatacggtgctctagtgctggtataggtttgatcaaacctatcagcccgaagagaaggttgcagcagcagtgaattccgcctacggcatagataccaactggtatgtcgactgcggtgccaccgaccatatcaccggggagctcgacaagctctcagttcgtgagaagtataatggacagcatcaagtccatacagccaacagcacaggtatgaacattagtcatattggttattcagtaatttcgaccccaaacaaagatttacatctgaaaaatatcctttatgttccctctccaaacaagaatcttgtttcagcaaatcgcttagcctttgataacaatgcattcgttgaaatttaccccaagttctttaacatcaagtaacaggcaacgaggaagctgcttcttcacggcagaagtaaggggcggctttatcctttggctccagcacccggtagtccaagtcctggtgattcaagtctcaataagaatgccttgagcatcatcaagccatcttcgactaggtggcattatcgtttaggtcatccagcttttccaattgttagtcgagtcattaaaagttttcagcttccttgttctagcgagtccaataatgtagaacacatttgtgattcttgtcaacgggccaagagccatcaattaccataccctaaatctctgagttcatccaatgttccgtttgctcttgtattctctgatgtttggggaccggcgcacacttctgttgggcgacatgattactatgttagtttcatcgacgattttagcaagtatacatggatctatcttctcaaaaagaaatctgatgtttttcaagccttcctaaactttcaacggtatgttgaacggcagtttaaaaccaaaatactcactatgcagaccgattggggtggtgagtatgaaaaactaaactccttcttccagaagataggcatagctcatcatgtctcttgccctcatgcgcaccagcaaaacggctcggcagaacgtaagcaccgtgacatagttgagaaaggtcttgcccttctatcccaagcctcggttcctttgaaattctgggatgaagcctttcttactgccacatacctcattaataggttgcctagttctgccatttccttcaaaacaccgcttgaacaactcttctctgaaaatcctgagtccagtcacttgcgcgtgttcgggtgtgcctgctggccaaacctgcgaccatataatcatcgcaagctttcaattagatcaatccggtgtgccttccttggctatagccctctccacaaaggatacaaatgtctggagatatctactggccgtgtttatatctcgcgcgatgttgtctttgatgagacagtcttttcgttgcctccctgcatcccaatgccggcgcccgtctccagcgagagatttctcttttgccttcttatttgctatccaccaccgatcaagggggagaaattactaatgatcatatgctaacatgttctactgaccctacttgtggtgatcaagcaacaggagcacagattgctggagaaaattcgatgcaaaatggtggaaatccggggcaaaacggtgaagatttgatgcaaagctcacatgaaatcatacctggatccgtgaccaatcaaacttcaatgtcagatggctcaggatcccaagggggccagagctcaagccatgcagccagtagccatgcggcagcaagcggaagttcaagccatgcagcgaacaaccatacgacagcgagcagcagtagccatgcagtgggcagcagcaatcattccagctcaggttcacatccaggatcttctgcgcagtctgctccagcacagccaatacaaccagaaccagtcaggcatcgtacccggttgcaaagtggtataactaaaccaaggttagatgttgatggaactattaagtactctttggcttgttctacaggtgaaccaacagatgtgcaagaagcattgggggactcacgctggaaacaagcaatggatgaggagtacaatgccctggtgaggaacaacacatggcacttggtgaaagcaccacaagataagaatgtaattgattgcaaatgagtatataaaatcaaaagaaaagtagatggtactttagacagatacaaagcaaggttggtagccaagggcttcagacagaggtatgggatagactatgaggacactttcagtccagtagtcaaaattgcaacagttagacttgttcttggtattgttgtctctagaggatggtcactaaggcaattagatgttcagaatgcctttttgcatggtattctagaagaagaagtttatatgaaacaaccaccagggtatgaaggtaaatcaaccttagtttgcaaacttgataaggctatctatggattgaaacaagcatctagatcatggtactctaggttgagtcacaagttatttgaactaggctttatctcatcaaagtctgatacttccctgtttatttataatagaaatggaataaccatgtatatgttaatttacgtggatgacattattgtcacaagctcttctagtgatgcagtcgcagctttgcttaagaacctaaggtctgatttaatttgctttaaaggacttaggtgagctacattatttcttgggtatagaggtgaagaaaatacctgatggtatactgttgaaccaagcaaagtatgctttagacttgctaactaaagttggtatgaaagattgtaaatcagtttccacgccgctagctgtgacagagaagttgatggcacacagaggagatcctcttggtaccgaggatagcactcggtacaggagcattgtaggaggattacaatacttaacactcaccagaccagatttggcttttgctgttaataaggtatgtcaatatcttcatgctcctacttcagaacattggtcagctataaaacgaatattgagatatatcaaaggaactgttgatgttggtttgcactttaagaggtctagttctactctagtcagtgccttttctgatgctgattgggctggtagtctagatgacagaaggtctacaggaggttttgtaatttactttggacctaatattgtgtcatggagtgctaggaaacaaccaacagtatccaggtctagtaccgaagcagaatataaagctatggccaatgctactgctgagttaatttgggttcattcagttcttgaagaattgggagtaaaaattgctcaaccacctgtgttgtggtgtgacaatttaggagcaacatatttatcatcaaatccagtctttcatgcacgaacgaagcatattgagattggttatcactttgtataagagagagagtagcaaataagatgcttgatatcaggttcattggatcaaaggatcaaatagcagatgggtttacaaaggctttgtctatacaaagtcttagacattttatgtacaatcttaacttgtccaagttatggttgagggggagtgtaaaacaatgtatatcttatgttctagttagttgtgttgctagctagataatagggtagttcagatggataacatccgttgttaacaacctgatcatatccttttgtaagtgccatgtcaaggttgtttttgacaatataaatacaatcatgccgcctcctccgggaggtgagaacgcttccaactttacagatggcacttcatggcatcatcgattaccggagtaatgtagccattagtaactgtcggtttcgcttttgctcataaaaacaaaaacggctgaaaacgagcattccgtctctgacgcggcgccctcatgccacggtttggaccaccgctcgcgtgtggcattccaaccactagttcaatggttcaaccggttaacaagtgcacttaatttacaaactatttaagttaaggtcttttcgtgttgatttttcatgcggtattaatctccaacattaatcgtgagtccttggaatttattagcattaatttagacatgggccatttagttctaacaaatggatcgtttgcttcctgtataaaagaaaatgttttcgaaaaaaaaatttcctctactatagtacttattacgctcattttaaaatatgagcatttttaccatctttaaggaagtaccaccaggtaccagtatctcgaggtaccacttacatctcaccgttgatttgaaaagggtacgatggtcatttaattcaaacttttccgtccgctactctgcaatgtgtctgaggtactaaaaactcgccgccgatgcacatgctgtgtccctgccgccaccacagcgcatcaactgatcggcaacacctgattcgcgggaaactcattcctaaccaactgacctccatgcgccaatccaagccggggttctctattgccatgaaaaagaagagcgaggtaatcttcatcgccataggcgagagcaggatgagcaaaaaaaaaaagaataataatcactagtccatggcgatgcatgagaaagctaatcaatattgccataagagagagcatgagcgggcgttgctaactggcgtgcgcgcgccagctgccccccggcccacaaagcccatcagcctttttttttctcttttattcgcgattttttctttcttttttttacgattttttttgttttttctggttactttttttaatctttagcacacttattttttaaaaaatgttttcagttgaaagtttttaaattttaacttgaaaatttttaaatctgatttgaaagtattcaaatctcgagttgaaagttttcgaatctcgagtcgaaagttttcgaatcgaagtcgaaagttttcaaatttcgagttgaaagttttcaaatctgagtcgaaagttttcatattttttcaaatcttaacttaaaaattttcaaatctatacttgaaagttttcaaatctcgagttgaaagttttcgaatccgatttgaaagttttcaaatctcgagttgaaagttttcgaatctgagttgaaagtttttgaagttgaaagtttttgaatctcaagttgaaagttttcaaatatgagttgaaagttttcaagtcgaagttgaaagtttttaaatcggagttgaaagttttcaagtcggagttgaaagtattcaaatatgggttgaaagtttacacatatatagaaaaatcacctattgggccgtgtggaccggcgcgtgcgcaccgccacgccaattaggattcctgagcatgagctccctgtcttcgtgaggttcaggcagcaaaaaaaaaacctaaaccggcgtcgatggaccaaacatgaactacctgtctttgtgaaaatacgaagaagcatatggatgggtagggttgcaaagaaccgtgcgtgcagctgcggcgctgatgttgttgctgggtctcaaggtcctgccgtcgccggacgccaggagaggattggtcaaggtcttgccaccggcggtgagggagaacacatccaatgccctcatcgatccctgctagggctgcactaccgtgcttcatatgatttggaacggtcggatccagcgccaaaatcccgcaccgcctcctcgtagctgacggtgaggtttaggtggagctcggttgctcagaggagggaagatgaacgggcagaggcgtcggccgccggactcctgtggcttgcgggacgaaaggcgaatgcaaaaatacaattttagcccttgggcggctggtactgcacagactgatggacggtaccaacaggtaccgactctttctcagtggttcgattataacagatcaacggttaaaatttggtacctcctgtaccttctcaaagatggtaaaatacctcttaaaatatattatcgagtgaattgttgttacagattatctatataaattaaacaaatatttgataatcaaacttatggtacacgtaatacaatataagaaagtattttgagaaaaaaatattttttttgaaacatggaggaaataatccgtttcaataatccgataaatattcttaaaagaaataaaaattaaactacttatgtaaagttatttattaagtttatttcttaaaatatttaatctctccctgtaatcaagtagatgagttgagataatctaaatcaaaataggccttagctccactagttattccatccaacaaacttgtggaatttcattgtttgaaccaatataattttactctagatatgcacagattacatggccctgtttggatcctccgggctattaaatagccctcccaaatcttgctatttatgagtattaaacgtagattactgataaaacacatttcataatccctgtgctattttgcgggacgaatcgaatgaggtatattaatccatgatttgcaaaatagattaatatacatcgaccatagattaatatacatcgttagattcatcttgcaaaatagtctatagattatggaatgggttttgtcagtaatttacgtttaatattactaaatagtaaattccaaagggctatttaatagttcggaggatcaaaacaaggacatagtagtagtaactttggttttgtttctgggaaaaacagcaactctggtactccgttcttggcagtttattgggctgatctctgtcatttaccaagccgacgtctgatgagcaaagagagaacggcacaagccgcacaacccggcaaatagaaaaaaaaaagtccattttcctccctcaactaccgagtttgattaacgtccctcaacataaatttcgttatcgtttttggttatatatatgtatatatagaggctcccataattatcgatcaaaaccaagtcattttaactcccttcgtggtttggacactggtttcatgacgtgtagaccaggtcaatcactgctaatctacgtgctatttatatggcattatctctactattataaaaattgaagatgtttttatcggtactttggtacgtcatccgtgtttgagtcggtttttaagttcattcgcttttggaaatatagatttgtgtttgaatcggtttttaagttcgttcgcttttagaaatacagaagaagtcgcgtaagaaatcggtttaaaaaacttgcacactaacttaagacgattggactcctaattgcagctcatgattttgtaaaaaaatatctaagcgaattcacatagtgaatttcactttagctaaaccgtataacaataataatattataataatccttcacccgttgtaacgcacaggcattccctctgttaacgccatcagagaggagagaagagagagaggagaggagagagggagggagagagagaaaaaaaataaaggagatggttgaaaaattttgaagtggtgaggagggaaagagagaggagtgaaaaaagagtgaggatttttatatgtggaccacttaatcattcgtatgcgaaaatatatttttcatgcggctatttaagagaaccgcatacgaaaatattcattacaaaattaatttgaaaatatgagaacttcgaatcgaattttataatactaaatgaccttatttgaaaacaaagttgtagaactcattgagatctaccaattttcttttgaccatttctccatccaattttaattgaactatataaaatttgaattttaaaatataagaaattttttaaaaaatcaggtagtaaaatgatttcaaatggaaaaattgtcaacaataaagttgtataacacatcaagatctacaacttctgttttagtcgtttttctatatgactttgtttaagcaatttgaatttgaatttcaaaatatgacaactttaaacaacattttctaatactaaatgatttcaactgaaaaaatcatcaacaacaaagttatataactcatcaagatctataacttttattttgcttatttcttcgcccgacaaagtcatagtagcattgttcacaaaatttacatatggttttataaactataagagagatatttaaattttgtaaacaatgttactattattttgtcggatgaagaaatgaccaaaataaaagttgtatgtctcaatgagttctacaacttttatgttcatgactttttcagctgaaattatttattgcttcaaactattatttgaagttttaaaattcaaaatttaattgataaaacaaagtcacaagaaaaaatggccaaaataatagccataagaacacaataacataatagagcatgatttttgaatgatttaggaaaataataatccaatttggagtccatatgagtaagataaactagttttaaatttttagattttattttcgcatacggctttttaatacgcccgcatggaatgagataaactagttttaaatttttaaattttattttcgcatatggctttttaatacgcccgcatggaaaaatcgatttttccatgcgggctcttaagtagtctgcataaaaaatgagctcatttttatatgcaggcctcttaagtggcccgtatgaaaaatcgattttttcatacgggtgtcttaaggagccgtatgcgaaaatccgctcgatttttctaacgcggcaagttatggtccgtttgcaaaagttatggggtcttgtaaagaaaaatcatttgtgtagtagtgaattgtacacataagtttctgcactgaaccatcttaattcatccaacgtctaaaattgcaaggtggatatacgtagacacaatcttattcatatatatgcatatgcatattattctcgtgcgactggtcccatatattgaaaaactaatattgactaccgggctaataatatagtcgtacgtccgactatttgatcaggacaggcacggccttgagaggcacagcaagcacattggcagacttgaacttctcggacacgtccacgtcctccgctgtcatgccgccggggagcttccactcgaacgtgtgcagcatcgacgcaagtatgaacggcatgacgcgctccgccaacggcagcccggggcacagccgcctcccggagccgaacggcatgaactcggcgtccttccccctgaagtccagcagcggcgccctctccacgaaccgctccggcacgaactcgtcgggcctctcccacgccgccgggtcgcgcatgatcgcccacgcgttgaagagcaccgtggagcccttgggcaccgcgtagccgccgacctccacgccgtcctccacggcgaagtgcggcagcagcagcgcgcccaccgggtgcagcctcatggcctccttcagcacggcctgcaggtagggcagcctcgccgcgtcggcctcctccacaacctccttgtcgccaagcacatccctcagctcagctcgcgccttggccatcacgcccgggttcttgagcagctcggccatcacccactccaaggtaagagccatggtgtcagccccggcaacgaaagcctcgaacaacatgtcgagcacgttgacccgatcgatcttgccggcagccatgagctcgaggagtgagtcgaggaaatcgttatggcttggcttgttgtcgcggatgtgagccaaacggcggtcgatgatgtcgcccatgatggagaacaccctgttgaaccgcttcgtcgtccagcgccgcaggccctgcaggtccagcggccggaggaacgggtagaagtcggagatgttgggcttcccgaccaccgagatgatgtcgtccaccacctcccgcaggtcgcgagccatctgcgagcccatgtcgacgatgtcgatggagaagtaggagaaggacacgaggttgaggaggcccgtgtgcatggcctggccgaggagcacctcctcgccggcgtgcgcgcggaggtaggccatgaggtcgcccaccttccgctcgcggatggggcgcacggcggcgaggccacgcggggtgaagacgtgggagccctggatcccccgcagggccttccaccgcgggtcggagctcgggatgaacaccatggaccggtcggcgaagccgcacgcgcggaaggtgtccggggtggcgcgcgcggcgaggtggcggtcgtacttggtgtacgcctcgatggcggcctcacgggaggagatgaccacgttggtggcgaggccgagcttgagcgtcatcacggggccgtggacgcgcgccaggtccctgagcttgtggtggaacgacgtgccgccggccaagtggaggttgccgatgagcggcagcggcgtcgggcccgggggaaggggcttgcctcccgcgtggcgtcgtcgcagggtggagaggtagaagaggacagcgacggagagagctccccatagcagccacacctggctattctccattgttgcgatgaagctgtggtgcactactggtatcgttgttcttaatttttctacctggtgatcttgtcgctgcgcccgcagcttgtatttatagatcgagtcgaagtttagatctaatacacccttattgcatggcgttttttccatttctcatcaaaacttgaaaggtacacaatactagaaaaagtattttttttaggcggccaaaagtgatttttgcaggggggaccgcctacagcccaacgactgtcaaaatcgatgattttcatagtcggggcaatggtccgcctgcaaaaatgcgttgaaaaagcaaaaaaaaaatcgtgggcgccgccgccacgcgcctcgctgccaccgccctcccctggccggatctgggaggggatgggatgggaggggagggganccncnccnnncatccncnnccccgccgcccccaacggcctccccccnccctcctcccgccggatctggcagggaggaggaggcaaaccttcacccgggacccttttcgaatctatataacagccgcaccggctttgttaactcctccactcgcggggttgttaaaatcctatctccttttgcgaggaaaaaacaacttcttaggccctttttcctccgtaaaatattttgccttcgttggttagaaacataaaacccccgcccgccgggtaacacataataatctatcccgttttctctgtcagctctagacttatattcttgggccccgaatcacacgaaaaattatccccctctagcgagcagggtactttattactttcaccggtgggcgcgattataacaaaaaatgttcacgcgtcctcc

SEQ ID NO: 9966 - DNA, 5954 bp, Oryza sativa
  unsure (1)..(5954): unsure at all n locations
acttccccctccctcctccgnccgaatctggaaggaggggaggggaacttcccaccccggcgtcgtcgcctctgtccggcagtagtcgccgtcgtcgcaccgcgcgcgctgtcatcgccaccctgctcgcacggtagctgccgcggcccttaccagcctccccctccctcctcgggccagatctggaaggaaggggggaggggtttcgccgccgccgcccctgccggcctcccccctcctccggccaaatctggaagggaggggggaggggagccactgcgtcgtcgtcgtcgtcaccaccgccccgcaccgccgtcgttgtcaccgccccgcacacgccgtcgtccccgcccgcacgtgccgtcgtcgccgccgtcggtagagggagggaggggagggggacggcgccccaacgttgaggtgaggggaggggaggggagaggaggggaaagtgttgagggtgagagagagttgagtgagtgaaatgagtggtggggaagggtggaggagaagataaaacttagaattttttggggtaggtacgattttcgcaggcgcggtttgagtggtccgcctgcgaaaatgattttcacaggcgtcgcttaagtggtccgcctgcgaaaatcacagcgaacttcaccccgatttatatttttgtaggcggtcatttggcttcaagggtcatattcgtctgtgaaaatcagaccctcatattgggaaaaatgcattttctagtacagacatgtcgttttcgtaaaacgggaaaaaaagatcaaagtttctctacatgtgaccgtacgtttcacactattcctgacttcaactatggccctgtttaggttgtgtttggatccagtggtgaaaatttttggcgtgtcacatcagatatacggacacatatttgaaaaattaaatatagattaataacaaaacaaattaagattctacttgtaaactgtgagacgaatttattaagcctaattaatccgtcattagcaaatgtttactgtagcaccacattgtcagatcatggagcaattagtcttaaaagattcatcacgcaaaatagttgcaatctgtgcaattagttattcttttagtctatatttaatactccatgcatatgtccaaacattcgatgtgatagagtgaaaaattttgctagcagatctaaacaggccctagttccaaaaacttttcgcaaaaacatcacatcgaatctttagacacatgtatagagcattaaatatagataaaaaaacaaaaactaattgcgcagtttgcatgtaaatcgcgagaatgaccttttgagcctaattagtccataattagccataagtgctacagtaacccacatgtgctaatgatgtcttaattaggctcaagagattcgtctcgcggtttccaggcgagttatgaaattagtttttttattcgtgtctgaaaaccccttccgacatctggtcaaacgtccgatatgacctaaaaattttcattttaccaactaaacaggccctatatatttacgtgatgcaaagaagaagcagcacaaggacaaaatgattgaggatgacagttgacaatgacctttttatcgaaactcgttccagcgagagcatcaggctgtgtttagatcagcggtgaaatttttcgtcgtgtcacattggataacgaacacatatttaaagtatttaacatagtctaataataaaataaattgcaaattccgcctgtaaactgtgagacaaatttataaagcctaattaatccgtcattagcaaatgtttattgtagcacaatattgtcgaatcatagagaattagacttaaaagattcgtctcgcaatttacacataatctggggtaattatttttttctatatttaatacttcatgcatctgtctaaacattcaatgttgtctaaacattcaatgtgacacagtgaaaaaacttgccagaggatataaacatgcccttctagcgaagctgcttcttctttctttcttttttttttgcgatcgcacatatacaaatttgtcgaagtcaactatgttatcacgatggaaggacgctcaccacacaaagttacactattttattgttatctacttggactgttccttctatgtaggagtattaacgaagtgatacggacggttaccaaacctaggctgccgtgtttagttgttaggtcaattttttttactcatacggacacacatcacatttaaagtattaaagtagactaataacaaacaaattacatatcccacttgtaaactgcgagacgaatctattaagtctaatcaaatatttactgtagcactacatagccaaatcatggtataattaggctcaaaatattcgtctcgcaatttacatgcaaactgtgtaattatttttttcgtccacatttgatgttctatgcatgtgtccaaacatttgatgtgacagaaattttggaagtttaaaagtaactaaacacggtcctaactaactttcatggaaatatttatgtgcatgcatgtttgaaggagatgtttatactaggagagtatctttgaaagaaaactactacctctatttcaggttataagacgttttgactttagtcaaagtcaaactgtttcaagcttgactaagtttgtagacaaaataataacatttttaacccaagacaaatttattataaaaatatattcaattattgatttaatgaaactaatttggtattataaatattactatatttatttataaacttagtcaaatttaaagtagtttgactttgaccaaagttaaaacgtcttataacctaaaaacagagggggtaccgtgttttttgagtaaaagattttcatatgtaactctagtataattgaaatgtaatactacacttttactgtattgtaactatactatatctacgatataactacgatatagaacctgtattcaagtatagtttggttagctagcaccggaatcttacacgtgatatgggtggatttttttttccttcatgcacaaatctcgaggtgatccgatggtcacagatctagaaattttgagggcaaaaaacttgcagaagttttcttccagttctgtaataataattatgtacctatattatcaagggcggacccaacatttctccatacgtatcagagtctagcacctctgtgggtaaaatagaacgggagagctgcaaagcagcaacaccgcccttttttctttctcatcttacatactaaaatataagggattttgattagatgtgacacatcctaatactattgaatatctggactaagaacatgtctagatttatagtactataatatgtttcatccaactcaaatcccttatattttaagaaggagggagtgtttttttttctagggatagaaccaatggatctagccaccctagccatcccctttacaaaggaggagatcaagagagcaatggataagatgtcggggaactaaactccagatcctgatggtttcattagagggaagcttccacaaggtgtgcttgttgatgtaaaaaaacacacacacacacactggcttagatatttgttttactctagtgcaggtactaaatttgctttcgggttcagagcgtgctagttggtttgatcttgcaaccaacaagaaacaaagaaaccaaagtttaatccataaatgatggtggatcggctagattgccgatgatgttgaaagtatatctaggacccctcatttattttggtgttaatgacaacacaattagagagtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagaggaatgccacatgcatataattggtagaacactagtgctcaaaatcatttatttgaagtgttcctgttttatgtctgtcggactatcgatgttgatcagactatccgatgctcagactatccgaaatttcatagaactttgctcactgtcttgggtctgagtgttggctaaaaaaaatatcggactatccgatacatcggactatctgaaatttctcagaacttcactctctgttttgaattgctttttattcctttttgagtgagttttaaatcagactatccgatgtgatcggagtatccgatgatccagagactccgaaattcaatggaacttgagtctctgtgagaggatgaaattcttggttcaaaaataacggaatatccgatatgaaatcggactatccgatcgattggattgtccgaaattctccagaatttcgttctctgtctctggcctgcttgggggtcaaaaacatcggactatccgatgtcacctcggactttccgaggtgggatgaaaagattctctcccaacggccacattttgggggcttctataaataccccccacctaacccttttctagggttacccaactcattcattcatattcactttgggttgagcttggtgctaaggtgctttggatctttgagctctctctccctctctcaaatcccctcttgttctttgtgtggtggatcttggtggttgtggatttggggtttgagggcctagtgtgtgtttcactcgatcttgagcactagggttgaccaagagttgtgtggtgtttgttactcttggaggttgaggactcctagacggctaggtgtcactcccgagccaccgatctacgtgtggttggccgggagaggtttgtgaaggccggatctcgcctccacaaggaaagagataccccttagtggaaggaggagtgcttagtgcaacctcttgaggaaagggctagcaaagacccggctcttagtgagctcctcaacgaagagtagaatcccctcaaggatttgaactccgggaacaactcggtgaacttcattgttggtgatatctcttctcccattatttagctttgctttttgtgccactatagatctagtcgctgtttgcgccatactcttgtttgtgcactagatcttcttgtagtgttcttttagtggatcagacagtctgatccaacatcagactatctgatattttcgaatagtctgactgtggatcagactttccgaccctaactcagttttagcttccgcataaagttttaaattagcctattcaccccccctctaggcctaattgaccctttcagacgtatcgtctgagatcaagccgatgcgatatcattcagatcggcaatgaagtatatagtaaataaagagctaaattcactttatcggttgtagatattaacaatatataatatatactttaaaatatgtttaaaccaagcgatttggatacatcggacagccatcgagacagtataaatcacttatgtttaaaagtacctcaaatcaaagattatataagctcggattatataagttcatgtcatagccgataggtaaatctagcgtgttgatgctattattccgatacttctttatactaagatatcattatagattaactatattaaacaagtataaatctgttattaggatgacctaaatagattgatatcaagcttaatatatttaatcctagtgagatcttaatataaagggcagatttagcaaatagttatgaatgtgggaaatgatagaatgacttacattatgaaacggaggaagtaaataaatgaaggacaagatagataaaccaggtaagatcggctgaaactccgatactatctctattaacaatcatggagcaagctagaaattatggttctaggtattacttaatagatcaaacttatctgatgcagcattaagcatagagagaaacacannnnnnnnnnnnnnnnnnnnnnnnnnnnnnnnnnnnnnnnnnnnnnnnnn

SEQ ID NO: 9967 - DNA, 1163 bp, Oryza sativa
  unsure (1)..(1163): unsure at all n locations
nttctatcaagcataagcatagagagaaccncaagttctatcacccagccaaataaagtctttttcagattggtggatatactatataatttaaatcgtcaacattatctaattctatctgtcagggttatggataccacatacctaataatagttgactaagctcagcagggcccaccacatatcatgtcttatacggaaacaaacctcgtatatagagggaattccgtataaggaaggacaagaagagttttatatggaaatgacaaggactactcggatcgtatccatatttatctccctagtcttacttagacaagggggcatctatgggtataaatacaagcccccctagaaggagaggggacacacccaccacaatctacaaagccacaagccaatacgccaccagacatcgacatcagatattagcctagccataccccatccggctccgacggaggccggcaagagggatctagcgctatctctgatctcgccaagttcgtattcgagtaggaagactaccctgccgtcgactacaagttggttatctagccaccaagacgacgacagttagatatgttatcccaattattgtacttgtgtgatccagatgaataaagagcaacaccggcttcggccaacaggatgtagggctattacctgtcagataaggggcccgaacctgtataaaaatccatgtctccatctcttttgcctcaatctcgcatatactctggtaccaacgatccccataccatccaaataccgtagtcacgataccaaacgtggacacgatcagctgatttcgatgatagaggctagtcgacaagatcagatagtaatatcaacctagattatatagtatatatgataactcagtgattcacatatacaagattagagtgtcataaagatgtggctactaatccctgagaacgctagccaccatagcaagtcttacctcttgtcggagatcgcaaccgatgcagcccaactcgaatgcaagaactcgtcgagtcaatgaaaagtagaaaaggtggcatgcgccgaaagtgtattgaactggtgttaattatttagggttaattggattcataacattatacatttcacggtttgtnatggcatagttctcactcaaaanttcaagtccctcg

SEQ ID NO: 9968 - DNA, 898 bp, Oryza sativa
  unsure (1)..(898): unsure at all n locations
agatggactgattgacagatcgacatgtagcncatcacggttgataccgactcggataaggagaagccgatgtagccgatttcggcaaaggaatcttacagtcattgctggattagatttaaatgttgcaaaagtactgccaggcatggattgcgtccgaagaaggcaactatatctattaattatgatattttagtagtttccttatagatattttcggtaaaagtccgccttagggacttgttcgtcttttagagttgtaatagaagtggagtcatgtccgatgtggatatatattgtattttgggtataaatatatgcccgagaccttgtaaataaatagggttaattagatccatgtcattataactttcacgcttttgaaaaatatcattgatatttaactatttagaaccatgccattattatttcacatatatctattatatgccactacttacctattcaacacaatttataaacttttaggaccaaattgccatgtcttcttcatccccttccccctctttcctttcatcttctctctgcatctccttatcccttcaaacaacaggaggttgcccagctgcttctcttcttgtgggaggcgatggacttgtagaggaaggtgaggaggtcgatcagggcacacattggatggcagtaggaaggacgcgagctcggcaacagcgtcagagagcttcttcccgatggactcgtagatcttcgacgtcatcctttgcgagcaaaaccgagtctgcgcccagagccgttgccgccgcattagcctactctgtgacgcnacacgcatgtgcagagcctncccagcaccattgcggcggcaagtatgcgggcacgatgcgacctgctgacatgtgcgcgagttgacgctgacggt

SEQ ID NO: 9969 - DNA, 783 bp, Oryza sativa
  unsure (1)..(783): unsure at all n locations
ccctgcccccccccagtgaggtgcactctcctccgactgcaagnagttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccagacgccggcggcggaggagaagccgacagtggcggcagcgcagacagcaccggccgctccactcccaaagctggacggaagaggggaaccggccgacagtggcaaaggcagcgctcccctcgctctcgggcagcggcaccggacggaggtggagagccgtcngtcggagggggatgcccgcgccggcggcgtcgccagcgggtagcaccggatttttttttggtcccctgctttatttntgcaggcggggcaaggacccgcctacgaaaatcacctattttcacagacgatgggatagcggtggatgactcccccgcctacgaaaaccgtttttgcccgctgtgaaaactatttttctagtagtggatgccgccggtgtccagaaacatcacgaacgcgatcaccaccgcatcn

SEQ ID NO: 9970 - DNA, 27184 bp, Oryza sativa
  unsure (1)..(27184): unsure at all n locations
gacgtgacgtgcgcattccatttgcacagnncaccatgggttgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagaaaataggccattttaatagttaatttaggctattttggcttcaatccaaacacaattttacctttgccaaaattagccatgccaaaagttgccaaaatttaacattgacaaaaattggtaaggccaatttaggccacaaaccaaaccaaccctaccaaattttgtcaatgccaaattttgacaagttttggcataactaattttggtatggcaaagttgtgtttggattgaagctaaaacagcctaagttcactattgaaatggcctatttttttaggcatatcaaaatttggcttcaaaccaaatagatactaaacattattaaaattgccaaatattggtaagcctaatttaggcctcaaaccaaaccagccctgcaaaacctggacggggccactgggcggggccacggacgcttctacacttggccataacctttggtaggagggtacagcgcgctcggcccatatacttgatcagccgcagcagtgaactgctggttaggcgcatatccttgcggcggatatcccgtcacaaccggtgcggcgggggcctgctgcggctgcggctgctggccgtcgggcttaggctcgaccgccgcggcgacgcgaagcatgatgtaggacttgatcccgaacacggcggcggcgaggctcagcacggccgccctcctgaagacgccgtccttgaggtagtagcacagcggcgccgtgtcgcgcgtcaccggcgcgttccacgccgcgccttgcacgaaggacacacccgcgacgatcgccgcgatcctgtacacgaatattttgtgggggaagatcagatttgcatgcgcctcaacattgaactgtcgattgacaaagagacccgaaggccgaaggtacacacggttgttggcgagagggtgcaattacgtacgaactcgtggaactcaccatgagaagacagagcagacaatgccggtgacacgcctggactcggaagcgcccgcacgaggcctgcagcatccgcagcagccggcgacggaggagacgatgatctgagccaccggcagcaggagcaccgcgcatattcccagcacgaaggcggcgttcgccggatactcgcactcgccggtcgacacgatgatgtcttcgggctgcaacaacgaataaaattgctcatccacagatcacagaattcggaacactagtgcagcggagaatcaagatagatgtgagccatgtgatgtgacagtgtagcataataaaaatcgctgtgcttgttacggtgagttttttctcctcggcgatgaaccccaggacggcgctcgccaccgcgaacaatcctaccacggcggacacgacgaacactcccgtttccatctctcttcaaatgctgaaatgcctatgtctctccctgtcgtgtcgtcttctctctagcctctagctttgctctgagatgagaagcgatgctgccatacacagtatttatactgagcgtctcgtgctgaagctattatttctatgatcattttattctgaatttgtgctagctaatacctgtgcagacgtgcagttggtctgtttcgatgattgcgttgaccctagaaaacataagattcatgagacagctagtagtagcattctgaatgctagctagccagctcgttaacgctgccatctggcatctgccggcgcgatgatcgctcgagttctataagcatgctgcctaattaacctaggacaaacataaacattatgagctgaaaaagacacgcagatataaacgcatgaactatttctttggacaaaaaaaaagaagcaaactggggacaagcctgataacataaataactgctagaactgaacagcatggtgtttatcttataccaacttgagttgacactgacgaggtgacaactactggttaatcatgatctgattgcttggataatatagtgatatagtttatcagtttaaaattattccccgcaattcctgcccatgttcttgaagaaactgaccacaaagaacatcagttggaaacttggaatgtgcaggtagctagagcatcgcctgccgttgagtcaaagtcagctcgaaactcaagacgtgcatccgtcaactctgaggctgtatataggcgaggatggattctaatcttgcccgttcgtccgtttcttccacgtaactaaatggttatattttttttaaaaagtaataggatagattaatacataatatatcactctacaaacacttaaacttaaatttaaatttctataagttataataaaaacaataaattaaactttaattagtatatatatttacagacaatttgttttttttataatttataaaagttgaatttaaacttgtatgtttgtggagtgatatattacatactactaatctatcttgttattttttaaaaaatgtattttataactatatatttaacatgtaaaagataggtgaacgtctaccgagtgctaaaaaggggtccgaatgtttgcagttgcagagcgtcctgattagccggcggcttcctcgacaatcatctggggaagtcagtcaattagtgcctgatcagagagacgctttgcataatgaacacaaagaacaaaatggtcatctctaatggttaaacgatctgtttaagaaaaaaggtcagtgcttcggagatctgttatattctatcactgcctgttcacttagtgccaaatttgaaccggcataatactgctcatagttttttttttaggaaaagggattatattacccaactaaagagtcttcacaaacaaaatgtgagatgaaattagatttatcatccggccaaaactcaataagagcgaaatggcctataatctagtggttacaaaagtcttagtaacaccttagatcttaagtttgacttcctgtataaacgaatttttcaggatttaatactgcagagtatcctcactcgtctcatggaggcacgggaggttgagcgggatcctgacaacaacgacaccctcgaccggagcaactactgttggatctggcggcatgggcctcgagccctctggacacatatagccacgattgcctcaggtgcctggatgatgagttgatctgtaggcatatggtactacttgttctttaatttaatttgttcttgaatgttcttaaatttgtgataatcaattcggctgtgatccctcatgttttttccttctatttttcttgcaaagttgatttggcatacgatttacttgcaaatgttgcaaatgtgtgtaaacatatgaattgggcatcaatataaatcattttgactttcttttttttttctgaaaataggtatcagtgattgtagttgagcaacatggccgccagcctactgttggttaaaaaaccggcaacgtacgtacgatgccgtttttgaactgttagtgatggccttctgtttgttgatatatagtgtgatcacggttgactcacgtgatcttctgtaacataaccccaaacgaaaaccatacaacgatctattatattattaaaacagctatgaaaggagacaccacgtttgctgtgggggttagaaattcccgcattaatcggagaaaaagaaaacaagagtccaattagaaatacaattaaaattagctgaaattcagaattaaaaatacgcaatatggaaagaggagttcatataggaacccaatacgtgattaattaaaattcagaataataataaaataaatatcaaaattaggaaaagaaaaaaagaagaattcaagtaggaatacaatttataaataactgaaattcggagttaaaaataagaaatattaaaagaagaggacatccaaaaatccaatacgagattaattaaaattcagaataaaaaataaaaaaaatcgaaattagaaaaaaaaataagagttcaagtaggaatacaatttaaaattaacttaaattcggaattaaatataagcaatattgaaataagagtacatataagaacccaatagtagattacttaaaattcagaataataaataaataaaaatcagaaattaggcaaattaaaaagagagttaaagtaggaatacaattatgaaacaactaaaattgaaaataaaaatatcaaaagaacataataataaataaaataaattctgaaattagaaaaagaaaaaaaagatttcaactaggagtaaaatttataaataactaaaattggtgataaaaaaataagactattgaaagaaaagaccatctaaaacacatgacaaaattaattaagtaataggcctatagaggagcaaagtggtggcggttgatgagacatctaaaaactattaataaaacaccaaatagaatcctaatgacgattaaaaggaaggacgacgggcatgtcgtgaagcaatcagtcagggacttctagaaagtaaaaaaataaaccccaatgataatcatattttatttttaaaatctcaattacaataaaaaagagaggcagcgggtgggtcgtataggagtacgatggtagagccgccgatggttggtgggtcttctagaaagtaaaaaatgaattccaacgatagttatgttcgatttttataatcccaatgataataaagattacgcggcggatatgtcgtaaaggagtatagtggcagcgtttgacgagatttctaaaaattataaaaaaaacatggaacccaacgagacaataaaactctaaaaactataaggttcaattttaaaagttcaggcttctaaaaagtaaaaaaaataaaccctaatgataattatgtttgattttaagatctcaatgataataaagaaggacggcaacgggcgagtcgtagaggagtacagtaacaaagttgctgacgttttggcggaacttcaggaaagtaaaaaaaaagaaacttctagaaagtaaaaaaatgaacctaaaaaagaaacccaacaggacaataaactctataagtttttagatccaatttttaaaggttacaagaagaatgaatagaaacagtggtagatcgagcaagctaataaaaaaataatatgacagaagtaaggggtagcaactgatgtgtcttttaaaaactataaaattagaaacacgaggatgataaagtttggtcttttaaaatcttaagacaacgagataactatttaataaattttaagtaaaatcatattagaaaatatataattttatatgggtgctagccgtgcaattacgcgggccacccagctagttggattttaattaaactctcaaagaacatcccttgttatttgcatgtcactcaaatacttataaacaaattaaaaataatctaagaagatttcttaagatgtgatatatcctttcacaaacatgcaagttaaaattctatcctttgtaagttgtaataaagaaaaaactatagctagttaagatgtattcgtagttaaattcttcacgtttgtaaaatgatatatcacatattaatctattgggttaatcttttttaaaacttttttcataaccgtttaagtgacatacaaataacgatgacgatgagatatttcctcaagagtttagaatggtttcccaaatattcatgaagtgagatgctatttggaatatatacatatacgtgtattttacatgagagactctttacagcaagtcagcaaccgggcatatataataattatttaagtatatcacgcataggttcactgtcacgtactgacttacagtgctacacctgagcatcccctggaggaggatgaggaggcaacggctgatccggcgcgtgcgatccgacttgagcaggagcaggaaaagcggcagcgacctgcggctgcgggttcagtgctcgtccgtcccctccttgctgtggcggcgccggcggggcagaaacaggaggagacaactgggcggccgggtggcccatcgcgatcccggccgccggcgtcggctgctgctctcccggctttggcgtccgtactgcctcgttgcgttgcccgcggagcgtgacgtaggaggcgatcccgagcgccgtggcggcgagggccagcacggccgcgcccgcgaagatgccgtccttgaggacgtagcactagcacaccggcgccgtgtccctcgccacgttggcgttccacgccgcgcccaccacgaacagcacccacgcgacccccgccgctatcctgcacgtacacgtacggccccacgcgatcagctacgtacgcacgaggtgatcgatataaccaaacgggaagcggatcctctgactttggctccaaagtcacggttgtgcagttagcattgtatcaaccgttgaaacaatgagacgacgacggtgacacggtggccggcttgtgggatcggcggccggttgcatcatgtaccatgagacgacggcgcagacgatgccgacgatccgcttggtctcggacgggatggcgcgggacttgcagcagccgcagcagccgccgacggccgtcacggtgatctgcgccatcagaaggaagatggccgcgcagatccccagcgcgaacgacgggttctgtgggtacaggcactcgtcgccgatcagcaatacgtccgaaatctgcaacaaatcattccccgtttgtcacgcatgctcactggagtcactaatcactaattacgctcatcagtcatcacatgtatatcagagaacggagatatctaaagaacatgcatgcatcttagcgcagtatgctcacaatgatctttgtgccctcggcggagaaccccaggatggcgctcagcacccccaggggcccgacgatcgccgacacgatggccaccgtcttgtccatttttcccggccaccctcctccctcgtcttggtgcgtttatatacagagctttttagctagctcgggcacactactggagaagtgggactttagttccggtttgcaacccctttattcccgggttgcaaaccgggaccccgaatccggtactaaagatgtccaaaataatcgggactaaagatccatgaattgacatcacaaattcatctatgaattgacatcacaaaatcatccgcaacttgacagaaacattaaaaaatcatccacaaatttacatcacaaaatcatcaataaatacacagaaacatctaaaaatcattcacagaaacatctaaaaatcattcacaaatttacatcacaaaatcaacccaaaaatcaacacaaaatcatcacaaagtcatcgatcccctccggcttgcccgccacctgccacctcctctccgtgtgcgccgccgtcggctgcctcccttcggcgcgcccgctgcacgtgcgcatccgtgcgcgccgccgcccgtaccgccgccttccctcctgcctcccgcgcgcccccggccatctgccgctgcttgcgccgacaacgtcgaggggaagagggatcgatgaaagagagtggacgagaggagtggagggaggattggaggaagagtgtagaaagaagataaggaagagagagagcgcgagagatggggatgacgcaggaatagagatatttattcccgattggtatcatcaatcaggattaaagatctatctcccggttggtgttaccaaccaatctttagtcccggttggtgttactaaccgggactaaagatcaaaaaatacctatggctttaaaactgggactaaaaatgtttttacttcccattcctacttaaaccgggactaatgatgtttttacttcctgttcctactcgaattgggactaatattatttttacctgacccagcaaagataacttatgcagtagtggcacacgctgatcgctgatcgcatttcgatcgaggcatgcggccgtaatttctccgtggatatccgtttaagcaagtttggctgcagcctacaggcactatggacagctgcgtctttgtttacaggtttacaccgaccctgccggcacggtaacttgtatctatatggctgcatcgataatttgctgcgatgtgcttacaaacatactagactggagcaaatattgagatatcgacttggagctcaattatttctatttgaacatctacgttccgccttggtagtcggcagatcttgacatggtttttggatgtttggtcctattaattccatgttttctttgggggtactaattccatgctatattgttttccttagttcactactaaagccgttattgtcgcagctgctaccgccgtcgctgcagccaaagccaccatcaccaccgtcgctcccgccacttgatgccagccaccgccatctccgctcatgctgtccccaggcggactgagcggatctgccactcccgtggcatcgtggtagatccgcttggtatgaggccaccgccacttgccattcctgaattgggtggatctgctgccctcgtaagtgccagcggtggatccgcttagtccgaggccgccactgctgctcccgtcgtccagtccactgctcatcgtcgcaactgcctagcctgagcctgaggctggaccgaagtgggagggagagaggggaggggggaagtaggggagatgagtgggaaatgggaagagaagagaggagagaaaaggggagaggagagataaaggggaggtggggaggccagacgcgctgagagaaataaagagtggacgaggggttgttgccgaactgcacacggaggagagaaactcttgcttgtgaaaatccatttttgtagcgggacctcttaagcgaaaataggctatttacgaaaattgatttttgcaggcgggccttaaccaaaccgaacatcacccaaatatttttacatagatgtttctttagcttgtctaagataaaataagggatgcggcgtgtagtagtgagtcaagatgaccggttggtagacaggctgaggcacatattggtggcccaacgtatacatgctactagtgtgatatcgtcggaaaagaaggatttcatgttggttgtcctagccaaagcatggtcaacccgtcgccgaagcctccatggctgatgagaacatcacctcctttcaatacgcatgaggctaagagatggagacccacctcgttatctaggagcaggccgcattaaaatcgtctcctagcctcatttagactatgttttcaatgttctacatatgtatgaaaagctaacgagaacacctttccaatgggtctggtctcacgtcaagactccttataagtctatgggaatcatttaagcaagagagcgtccagaatctgcccaggtgctgcgtcaccgtctttaggctcattgggccgagtatcgtgtcggagtccattagggacgtatccagggggttctaggtcgatcctagaacctatttaatcaatagccgtcattgaattagggttaggttttgctttgattatatattctgtcattgtagtttcgctgctaaatcgtttcatggaatcctaacttgtgagattcatcttaaattcgcaatatattcagattgcatcttctactctcttacctatgttcttgattcgcttgcaagagatagtcttattggcgaggtcaacagttgtttgactcgggtgataaccaatggaggggtggtgtgctaattgcgagtggttcggtcatcctgattgaagccttttaatcattaacgtcgagtttccacaatcgatttattagcggaagatcgggaccctaatcctcatcaatggcttaatgggtagcagcctggctgacacaaaaaatatgagatatgtgtggacggcctgtgatgtaagatgtttacaatgaatttgacacctttatagagagtttaaatttgaaaacataatattatatcctttctaactttgatcatatttttagcaaaattatttagagataaaaacgagtgtaagagtatcaacaggttttattctaccacgcggtaggcccgtctaaatatacttggccaaaaggcccgcaacccgatggtatggttcacggcacgaagatttggcccgacctaggcacgacacgacccgactgttatctggctcgtgccagcccaacccgaccaatgggtcatgcctgggcctcttcctcggcatgataggccggcccggcacggtccagcccaacgattagggaggcaaaatatacttattacagccatgtaaggcacgactcaaagaaataagggacgcaaagtgcacttatttccaaccatataaaacacggcccaagagatgagggaggtaaaatagacttattctaaggcgagcacgatgagctgcttgtgcattcataccagcacggtacgacccgcgccttattgggtcatgtctaggctgcatttatagcctgtgggctgacccggcacgacataaaaagtatgccgggccgtgccagcaaccagcccgacatgctttgagccgtgccctaaagtatgccgggccgtgccctagatggggctgtgatcggaaacgatttggtatcgtgagatactgatacctcgagatactttttattgaactgaagcaaacctcgtacaaataatttcagattccgtggcctgtgcagcatgagaaaatcaaataaaacttaccgggagatcgtcccgccattgtcgacgaaagaatcaccatcgctagcagcagcagaatctggagcaagaaacttgtcgtgttcatcttaattaattatagctagctaatttaatttgtctaggaaatttgttgtgattcagctttcagaataacgaagcacaagtgcaggacaaagtcgattagaggaatttttgaagtccagggcatcgacagagatgggcaaaaccacaacatgctgcagttcagtgccattgtgccaataccagggatgtttcgagtcacttgtttatatgatggatgtatttttcagccggccaaactcagggtcaactggtggattctttggctttaatttgtggcgttcgttttccgtgcactaattaaacagttacggcgacttggcagcttaactattttcttcgttgtcattctaaaaaagggcatgtaatagtcggcgactaactgtactactactcccttcaacccaaatatttagagtgattataccgtacttaataaggtatcaagagtttcccccgtaatatttggtaactccggtattaacaggtactatcaaatttatactaaaaatttttatacatctcactactacataaagatttttctgtacgaaaagccctatctttcacacatcttttatgaaactttaggacatatcgggcagaaaaatctatatcaattattttgtactaatgagcactataaatataagggatttcttctataaacatagaagtagtaaacaaccaaacgtacgaagaatgccaatgatcacatacggggagtagacaactaaacatatgacgggtggcctaataactatccatctaagtgatatatataccacatagtgaatttttgactgacctgtgtactgaatcaagagcgcgttgcattgtggtggattatgactctacgctgacaatgacatcaacctgccacttcaaaatgcctctaaaagttgctttatggaaacagtcaaagtatatgagctgaacacacccacagtttacagagaaattttagtccaaacaaacaaagttgtgtcgtcactggtgaccaatataaccagggattgattctcttctgcatcatttggctgtctatacttgtgaatctggcggcggcgggaactgcggttggcccatcgcgaccccggccagcggcggctgcttggccggcgcctcgtcggcctgcctgcggagcatgacgtaggacgtgatcccggaagccgtggcagcgagtgccagcacggccgcgccagcaaagattccgtccttgacgacgtagcagtcgttgttcaccaccgcgcccatcccgaacagaaaccacgcgatccccgccgctatcctgcatatccgctcccacgcacgctcgatcagtttcggcatgaatcacggttcgtcgagtataaccacaccgtaccggcggtgatatcggcggtgactaaccatgacatgacagcgcagatgacgccgattatccgcttggtctccgacgggatggaccgggacttgcagcagccgcagcagccgccgacggccgacacggtgatctgcgctaacagcaggaagacggccgcgcagacccccagcgcggtcgcggggttctccgggtacaggcacttgccgccgaccagtatatcggtcacctgcaacaacatcgttggccgtcgtcatacacactgataccactactcgcgcatgcaccgcagcaagctcatttttgcacatgttgtacaaggaaagacatcggtagtgtgcttacagtgatctttgtgccctcggcggagaaccccaggatggcgctcagcaaccccagggacccgacaaccgcggagacgatgatcgtcgtcttgtccattttcccggccattcttctcccaagtcttcccaagccttgccttgtgtgcgtgactgcgtcggtctttataaacagcgaacgagctgccccacttctacgatgtcaccagatttacgccagcacgcgattgggaggaagctggtaacgaaacaggcttgcttaggcaaaagttggcaggggctgttgacagatgcgggtgtctttgtttacatcgagcatgcagccggcacggtaacttgtatcgaccaatcaaattgctgtgctgtgcttacaatttacaaaacggtacgttctattgttattcccaagaaaagcgatgttcacgaattcacaagccgacaatcggttttagcatcggaagagaattctcacagtaggagagctaagtgtgtatatcagggaaaactctattcatccaaaagatattccctcatttttacatgtcacttaaaagttatcaatttttttttaaaaaatagtatgatagattaatatgtgacatgtcacttcataaacatgcatatttaaattcaacttatacaagtagaaacaaaaataataaatttgactacgaataaaacacgtaattcatggtcatatttgttatttttgtttcgaattgtataagtcgaattttaacttgcatgtttgtgaaattgatatatcttcataattttttaaaattttttgattacttttttaatgctatgcacaaaacaaccggatgtcggacaaaaaatccacttccgcatatcggctcaaataatgggatggtttcacgttactcggcccagccgaagcatagttgggccctgtcgagccaccacaatatggactttgtttcggcccactaaacgaacattactttgtttcggatggttcattcctcatgattgatatcggacggtgcaaaagaattgtggtgatgtggaagtgtaggaaagcaggaaaataccattaaattacactaagtggggatgatttgtatagatttataggattacttgctaatctatgtgatttgtcttagcttttaatttcactaagtggcgatgatttgtataggtttataggattacttgctaatctatgtgatttgtcttagcttttaatttaggtgtgatcatcttcttagaggaggggtttatagattcacaaccccagatttactcaaaacacatactccgtaatcgtcgataggttttaattaagaccttaccaaattttaatggtgttaggtgagtggaaggttttaaatctatcaaaattttttggtagagatcgataaggttccatcttttctaatttatttacatactaaatttgaataatggtaattgttgatgggagcaagtactacttcaaagtgataattatttaagataaagtttaaatcgtactagaaaacaactattttaggatgatgaaagtacatgccaaatgcgttgtacgagaaacgcaacatcacaaatcacaaaccagctcgtaaaatgggtgtgtttagttcacactaaaattgaaagtttggttgaaattgaaacgatgtgacggaaaagttggaagtttgtgtatgtagtaaagtttagatgtggtggaaaagttaaaagtttgaaaaaaaagtttagaactaaactcggccatagtcacttaatttccaaacttaagaaagctagcatgtactactacacagtacgtgcatgtatctcatatacacagaaagcacgacacaaactttatgactacaccctttggttcgagtcacagggtgacaccatgacatatatactgaggtcacggtactacacctgtgcgcatgggaaacgttgctggttcggcgcctgccatccataatagccttgagcagaagcaggtgccgcgaattgctggttcggtgcttgcccgtaccacccaccttgtggcggcaaagtagccggatgagcgaacggcagctggttcggcggcggcgcttgactggcaccgattccctgagccggcacaggaaccagaagaggattaggatacaccggctggaacgcgatgaccatcgggaccacgatcgcggcgtgggctcatcatcatcgtactccggctctggcctcgtgcggagcatgaggtacgtaggaggtgaccccgagcaccatggagatgaggaccagcgtagacgccctcgtggatcttgtcgcaatccgaatcctcgaccgcggcgtgcaggagcaacacaaacacaatcaccggcactatcctgcacgcaacgcaaaaaacgcggcgcttgccgtgtatgcatgtgacgtagcaacgatgcatcccatgatcgatcagagcgcgtgtgacgatgggtcactcaccatgaggtgatggcgcagacgacctgcaccgtctcggagaggatgcagcagctgcggcagccatggcgacgtgtgttatcattaggaagatgaccgcgcagatgcccagcttgaccgctgctgatctcgacgagccgtggtcaacttaacactgatcactactaaaaaataatttttagcaacgttggtcttttatttttccagacgggtatgaccattagagccaaatagccgcctacaaaaatacaaatcagagtgaaacctgctgcctgcccgcgaaaatccattttcgcaaacggaccacttaaacggtccgcctgcaaaaatacatttcatttatgcaagcggatctcttatgtggtccacctgcgaaaatacatagcgaatataaatagaggctacataccctagattttttctaagtcctctttctctcgcctctctcccggacctctcccctcccctaacctctcctcctctccccggcgctgacggcagcgtagggtgcacggcggctaccgttgaaagcggcggcggaaggcggtggacggcggccggcggcgctcccctcccttgctccctcccagatctggcctgaggggggcggggggagggcggtggccacgcgtgcggcggcggcggaaggcaacggctaccggtggaggcggcggcgaaggccggcagctaccggcgggaggcggaaggtggtggcgggcagtggcgaaggtggccggcagcggctctcggtccctccctccctcccagatctggcctgaggggggtggggaaagggcggtggccggcgatgctcccctccctcgctccctcccagatttggcctgagagggggcgggaggagggcggtggccacgcgtgcggcggcggcggcagcgggaggttggcggcggcgggaggaagggggccatgacgatgtcagtagaggaggaaccgatggcctggtcagcgcgcaaggagaggagcagccggccaagaggagcaaacggccaagaggagcggcggcggctctgggcaccaacttccttccccccagacgccggcggcggaggagaagccgacagtggcggcagcgcagacagcaccggccgctccactcccaaagctggacggaagaggggaaccggccgacagtggcaaaggcagcgctcccctcgctctcgggcagcggcaccggacggaggtggagagccgtcggtcggagggggatgccggcgccggcggcgtcgccagcgggtagcaccggatttttttttgttcccctgctttatttttgcaggcgggccacggacccgcctacgaaaatcacctattttcacagacgatgggatagcggtggatgactcccccgcctacgaaaaccgttttttgccgcctgtgaaaactatttttctagtagtggatgccgccggtgtccagaaacatcacgaacgcgatcaccaccgcaatcctgtactatcacgcagtatggtgcacacacatacgtggcggagtggcgggcgagcggcggctcctggcgcagagagaagataaaaccgaaagggaagaagagaaaaaagagtagagaagaagattgctgactaggattgtttactccatatttttttttcttacttacatgtgggctctacatatttttttattttttctgattaggatgccacgtcagcgaaaccatgcatctatactacttggaacttttttttgacggttttatatagttaagggatacacatttctggtattgcagttaggagatctcagacagactcggcgtacaattgggggaccttaggtgaacttattcctttattctaccacgcgattgaaccatgtaaatatagttgtccaaaaaaggcccgcagcccgatggtatggcccacggcacaaagatttggcctggtctaggcacgacacgaccctgtcaggctcgtgccggcctgactcaaccaatgggttgtgcttgggcctctttctcggcacgacaggcttgcccagcacggcccaacccaacgagtagggaggcaaaacagatttattccagttatataaggtacgactcaaagaaataagggacacaaaatgcacttattttcaaccatataaacacggcccaaaaagatgagtgaagcaaaatagacttattctaaggcgagcacgatgggctaatcgtggtttcgtatcggcacgatacgacccgcaccttattgggttgtgtctgggctgcatttatagcctgtgggttgacccggcacgacacgaagagtatatcggccgtgccagcccgacatgctttgggccgtgccctagatgtgcctgggctgaggtcgtgctgggtggcccatttggctgtctatacatgtgaagcctgcggcggcaggaactgcggttggcccatcgcgaccccggccagcggcggcttcttggccggcgcctcgtcggcttgcgttcggagcatgacgtaggacgtgatcccgaacgccgtggcagcgagggccagcacggccgcgccagcaaagattccgcgcttgacgacgtagcagtccggcatggttgcccccttgccctctatgttcaccaccgcgcccaccccgaacagaaaccacgcgatcccgctatcctgcatatccgctcccacgcacgctcgatcagtttcggcatgaatcacggttcgccgagtataaccacaccgtacctgcggtgatatcggtggtgactaaccatgacatgacggcgcagacgacgccgatgatccgcttggtctccgacgggatggaccggccggacatgcagcagccgcagcagccgccgacggccgacacggtgatctgcactaacagcaggaagacggccgcgcagacccccagctcggctgcggggttctgcgggtacaggcactcgccgcgcgcgccgaccagtacatcggtcgcctgcaacaacatcgtttgccgtcgtcatacaccgataccactactcgcgcatgcaccgcagcaagctcattttcgcacatgttgtacaaggaaagacatcggtagtgtgcttacagtgatctttgtaacctcggcggagaaccccaggatggcgctcagcaaccccagggacccgacaaccgcggaggcgatgatcgtcgtcttgtccattttccccgccattcttctcccaagtcttcccaaggcttgccgtgtgtgcgtcactgcgtcggtcttcattaacagcgaatgagctgccgcactactactactgtcaccccatttacgaaaactagctgggtggcccgcgcaattacgcggctagcatctatataaaattatatattttttaagtatgattttacttaaaatttattaaatagttatctcgttgtcttaagattttgaaaaaccaaatcttatcatcgtcgtgtttctaattttgtagtttttaaaagacacatcagttgatacctcttacttatgtcatattattttttattagcttgctctatctatcgctgtttctatttattctccttggaacttttaaaaattggatctaaaaactattagagttcattttcctgttgggcttatttttaataatttctagaagtcccgtcaaacgctgctattatactcctctacaaccgtccactgcatcttctctttattatcattgctattttaaaaattaaacataagtatcgtttaggttcattttttttactttctagaagtttcgccaaaacgtcaacgctttgtcactgtactcctctacggctcgtccgctgtcgtccttctttattgtcattgagattttaaaatcaaacataattatcattggggattattttttttttaccttttagaagcccgtacctttaaaaattgaaccttatagtttttaaagttttgttgtctcgttgggttttatgtttttttataatttttagaaatcccatcaaacactaccatatactcctctacgacccgtccgccgcataatctttattgtcattgggattgtaaaaattaaacataactatcgttgaaattcattttttactttctataagaccgaccaaccatcagcggctctaccattgcactcctatacgacccgtccgttgcctctcatttttattgtaattgagattttaaaaatcaaatataattatcattgaagtttattttttttactttttagaagtcccgccaaccgccttgactgattacttcacgacatgcctgtcgtatttccttttaatcgtcaataggattctatttggtgttttattagtagtttttagatgtctcatcaaccgccaccactctcctcctctataggtatgttacttaattaatctcatcatgtgttttagatggtcttttcttttaatagtcttatttttttatcaccaatttcagttatttataaattgtattcctagttgaaatctttttttcctaatttcagaatttattttatttattattatgttcttttgattttttattttttattttcaattcagttgtttcaaaattatattcctatttttattccgaatattatttaatctactattgggttcttatatgtatttttatttcaatattgcttatatttaattcctaatttaagttaattttgaattgtattcctacgtgaactcttattttcttttcttttttctaatttcgattttttatttttttattacgaattttaattaatctcgtattggattcttatatggactcttctttcaatattccttatttttaattccgaattttaattatttataaattttattcctactcgaactcttcttttttctttttctaattttgaaatttattctattattatttcgaattttaattaggttcctatatggactcctctttccatattgcatatttttaattccgaatttcagctatttttagattgtatttctatttggactcttttttttctttttctccaattaatgtggaaatttctagcccccaagcgaacgtggtggctcctttcaaggctgttttaataatataacatagattgtttaagccggacgttcggcacttggaaaaaaaatcggctcaccatcccatctactccactcgttctctttcaactccaccagccacatgctagccttatctcttcaacttcccaatttttctctctctagctctccctaacttcctacctagcttatctctctctgcacaacctcaccagcgacggagaaggtacgatgacgacctcaccggcgctggcatgccccacaactagcttcgaggctacggaggaggtgcgaccactagtacaataatgatttttccgtgtggtcggaatcagttttctcatgcggatcttccaatggtctagaacgaggtatctgcgaaaatcatgattttcacgtgtgggcgcccgcacgggaaaataaaaaaatcaaaaccggaacactaatccagctaacgccgccgccaccaccgtcgtcgtcaccgccttgcccgaggcctgcagccgtcaccattgtcgtcgtcaccgccttgcccgacgcccgccgccgtcaccaccgccgttgtcgctgtcaccaccgccgtcgtcgccgcattgcccgaggcccgccgccgtcgtccccgtggtcgtcgacgatgaatccgacctcgccgcggtggcaggcgacggatctggcctccccacagtggtcggtgatagatccgctctgccgccaccaccctaggcaggggtggatctatagttatagggttggtgtcaggcgacaccgacgactttcggcaaaatctatagcgaaactgcttattcatatactataacaccatgatctaagtataattagcatactatggcactgatagacgcgttctgacaccaacgaatcgattttctggatccgctactgaccttaagcgatgccgatgctgataccaccgctgatgctgccgccgccatcgatgccgctgcctccgccgctctaaccgctctaaccgatgccgccgcctccgccgccatagccgaggccgatgccgtgacgccgtcgccggtgtttgatggtattttggtgatatgcaaggattactcgtatttgccaaagtaagcaaacaatgtgaaagttatatgcactagtggagctggctctagcttgtcattctgtacgtgatgcatggccatgcaaatacatgcacaggcagaagcatacaccatgccctatatatacttggttaattagtatgtatatgcgcgcacgtgtataaactaaaggaaatcaagagctagtcatatcccatatgataattggctggtgaagcaattacgtgcatgcatgcatagcaatgcacaaacatattatatatatggtcctcaattaatggccaggtgacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagttccggttggtagcaccaactgggactaaagatcttaactttagtcccggttggtaataccaaccgggactaaagatcccggtgatctttagctccggttggtgctactaaccgagactaaagatcttaactttagtcccggttggtaataccaaccgggactaatgatcccggtaatctttagccccggttggtgctaccaaccgggactaaagtcccacccctatatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacgggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcagaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattctgctaaggtgatgtggtatttccctataatacccggctaaggcgtttgttcaggacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaatagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttatatacatgggtcatcgtcgattccttgcagcaaaccacccggtacggaagaaaggcaagcacttcgaacataaggccgaccaccgtacgaagcctaaacatcgcagcgggaaaacaatgtttggtatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaagacagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcttcgatccggatagattagaagcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgttttctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcttctcaaggttcctctgttccggtgccaatgggttagattgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttgatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatatatatatatattggaatttttattaattataagtcatatatttgcttattacgatttatccacttaatttattacagacaaaaattatttttcgaagtaattgtcatcaatctttgtactttaaataatgttaatgcattaacttctattttataaacacatatgtatgcgaaaatcatatgcagggctataatcttttgtcccgggtcttaaccctaaccgggtttaaaaataatttccaaatagcgggaaaagatatttactcccggttgttgagaacaaccgggagtaaagatccctgggttactaccggccgggggcgaccacggggtcttaagcaacactgcaaagtataggggcggtcgatctctttaagcctgagttactagacgacgctgactaggggaaaaacgcgcgctgacgcccgcgtatttcgccgaagtgtggagcgtggggtgctggccgacggcttcggcttcttcggtgccgacggatttttggagtgagaggccgcggatctcccttcatgcatgttgaactctcccatctaaatctctatcggccgtcgtcaacaccgggggctttgaacgccgacagatttggacggcgggcaatggcatcagcgtatggcaaacgcaacgccgccgacggcggtggcacgcctgcgctcgctttcgcgacgagcgcgccatggccgcggcggcacggccagccgcacccg

SEQ ID NO: 9971 - DNA, 48356 bp, Oryza sativa
  unsure (1)..(48356): unsure at all n locations
acgccccaatcccgccacaccgccgttaacgaacgagacgaagaccgatcgaacgacgagaagcgagaacgaacacgtcaacgtacgttgccgcgtcaacgtgaacgagaacgagaacgatcgaacgaacgtgaacgagctagggaacgtgaacgagcgaacgaacgaggacgaacgttatcgtgaaatgcaatatatatatatatatatatatacatgtatatatatatacatgtatatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattagtattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgctacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagttttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaagaggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacaaactcgagggcaaggggtgattccttggaagattggtttcaaggaggacatccacacgtacaggagtcggatgaggagcaagagagataccgaggcgaagattgcagacctagagttccgggtatcgagcaacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgaggcacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagttaagggccccccccagctccaccgcttgcccacacaagggcaacaaagaaggcgaaagttgacgccgccaagaacaaggacccggggtacaattgcacgcaagaggagcttgacgcttacgttgcatcaaaagtcaagagacaattcaagcctcgaagtccagaaaagaagattcctatagaccccagtgtcaggaacttcttcaggggtatgtctgcatctgttaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgataaaacaatttattactgacaccggtctaactacggatcaattgctaggagtcgcaccaatcgaaaaggcgaaagtgaaatacatgtacgaactcggtaaaccgcttgtcaagcctgagctgctgcagtctctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccacagaaaataatatactctcttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggtttttgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagagaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtggattctactacaacggaaacacaattcatcggtccttagcttctgagctagcagcgagtactactacgtcgaaaccgtagctagctaggacatataatggattgtaattaatacatgactacatatgtttctatatgcatgtgtacacattttctataatgtaaatatatgttgttcatatatatatctatatacatatgcatttgcataacatatatatgtataaatacatatatatatgtatgcatatatatgtattgaaacatatatatgcatggtttatatatatatatatatatatatatatatatatatatatatatatataaaccatgcagcaacaggggcatgcaaaaaaaaaaaggtcagctctatctttagtcccggttggtgttaccaaccgggactaaagatcgatctttactcccggttatttcacccgggactaaagatagcgatctttagtcccggattggtactcccggtttggaaaccgggactaaagggggttatgaaccgggactacaaagggtttctccaccagtgtgattagcgagcttaggaaatgagcttagcccatgactgtaaatgacgcgaccacggcgcactctacgcgtgcattatcagctagataagctcggctgatcaaattgaagagataaaatatggctgtgatttatctaaacgaatctagctagtgtgttccaagcgggttgtgcgtgcggataaaatggcagcgccgcacgcgacgcgccttttgccaaatccccacagcgaaggaactagccaacaaaatctgataagtcatgatttatctattggtttaaaaagttgtgtaggtctattgtctacaagaataacggaaggaatcgccaccaacggctgcgcacgcgcgggcggctgggcctccatctcgccgatgtttcagaagttaacagagggaagcctcttaattacatattcctctctctcctctcgcgttgtcctccacgagcgactcgggaggcgacgacgccgccgcctcttcgtcttcagcgcctcctcccccgcctcgccgccgcctgagcgggtgctggcaaagccgtgcgcccgcaaggacggcggcggcggggcctctctccccttggcgcccggcggctggggacgccgctcgtcggcgacggtggtgcccagatccaccatggctggccggatctgggggagcggcagtcggtggcggggaatgaaggtggcggcggtggacgacgcggcgcgggaggtggcggctggggacgccgctcgacagtggcgatgcccagattcgtgcggtgctggctggatctaggggagcggcagccggcggcggggaaggaaggtggcggcggtggacgacacggcggcggcggctggtggcgactgcggctggctggcgtccgcgtcggtgactgcggctgccgacggcggcaggtgacggcggcggctgactgctggcgagaaggcggctggtggcgaggcggcggctgctatggtgactgctgaggcggtgacggtggcggcggctactgatgcaccggatggcgacgaggcggcgactggcgagctgtggcggcggccgaatggctgctgtggtggcagttggcgaggcagcgccgcggcggtggcggccgtgtctggtggcggcgactgccgacggtggcggatgcggcggcggggaaggcgcggagaagtaggcatggcagcggggaaggatgcggcgacgggggtacgaatgcggtgtcgacgaccggaaacgggcgttgatgaccgcgaaattgcggcggtggcggcgccgccggtggaaggaggcatggcagcctcagacggctagtcgagggcgtggcagacggctgcatttggccggcgcggcaatggttggaggagggtcggagaccggcttggcgcagagaggcgcagccgatggtagcggaggccggctcggtgcgagaggcgcgggcgacggagatggaggctggcttgacgcgagagacgcggccgatggagggaggccggattgacgcgaggcgcgtccggtggaggaggcctgctaggcacgagaggcgcggccggcggtggaggaggcgaccttggtgctaggaggagctgccggtggatgtggcgcggtcttcggcgcacgaaggctggccggcggggggcgccggtgcagtggtcccacatgtcggtagaggttgagtggtggtggagcattggtgcatcaaccgtggattcgtaggtgttgagcagcgggtgaaaacctagcccggccttggccgggccgacaacgatggttaattccccttcctgagggcgttgtcgtgctgtctcatccctcacgggtggttgccgggcgaaagcccagtcttggctcctttgagccccgacggacggcggcggtggttttccgtcgcttctcttcttgaagacgtcgttttggcatcccctagccgaagcctctcgatcggtgcaagcatgctctaggagttggctttgcgttggttctgagggtgttcttttgggcaatctcgtctgtattcctttgtcgtctagcggcggtcggtcacgcttagcggcggccggtccggtgttagccttctcccagttatgtgtcttggcgctgtcggtgtgtgggtggcgttatatttttttctttttcctagttacgaccctctagggttgtaatcttgtaatttttttctgctctatcaatagaacttcgcaccgtcttgtgcgagtcgttaaaaaaaaaaagaagttaacagagcccacaggccacagatgtgtttgacgccaggcgaaggagataaaatcaaagtataaactagaaggttattagcagataacaaaccgatcgatcaaacatatcctcagcggacttgacgcggaagaaaacggcggacgcgtggcgtgcggcacgctccaccgacctcctacataaggacgtcaatgctcggcagcccgggcatccatcaacacacatccatcccgagaatcaacgcaataatccatcgaaaacgcatccattcatcaacacacatcaacctgacaacccatcgatgcacatccatctgtgcacctcctcctagaaggcaaccatccatcagcgacatcggccggcggcaaattaagcaacagcgcgtacgcggccggagcacaccggcagcggcgagcgacttcggacgaagcggcggccggcaggagaggaccggagggagttcgacgaggagaaagatgagatcaatggcttcccaaggtaaaagttaactaagatttgtttccttcttctttcattcatatgcagcacgtacacacgcatgcatgaagaggtatcaactagcgcacagaagaatacactcgcgcggccacgccggcgttcactggtgtttagccgatgcggtggcaggagatggcgccagatgagggcgacggctatcgatctacaccagcatacgtcgggttacagatcgaactggcaaccggcggcgctgcgtgcagacaacggttgctaccgatctacatcaacaaatatcgtcgggctacggatcagatcggcgaccggcggcctcacgtacactcatcacacggcagcagcatatcaagccgaagctagcagttgcacgttaagccatctccattcagcaaacacatgttgtggcaacatggccgaccaaccagaggacgacacgtcatcaccatgctacagtgccatgcacaaggagtagttggccaatgtgttgactaataagtcccttttttttctatttttttcaatggggtgctgagctgtgattaaattcggttattatccgcgccgatcgtctccaataactcctgattcttttctaatctaatcccgatgcaactgctgtaacgttgagctatccaacgggccagtcttcggttgccaggaggccgcacgacctcctggcgactcggagttagttccgaaccctagttctttgctcgggatttcggattggttttcttgctgatcgttctcagatcgttcctctttcaatcgttctgccacattctgcttccttttccctccttccacatactgctttcaatttcacctgttcgcgctcgttcttccggagtagggtgcggtctccgccccggactccgggattgcaccgtggattagggttctgggaggtgtgatggacaaagggggaaaaaagaagggggtggacctggaaggcctcttcctaggtcttaagcttgtcccggaggaattgagaggcatgaaaggatcttggtgcttgaagaagaaggatgccgaaaaaaaaaaatcaggcagtggggaagttattctctccacgagcagggtatgtcgaaggaatggtgtaggcgttgggcaaaatttggtgtccacagagagggattagggctaaggagttgggagataaccttttcctattctctttcttgcaacgcggggggggggggggggaagagaagagccattacggaaggcccgtgggaattcggaggagatctcatcgtagtggattttgatgagacgaagaggctgaaagaccttgtattcacacatttcccagtgtgggtcagggtgtacaatctgccgttcggcttgatgaatgtggatactggccgggtaattgggaataaaattgggaaagcattggaggttgatacggatgaggatgggtcagccgtgggaggttatctgctggtgaaggtgctcatggatgcccgcaaagccctaatcggcggggtgatgatggagggtgtcgccggtgagaaggagaattggtgtggagtgaagtacgagttcctgccaaatttttgttattcctgcggcgttctgggtcatgtggaggagtgtgatgataaggtatggaaggaggaagagcagcaattcggggactggttgcgagtcctaccgatgaaacagcgggatgtgcgaggctggagctcggaagggggcagttctgggggttcgtttcagcacaggagtgtcgtatcctggaggaaaagtggagttgagaaaggaggtagcagcggtgtaggtggaaaatctgctagccgggatgaccctgaactaagggatgatgctgaaagcccgggtaaagggcatcccaagatccggatgggcggtgctccgaagaagctgacctttgtcggtgatggtagttcggggagtttgactgaggagagagggcataaaaagctgctggagattacggctccctcggagccgcaactagttccgaccacgggtgaagtagctagtgggttagatggagaggacgctcgggggaaggagcacagtaccatgcaggttcctgtggggggaggagtaaaggacaaagtgtgcatgaatgtggatatacagggatcaatctcgttggaaagcaacgtcgggtaacagcacactctcccgttggctgctgaaagtggtactttggatactgggcactcggggacgggagataagaggaaggccactttcaagcggcgtccgcgagtgatggataaggaagtcggcgccaaggagagcgcgattgctgatactcgaaagtgctctgtaacggaggagatggttgtgaccgaagaacggaagaaacagaatgctcaggtggctgtgagtgatgacgcttccaaggtcaattatgatctgcaggcaggattggccggccaatcccgccgagataaatgaagataattgcttggaactgtcggggacttgggaatggctcggcagttcgtggccttctggatatccagagggaggaggatcccgatgttctgtttatttcggagacgaaaaaaggtggtaagtggatggagggtttaagatggtggttggatatgcctaacatgttggcgaaggacagtgagggagctaggggtggtctagctttgttttggaagaagggggtgcaggttgatgtgcagagttttctcgttaccatattgatgccaccatcaaggatgtgcgtgggtttgagtggaggttcacaggaatgtatggggaaccgaggagcgaggagaaagaaaaaacctggcgcctattaaggattctgtgtgatcggagtacccttccctggctatgttgtggggactttaatgaaattttgttcaattgtgagaaggaagggggagctcctcggtccgaaagttgtatggccaagtttcgacaggctttggaggactgccagctgcatgatctgggttttgttggggatgccttcacgtggaggaatcaccatcacctggcgtccaactacataaaggaaagacttgatagagcagtggccaatggtgcctggcgagcacgcttcccgcttgttcgcgtaatcaatggggatccgcgccactcagaccatcgttcggtcattgtggaaaccggtgccactgaaaaacaacaatgggggcaacctttggagattatgcagaagtttgaggctcgttggctggaggaagaagaatgccaggccagagtggaggaagcgtgggagaatgcattggaaggtggtcaaactcggctaatggagatccaaagccgggtcctgaaggaattatgggcttgggaccgcactgtcctgggtgagttgaagaagagggttaaaaatctaaggaaggaattggagaagtgcaggagggagccaatctctaaccggcaagttaacagagaacatttgttgcggtacaagttagagcggctgctggatcaacaacatatttactggaagcagcgagcacattctacctggttaaccaagggcgaccggaacacaaagttcttccatgcccaagcatcggagaagaagaaaagaaatacaatacagaagttgcaggatggccacggtggtttggttgctggaaatcaactaaaaagcttcatttcgaaccagtaccaacaactctttaggtcgaatgggtgctctcagatggatgcagtattacaatgtgtccaagcgcgtgtgaccccggagatgagagaaggccttgctgctccttatcagagagaggaagtttgggtggctttgaaggatatgggggatttaaaagcaccaggcgcagatggtattccagcaatcttctacaaaaaatttttgtcactagctggcgataaggtaaaggatgaggtgctggcggttcttaatggtggggatatgccacagggatggaacgatacagttgtggtattaataccaaagacgaaacagccggacacattgaaagacttgagaccgataagtttatgcaatgtggcatataaactgatctccaaggtgatagtcaatcggttgaaagttgtgctgctggaaataatctctccgtcccaaagtgcgtttgtcccgaggaggttgatcacatacaatgtattactggcatatgagctcacacactacttgaatcaaaggaagaaggggaagaatggagtggctgcgatcaagctggacatgagcaaagcttacgatagggtggaatgggatttcctgcgacacatgatgctgaggttgggcttccatgatcagtgggttaacttagtcatgaagtgtgtaacttctgtgacttaccggatcaagatcaatggggagcactcagatcaaatatacccacagagggggctgaggcagggagatccactttccccttacttgttcattatttgtgcggaaggcctttcagcgctattacagaaagcacaagctgatggaaagatagagggtattaaagtttgcagggacacgccaagaataaaccatctctttttcgccgatgattcccttgtcctgatgcgagctggccagaatgatgcgcaagagttgagaagggttcttaacatatacgaagtggcatcaggccaagtcataaacaaggacaaatcatctgtcctcttcagcccaaacacacttcagagtgataggatggaagttagatcagcgctatgtattaatcaggaggcaaaaaatgaaagatatcttggcctgcctgtctctattgggaagtcaaggaggaaagcttttgagtatattaagaggaaggtgtggctccggatccagggttggcaggagaaattactatcaaaagcagggaaggaaatccttgtcaaagctgtggcccaagctattcctacctatgcgatgtcatgttttgatttgactaaaggtttatgtgatgaaatcaattccatgattagcaagtggtggtggagccagaatgacaaggaaaataaaatacactggctgtcgtgggagaagatgacgctccctaaaaagcttggcgggccaggattccgggatcttcatctgttcaacatggcgatgcttgctcggcaggcatggcggctcctcctaaatgtagactcgctctgtgggcaagtctttgttgacgaaaaaatcgaacacaccggcctgggagatctgcttagctcctgtgcaagtccaaagattgatgagatgcgggcgtgccagtcagtttgatcctgcaactgacaagatatgcaaatagtagatcaaaacagccaatcggctgacaagccgatggagtagttccagccgatagccgataatagccgatgccgatatcagccgatagcgatagggtttaagcaatcggctatatgtccaatgtagataatgatatagaggcaatcggctaatgatgatgtaataaaataacaataaaacccagtataaaccaatcggcaaataatgatatgatagataagcatcgatccgaaggttaaagcacacatcggctggaggtccgatgtcatgaaatccacaagattagattaaacagtgaaacatttgttgtcatcggctaaatccaacttatatgtatatgcaatccttatgagccgatgcaacacccgataactcaccggctgaaatctcgatgaaacccttattggcaatcaagaagcaggctagagattatggttctaagcatgacttagtagatcaaacttaactaatgcagcactaagtatgaaaagaaacataatatctagacaatcaagccgttgactgagttttcagggtggtagatgtctaagctaatctaatctagcaagacgatttagccgataccggcagaaaccctaaaacgagaagcaactgatagagctaaattgatatgctaagactagattaccagagacatgataaataggtaggcaagtatatcatccaaaccagagcaatccaagaggtcgaatgtactgatgcagccttgaacgacgctgacgtagacaatacaatagcctgggcctgcagaacattggacttatcccttcgccggagatcgaagacgatgcagccccgcgtcgggtgccaagttccgccggaacgtaaaaacaaaagtagaaataaaagggtggcgatgcgccgaattgtattgatcgtgaggatagattacatagaccccgggtgtacatatttatacccatgggttgatacaagtccttctcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagtaggaatctgactattggcgactttataactcccatcggctgattccgagatgctgcagccgataatgattctaagccgatgatgtttttgccgattaccaaatttcactgttaacagtcttgaaagctaaatatttcctagatggaagcattctgcagtgtgcgccgcgggacgggatatcatatacttggcgcagtatcttgaaaggagtcgatctcatcaaggaaggtctagtgtggcgagtaggaaccggtgaaaatgttaatatttggaatgatccatggatgcccgttggatttacacgccggccgatcactcccagaggcaactcaatcctaacaaaggttgttgaactgatcgatccaagcacgggatggtgggatgagcaattagtcaatgatctgttttggccggaggatgctgctacgattcttgccacgcatgttgatgagaatttggaggactggccgacatggcattttgattcgaagggacttttctcggtcaaatctgcctataaactggcagtgcaaatcagggagaaggaaaaatgcagagatgcatcaggatcttcactgaatacaagtcatgctgacactcttcagtgggagaaaatctggaacatggaggtgccaaataagattaaaatgtttgtttgaagactagctcacaaaagcctgccagttcgatgcaatattcggcgaaggggcatggagtcggacaatttatgtccgatgtgtaatagatttgatgaggactgtgggcatttgtttctgaaatgtaagggagtgaaggagtgctggaggagtctgaatcttgaagaagtccgactacgcctagtgcaatatcagtctgggaaggaaaccgtaaaggagatcctgtcaatgactgccaaagatcagttaaaagctgttgttctgctgtggaagtggtggtatgccaggaataaggccaatgtgggagacaagaagctcacgagcctagaggtctgtgatgccgtcctttaccatataatggaccttgaaaagctgcaccagtgtcgaactccatgcatgaaggtgaatggaagatgggaacagcctccggccgatatttacaagatgaacagtgatgcatcttttgatgtgagtacgaaaactggcggctggggtttcctcgcacgaggcagcaatggagaattcctagaggggggttacggctatattttgcgggcatctagtccgttgtaggctaaagctactgcggcgcttcagagcctggagagagatgcacaactcgggatgacaagaatcatactggagaccgacgccgtagagctgcagcgtgctctcacatcgacggattttgatcgtcaccaagatggatgcttattccgccaaattaaagcttttgtttcctctcattttgcaagttgtctcattcaacactgtccgaggtcttgtaacaaagtggctgattgcctagctaagtatggggcgagttctgttaactctggcatgacaatgtacatcagccaagtccccgagtttgtatcacatctagtctctggtgatttgcctggagcccttggttaatgaaaggggttagctggtgtcaaaaaaaaaaacgttgagctatccaagctacacaattccatgcatatgtcttcaccaacaatctacaccgacacgtcgttcaagactgacgaggctagacaacgagggcgggcgaagccgatgcgaaggctatgctaacaactctggcgcatggaccgacgaggccgtggatgcgttgccgacgcccacatatacttatatatccactatctacacctcaccatcatcacaatgcatgaagaacgcgggactaagatgacgagatgaccacaagcagcttaatcggaggttctccaattaactgggagtttctcgaagccccaggaaccaggagaccacatcgcataagtcagatctgtccaacgacagattatggagcgcacatatatattacattgggaatttgtatttatgatccttgagattaataaagcacatgttctcttagttttgtttattgtgtatttaggtacactgacacgcctgcacacacacataaatatagagatagggatagggagagggagatgggaggagcggaaggagttgagagtgagagggagagggagagggagagggagatgggaggagcgagaggagttgagagcgagtgggatagggaaagggagacgggaggagtgggaggagatgggagtgagtggaatgggcgacgactgtgggattataaaagtaggtgaactattttcatgtgcgggtctcttaacaggttcgcactaaaaattgattttttttccgtgcggttattttaaagagccgcacgccaaaatggagcacgatttttgcagacgcgaccacttacggtgcgtctgcaatccaaaatgagtcacgtccagaaaaatcattcctgtactagtggacgacctcggcggcagagacgcccctcgtgatgagcgttgaggctatggaagaaggtacgacgaagatgatatcgtcgatggcggcatccctaacgacaagctttgaggatatggaggaggtacgatgacctcgtcgccggcggtgtcccccatgacgagcgtcaaggctgtggaaggaggtacaacaacgatgacctcaccaacgacggcgtctctaatgagcatggagactgtgggaggaggcgtcgtccccatccaccaaggagctctccaagcttggccaccatgtcctctcgaaagcttcgccagcgtctccttccaggcatgtgttgttgctgcatgctcgtgactcaactctcggtttgctgcagtctagtgtgtatgtttgttccatgtttcattatcttttggttagatgttgatgtgcaatattttttctttgatgttccacacaataggctctcgatgttgcaattacattttttcaatgtcacatatgtgtgaaacatttttttactaaacaatgaaacatttttcactgagtaatggaacacctgaaacaatttttttgttaaaagaaggaaaaagctttgcctcgtatatattgataaagtaggagagtaaaaataggactgatatttccatgtgatttgtcttagcttttaattcaggtaatcatcttcttagtgaaggaggggtttatagattcacaaccccatttactcaaaacacaaaaccgtaattgaaaaaataatcatcgataggttttaattatgatcttatcaaattttaatggtacgtgttaggtgagtggaagggtttgaatctatcaattgttggtagagattgataaggttccatcttttctaatttatttacatactaaatttgaatggaagatggttgatggggcaagtagtaatccaacgtgataattattttaacataaaatttaaatcgtttagaaaactattttgggatggagaaagtacatgccaaatgcattgtatgagaaaggctacaccacaaaccagctcgtaaaatcgtcactttccaaacttaagagagctagcatgtactactacaaagtacagatgtagggtgcatgtatctcgatcataaaatttaaatcgtacttaagagcaattattttgggatggaaaaagtacatgccaaatgtgttggaagagaaagacgacattacaaaccaacacgtaaaatcacattttccaaacttaagaaagctagcagcctagcatgtagtgctacagtcctgatgtgtagtagtacatttggtactctcgaggtatcaaatattgtacggtaaaattatccgtatcggatatacagaatgtacgacacgaatttataactacgcccttggttcgagtcaacacagggtgatattctgaggtcacggtactacacctgcgcatgggaaatgttgctggttcggcgcttgccatccatagccttgagcaggagcaggtgccgcgaattgctggttcggtgcttgcccgtaccatcctccttgtggcggcaaagtagccggatgagcgaacgcctggttcggcggcggcgcttgaaccggcacaggcaccagaagaggattaggatataccggctggaacgcgatgaccatcgggaccacgatcggcggcgttggctctggccgcgtgcggagcatgaggtaggagatgattccgagcaccgtggagacgaggaccagtacgcccgtgccagcgtagacgcccttgtggatcttgtcgcaatcagactcctcgaccgcggcgtgtaggagcaacacgaacacaatcaccggcactatcctgcacgcaacgacgcaacaaccgggcgcttgccgttgtatgtgaccgtagcagcgacaaccgcgtactgcgcgtgtgacgatcgatggatcactcaccatgaggtgatggcgcagacgacccgcgccgtctcggaggggatgcagaagctgcggcagcagcagccggcagcagccatggcgacgtgtgttatcatcaggaagatggccgcgcagattcccagctcggccgctgctgatctcgacgacgagccgtggacaacgctgatgccgccggtgtccaggaacatcacgaacgcgatcaccgtcgcaatcctgtactatcacgcagcatatggtgcacagtgcacacacgtacgtgacgcgcgtgagatcaaggcgacgatcgatcgatcacgcgtagtgcacgtgcagtttaattacctgaccgagcagatcgatcggtggtgactcaccacgagatggcggcgcaagcgacggcgacggtccgcttggtcgcggacgggacgacggcgcgggactcgcggcagccgccgccggccgccacggtgaccttcgccatcatcaggaagattgacgcggccaccgccatcccaagcgctgatgcgcaatcctgcaagatacatatatgatagtaagatctgctacctcacctgagttcaacaagatgtatatatcaatgttctacaagagcactctacagaaggagaagaaaaataaaaggagattgagattgagagatgagcagtgtgcgcacgcatataagcttacactgtgctttgcggcatcggcagcgaaccccaggatggcgctgagcgcgccaagggaagcagccaccgcggacacgatgaccgtcgtcttgtccattttaatcgcgacgacgtacgtacgtgtccggtcggttctaccgatcgccggcggccgccaattttttcccccaatagtggaccctctgtcttccaggaagagaataattggtgtctattctcgaacgtctgtttatatggaggtctgaagctgaagatttatgccgctacatatcaacgggagaacaggaggagctcctagtaattaacacagccttgcatgttgcatgatgcataaattaacattattactgtatatattaatgtctccacgatcggtttattaattatgcactgtatatatggaggcaggtgccgaggattcacaatttgttggaacctttcaaggcacaccagcaggcaacacactatagagagaccgttggttttgggagaatctaatggtttggaaatttggtaacctattactagttcaccacctattatatactccaggtcaccaatcacggctaaatttgtgtatactactcccccccatctgtgaatataagagattttaatattttactttcaccgtttgactattcgtcttattaaaaaaaatttaaaattattatttattttatttgtgattaactttattatccaaagtactttaagcacaacttttcttttttatatttgtacaaatattttgaataaaacgaatggtcaaacgttacacgggaatagtgtatcccttatatttacgaacagagggagtatatgaatagtgctaaaatttgcacacatgatccgtttgataatcctaatgcacgcgccctttgccaatgagcaatgactggcttcacactttctctcgttttatcactgcagtaccacctaagggcatccgcagcaaggttcctcaaaccgttttgggtcaggttaccaccaccccacactcatcatgttgtacacacacatatgtatacaaagtatatacatatgtataaaaaaacagtagtggactaaagcagggcgagtgcgtcaagtggggagaggtgcacgcgttaggctccctctcaaattgcattgaacaggaatagacccagtactggcccaaggctcgggccaactcataaagactatttggacattacataatgattacatactgaaaaaataactatccttctatgcatttcgctctaggcctcgggctgggcctagattcatccctggcagtgagatcttaaatactcaaagaggcaggactaaaaatccacatcctcattgtttggctttcagcttataagctgttatcattttttttgaattataaatcataattttggagttgattttgaaatttttacatcataatttatttttacaattagcttttaaatctcaaataacatatataaaagtttacattagagttagtatcaacgataatgactgcacttgaattttctttcttcttacaaagtgtgagaaagcagttggcatcacgagcaaaggagagaatggaagtaagtgtaaaggaaactagatgataccccgcgcgttgctgcgggaatttgtagctataatttgtgtaagacctaaaacatattagcaagcacaataaaaatattaaataacatatagtaacttgtagacgatccattataaaaaagaaaggctttagacgatcaatgttgattgaactgtgagaaattatagatgctatcacacagcaaaagagaacatatgaaaactgtctaatgttgtaacgtagcgatctgctattaatttgtcttcaattagtgataaccacttgacgtggagtactccttttttatgtatgcgatgctgcaaatgtgactcaatggtagattgccgatgtcttcgatcggtcatgtggtgttgatagatacagttgtttaattgtagccatatatctactttagatctctgtaatgaaattaatagaagaaagaaaatcatcttgtcctgaaggaaacagttttagatattggccatattgtaaagtagggaagatatgatagtgttgtgaaaaaaaaaagaatggaaaatgttgtcattcgaaagagatatgtaaagataaatttgtttatcaatgataagagataacctgcttgttgtaggtgatccatgtgatggccaatggtaggagaaattgagcagggaagatggaaataagctcccagtgatactgtcagtcatttatttgatgagaaaccagtgccttgcttcattgtaaagatagcaaaaaaaaaaaagtctatattgaagcagtgcaaataagaaaatataacaatactaagggtgttacattccgaaggtaagaatgagcttaatcatatctctagtatttttgttcaccttgcttggcctgattgtcgactatcaccactaacttattcctgtacgtgtaaatgagaggggtagaagcaaatttaatagaactagaacaatgggtacctaaaacttgcaatcagctaggaagaacaatacaagatgcaacggaaggaggttgatttaattaacactatgatgaaaaattggtctgtaatgttatacacaactacagacaatggataaaaactaaacatttgactggaaaactgaagcctgaaggagccatagcagtgatttggaggatgcatactcacctgatctgtgattgttgatttgttggtggattgaactgtggcgatcacgacagagatgtgagctgtgataacaatgccgtggtgcgtatggtacccctagatggagaaagcaatattaatagacgaatcgtagaaggataacgaagaggatcagttggattagccatggcctctcaccttcaccttaatggtgactcttgtgagaaattactactgctagacggcttttaggacggacagattagctttcagattaggcactacaggaggaattcatgacgccatatatcatctttatcgcaagaacgcaatcgggaggcggcgtccctgcccagggagcgtggaaacgatctagaatagaggattgtacttactaaaggctgtattaatcggatgagttgggctaggcctgcccttgatttggcccattagatgaagacgtgggggcttcctgccgttcctagtttctagtattgcctagacagcttacctgccaccggatggagatcgaacgtctaagaacacttaggatgacgtggaaacacgagaaggctgcaaaatcctattaactacactaagtaaggatcaattgtatagatatataggataagaatggaagtgtaagaataatgagcgttctattttagtccttttttattttcaaaaggcatcttattaaaaaaatggtctttacatataggccatgatggaacgacaacaagcggctgatatggtcgtggtcatgcatgatgccgctcccttcatctaaaaaaacaaatatagtatgggatatgatgtttattttaatatagagggagtatacctaagcgtttgcgcctatgtagttgtgtcatgctagccttgaggtgcagtgaattatgggtacaatactcgttcctagccagcttgcatgtggtggcagagcagtcggtgtttgatcgccgttttccggtgctggtagaggtgtaaggttggtcattcgaagattggtgaggtaccgcattgttggttattctggctgcggttgatggctaagacatgatataggaggcgatccctagcaggattctgatacgtggctaaccacacgcctgcaccaaccggcttccaacctatacgtatataaacatgcaagtatatttggttatatatgtataaactttgtacatataaagtttatactttatatgtataaattatgtatatacacttataaaaatatttatatatgtataaacatgtgtatatgatttgaatgtaaaaaaaatacatatacatatcaactttgtatatatatatgtatacataccaacttcttgtacacatatctactactacttaaaaaataagaggtgcttccatcgtccgtcaaaaaaaccgggtgaaaaaaaaccgggcagaaaaaaccaagtttgtccgatcaaaaaaaccggacgaaaaaaaagtccgatccaaaaaaaagtgaaaaaaaaaacccgggcgaaaaaaacacccgtccctggcaaaaaaacacccgatcccttaaaaagggaaaaaaaagtccgagagacaaaccgtttaatgaataaaaaaagcgaaaaaaagagtctgattccctggagaaaaaaatctgatttccctggaagagatccgatctgtattggattggagaaaagaaaaaaaaaacacttctctaggtgcttctgtcgtccgtcaaaaaacgggagaaaaaaaccgagcgaaaaaaaaaagaaaagtccgataaaaaaacctggcgaaaaaaaaccgggcggaaaaaaaacaaatatgtccgacaaaaaaaaaaggaaaaaataccgaaacgaatccgactacatcgacgcggtaaaaagagtttaaaaaaataaaaagaaaactgtcctattccaaagaaaaatgaattatatgtatcgtggagcaaaaaaaaaaagaaaagtccgataaaaaaacctgggcggaaaaaaaccgggtggaaaaaaaacaaatctgtccgacaaaaaagaaagcaaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaatttgtccgataaaagaaaaggaaaaagctgaaaagaatctgactccatcgacgcggtaaaaaaaggcgaaaaaaactttccgataaagaaaaaggaattatatgtgacgcggtaaaaaaaataaaaaaaccaggcgaaaaaaagataaaagtccgataaaaaaacggggcgaaaaaaaaacaaatctgtcctatccaaaaaaagccaaaaaggggaaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaaacccttcgtaaaagaaatgcacgagaaaaaaaattaaaaggacggaaaaaagcgcggaggaaaaaagtcaaatttatattcgtcgttttttaatccatttatatatcttctttatctctaatctaatctaatctaactataaaaagagaagtttctacggtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgatatggttatgcatgaaaaacgtatattatcattacgttttttcacccgttgcaacgcacgggtatatttgctagtatgtaaaaaagtataaaatttgatgggccagaacgcgattgcgcatagcatatgcgccttatcgctaattagcaattttggatgacgaggcacgttgcaatggagccatttcttttaaaagtttctcttaactgagtaaagaagtgaataaattaatgtagcgccatattaatatatctagtggattcgagttaaacggtgcatactttatatgtggtcaatactcaatactaactgataatgctaatctaatctaagtaacttaaagtcctggatcagctagcccgtgatcagcggtcagtccaagatcaagtctactagcacacagttgactcaaaaaaaattgcgcttgcatgaatctgaaaagaaaaaaaatcttcaagttccaattgtagctagacttcaaattaaggttacatatatatcttgtttggatagatataaatcccacgtatacatttgtcattttgtctgtatacatccttttggttgtagagcccggccggttttaatcaatttctaaggaagaatataaatctcacaatagaaataatactaatattgaaccaagaacgggtacacaaatacaaacttcaagcgtagccgcgttaggctactaattaaaccggattgctgatactgtcgtcgacggacggtgcattgcttagacctgctgcggaggaggatgaggaggcctcggcgggtacccgggaacagcgtccatcgggatcccgatcggcgtgggctcgcctctccccgccgccgcgtcgggctgcgggcggagcacgatgtaggaggttagcccgagcgccgtggcgatcagggccagcaccccggcgccggcgaagaagccttccctgacgatgaagcactccgacgccacgatcccggcgtccaggaacatcacgaacgcgatcaccgccgcaatcctggtgcaagaaacgaacgtacatgacgtacgtgatgtgagatcatggtgacgagacgcgatcacgtgtcgtgtgcgcagtgtgcgtggttaattacatatgtggattatttgattaatttggctagatcggcgacgacgagtactactcaccatgagatgacggcgcagacgacgccgacgatccgcttggtctcggacgggatggcgcgggacttgcagcagccgcagcagccgccgacggccgtcacggtgacctgcgccatcaccaggaagatggccgcgcatacgcccagcccgagcgccgatgggttcgtcgacgagtataggcaactctgcaagacacattcccatcatgacattgtctgatcacttagatagtactccctctatttcaaaatgtttgacaccgttgactttttagcacatgtttgatcgttcgtcttattcaaaaacttttgtgaaatatataaaattatatgcctacataaaaatatatttaataatgaatcaaatgataggaaaagaattaataattacttaaattttttgaataaggcgaacggtcaaacatgttttaaaatgtcaacggcgtcaaacattttgaaacggagggagtagtaagataagatccagaacaaattaaagaagagggagaattaattcaaagacgagcagagtgtgcatgcatgcgtgcattgctagcgcttacagtgagcttagagccctcggcggcgaaccccaggatggcgctcagcaaccccagggatccgaccacgacggacacgatgatcgtcgtcttgtccattttgatcgcaactacggtcgttcctgccccggcggctaccgtattttgccccatgtcgatcgatcgatcgcgagatatccgtcttctaggcagatattgagaaacggatcagtggcgttgtgcccgtacgatggtacgtctgtttatatagagggctggcgagctcgatcggtcatcggtcacacactcacatgctgatgcagttcgaatgatcggcatgacggcataggcaggtttacgctactgccaacgagaggagcttagaataaaacggccttgatgcaacaggccatgttcgccataattaatgccttcgtggatgttccattctgtaacatgcttgcaagttggtggggattcatgtagtacattagatcgagaacagtcaatttacaacttagatgtagatgcatttatctattactacatgctatataaatggttatacatttaataataataataataataataataataataataataataataataataataataataatgttatgtattgcttcataaaaattcaagaaaaaagtcctgtttattccctagaactatttcatgggttcattttaccctaaacatcttattttcattttataccctgaactattgaaaatagaacacgttactcctaaaaggtgtttctctcttttcttttctctctatgtaagttgaattttgcaacgaaatttagtagaattgatagatgcattataacttacctatcagcatttttaagaattcttttatcactgtttaagtattgagactgatttaaatatcgaggttttaaatttcaagcaaatactcatgaaatttttttaaattatttttgaactttgataatgtttccatctatggctctactaaatttcagtttaaaatgcaactcatataaagagaaacaaagaaaaaaatgctattaagtagtaaaaaatagtttagacagttaattaagtgaaccaatggaatagtatgcgagagtaaaatggatatttttttcaaaaatcaataataaatccaaggatgtttagtttgtagtcgaaattagccttagcaagaaattagccttagcaagagttcatttcagccttttggaacaactatttacgttttctgttagaacgttcataaaccgctaaacgatatgtttcctacaaataaatatatattttcaaatttatgataattagtactctattaattacatgctaatgacttgtctcattttacgtgtggccgaaaatttcagcctaaacactgagtacgcaataaactagcatgcctccactatcattacctctatcatattttggtaactccataaacttcttttaaaattaaatccaaaatttggcaaagcttcaaacaaaaactaccttagcatcttcccttgtaaagatttggttatgttaaaatttagcatcatcaaaatttgacaaggttaatttctatacggaaaaccaacagagataatctctaaatccaaaaatctcataacaataaacacaaactaggaaatagcacagatcgatctcaattattgaacttgtcctaaggaccaggtcaacaataaacacaacctcttggtagtaggaaattaccccggaatgatcagctgatgaaagtccaccatgataaggtcaactagtcgactacgactgttaattacgcggatcgagtaatttaccattggcttcggtgatacataaagggctgcctttgtcgtcctggaggtcaatgtgcgaattacccattgtgtggagatacacgtacttgccatggataaatctagtacttgctgagctactacttcattgcgtcgaccaacaaatcatccacttattcatagggtgcatttattagtcagggagaattttttttttaaaaaaaatggactagctaaaaaactgtggttgcattctcttaagttggttccattgtcctccacggtatgtcctatctgacgcacggagatgttaggtcgggatgaaagggtatctcaagcgaacacaaaacacatcgagttgatatccaagagaatcaaaaatttgtcaccggctgacaatcccaacgagctagatcccctctcgtcaggttagtagaatgggttttagagttagctaggattttcttttactcccccacttttcacatggcgtatcccgtatcaataaatataaatagaacgtacatagtgctattaatcaggtctaaggtaaaaaaatatatatagctgtataagatttcttatttagctctctctagctacatatttattttgtactccctccgtcccataatataagagattttgactttttgcttgcactctttgaccactcgtcttatttaaaagatttgtgcaaatataaaagacgaaaagttgtgcttaaagtactttagataataaagtaagtcacaaataaaataaagagtaaattacactttggtccaccttttattacccaagtttcactttggaccacccttaaatctatcttttcaatttggaccggataaatttacaattgttgcggtttggactaccataaacaactcttcttgtcatgtctaacttcccttaagacaaacatatgaaccataaatagagaagttcgcccggcccgtatactagagttgatgtgtttaaggccgttgattgtactgaaaaataatcgttcgtggtgatccaaatcgtaaaaatggcaaatttgtccggttcaaagtgaaaagatatatttaacggtggtccaaagtaaaacttaggtaataaaatgtagcctaaagcgtaattcactctaaaataaataataattccaaaattttttgaataagacgaatggtcaaactgtgcaagcaaaaagttaaaattccttatattatgggacggagggagtatctcatattggctgaatttcttatagatgaatactataattggaactttcttcatgacaaacgccctacaactgctgcacaaaccctttgtagccccggtttgcaaccccctttagtcccgggtagcaaattgaggctacgaatctggaactaaaaattgctatctttagtcccaatttaaataccggggactaaaggtcaatctttagtcccggttggtaatatcaatcaggactaaagatggctaagccacgtgcccagctccgccatctttagtcccgattggtaccaaccgagactaaagatttttttttcttttccttttccattgttctctttctgcttgaatattgatttcaaaatgaactaaagaataaaatcatcctcatttacaaaatcatccacattcacatcacaaaatcatcaacaaatttacaacacaaaatcattcacaaaaatatctaaaaatcatccccaaatttacaacacaaaatcaacacatatatttccaacacaaaatccttcgtgacagccacgccccgccgccctccgcaacctcggtcaccgccctctccagccctggccacgctttcgcccgcagcctcggccgccgccctccgcgacagctgcgtcgggcgctgccgccggccaccacatcccacagagttgagggtgccgcagcccgcgacccactgcccgctgccgcctgccgcaacccgccgcccaccagccgcagcatcggagagggcaggggaagaaccaatgctagcagaacaaatgaggggaaagtaatgtgcaatttttcttctgtagagcagaggagtgcaattaggcaggttccaccaatccaaaatcttgccctaatctgaagtagtggtgagccctgagattgggcaaactggtcatcatggaacctgaaagcaacaatagggaggggggagcagcaggagacggcacatttgtgaattctcaaaagttccggtttaggaaccggtacctttaagattctcgggatgaaaaaaaaatctgctcgatgtatcggctcgaatcgaccccgattcgcccccaaaatcaaccacaacgaactctcaacagtcaaaattgccatcacatattagtcattatcacaaaatcacaaaaggaaccgacaccacagaacaacaacaacaacatctaaaaacagacgaaagaagaacttccaagcacttctctgctcccgccactgctggatccaccacgggaggagccactgccgccggatcagcctatgggagagccgttgctgccgacgccgccatcaccgggtccaccgcgggagggaggtgagaggtggtggagggagccgccacctgtgaagggagacaagaggggacggagggagagggagggggaagagggccgccggatccgccaagggacgccgaggtgagtgagtacgccgcgagggaggcgagatggggcggagggagaggagaagggggcggcgagagagagagagattggaaggtgggtacgagaatggataaggacgcaagtgatatatgggtgtcgatcggtcgctcagctcgggtcggttttctttgtcaatattttaaaaacttcattaaaaaatcggcatttatagtattggtgtcgatttttctttaaaaccaacacctatagtttctaaaaggtgccggttctataattttttgcacctcgcagggacgggaaagcggttttaactatttcggtatataaagtgtcgacctctatgtgtttttctatagtagtgaataagtcacaccacgctatgctacccacagtcacaatcgttaattaaacattcgatagtatcactccaacagaagacattgacacaacttgtgctcttttagcatgaaattcgtaaatattatatatggacgcactctctagccttttattggagacatatagccaactataatatgtgttaaatactcatagctagtcaaatcattggacaaattaagccatctctttctataatgcgattatgtatatgatgagcatgtagatggttgcaagctgtaggacgtagatcggttagcttggacaaccataatgttattaattaagcatgattctttaattagaactatgtgccttacacgtggcaatggaactgtgatatcactatagtatactctttacagatttttctggatactttgatcagttcctaagtcataactatctcgcttatattagttgatgctgtgtgtaggaaggcatagacaaaacaaagtgtcatcaagtggcccaattaatacattaataattgcaattacagttcggtattttgtgcttgaccctgtggtgtagacttggatctgtctatttgtctaatagactaatttgggcaaatataacaaacctacatcaacatgctataagaattgcaacgttaaatttctaatgggtggatgatagagaattgtaggctactactgtagccagactgcaacactcctcccaagaccaaaaattgaggccaattactttctggccaacgacattttaccatatttgtctagagacgagagaattatatattataacctgcctaatgtataatttaactactatcactgacgactatagatgatggtacaatttttatagctaactattgtatatattattcaccttgctctaataggggatatggaaaaaaaaagtcatcaagataaggggtgtggcatgagagtttggatgtatataaatatatactccctccgtctaaaaaaaatcaacctaagaagggatgtgaccactcttatattgatttttttttggtacggagagagtaagtgttactaaaggaggcactagagtacaacatgcatagtggtgtgtttcttctgtgcaacttaaaaacaaaaacagatttgctagataacctttgacagttttttcctcccaaaattttcaatttgtagtccatcaaattgcatggagattcatgcaaggggtggggaagaattttttgcgccatgcgcaacctgccacttcatgcgaggggcgcgtgggggctagccaaccaaccagatgtggtttctctagttgattttatacttagttacatattagttataacacaattactatagagttacaatgtaattacatttagcaacaagggaatgaccttacaacacatactacctactttgttgtcacgcgtttgaaacttctttccatctactagcggattatagatataaaaaatctagggcatgcctacaacttaaattgcatgcgaaacaactaataccaaggtcatgggaggcgatgaacacgatcgaaaatggcggggggcaattgccacacgaaaagggctacccaaacttgggacgtgatcttttatgctactaacgtcctgggagatttgaaaagaaacaaactaacaagttctccaccacagagagctcccaacggcttcttgttgctaagataaaggaggaagggaaaacttagacgcgagtggaagggaaaagaccctcaaaaatgttaccctaattccttcaaaacacttttaagtcatttttcttttccagactcctttgtgacttttactcctactctatacaatgaaattagtattgtcttgtgctagctggttcattaaaaaaaaataattacaattcaattacactatatacactatagctaaatgtgaaagtattcccataaaaaacttgctgaaccattttaggtagtccttcagaaaatcacaaccgtccgtagttcttgaatgcataattattgattatttaaattaaaatcaagggccactttccaaacatcagaaagcaagcacgtgcatgcatcacacacacacacacacacacacacacacacatacacagaaaagcacaaatacaaacttcacgaacagtacactagccggctagtcccttgattctaagccaacacacgggatgatcgcagtgtgaagtcagtgttacacctctgaacgccctcgaggattagccgggaagtgctgctggttagacgcctgcgatccatagccttgagcagcagcaggagcaggatcaggaacagctgcatcagcgaaccgcgcgtgcggcagcgcctggctggtagccggatgagcaaactgctggttcggcggcgcttgagcagcaggtacaggcaccagcagaggattaggcgacgacactggtggcgggaacccggccgggaccgccgtcgggaccccgacgatcggcgtgggttcatcgccgcccgccggacctggcggtcgccgcgccgccggcgccgcgggctcgtccggctgtgcgcggagcatgaagtaggatgtcatcccgagggccgtggtgatgagggtcagcacgcccgcggaagcaaagaagccgcccctgacgaggacgcagttggactccacgatcgcgccgtccaggaacaacacgaacgcgatcaccgccgttatcctgcacgcacgtacgtacgtacgcaaccagcgtacgttcgtgagtcgtggcatcacaacaccgcgcgcaatctgtcgatcagagcatgcacgtacgcgcgcggggcgcgacgactcaccaggagaagacggcgcagacgacgccgacgatccgcttggtctcggacgggatggcgcgggacttgcagcacccgcagcagccgccgatggcagccacggtgacctgtgttatcaccagcaagatggccccgcagacacccagcccgaccgctgctgacgatgagttcgacgagtagtacaagtcgtacaggtcgagttcgcaacgctggaaattaaacacatatataatcactaaggcagtagtcatcaagttcaaaaaaaaaaagcagtaaacatatatataccactagagtctagataatatgtagctagtgttagcaagaacttgccttggtgcgcttcgcaccctcggcggcgaatcccaggatggcgctgagcaacccaagggacccaaccaccgcggacacgatgatcgtcgtcttgtccattttaatcgcgaggacggcggccggttcttccaggccggcggcggcgggcgcttcgatcttaaccatatcggactcttatttctcttcgcggctgatacaagattggcgtctcgtgtttatatatagagaggtctcacgagagctcggttacacgctgacacagttcaatgggcacacggtttatgctacggccaacaggagcaactcgtaaaaacagcgatgtgtgatatgggcatggtcagcgtgatttctacataactcaatggatcgttttttattctacgttttatatatctaccctgcattctgactttttattaactagaaatgtagcgcacgggcacaaagagaaccctgaccccggacaccctaggtcatgtgatggcgtgctctctctctcttgacctgatcttctaaggagataacttttactttgatcgagtatgacgttttcgacgtggctactaaccaaaataagtataggacacccatgcaatcgctaaaccacaaacgatggcataccaataaccatgacgtgcggttgatgatctctgcaatgcaaacgagagaacattgcaagaataaagtaggatgcaatggcataaaaaaatagttgcgattgaagtgatagatataatcgatcacgccaatcaacatatcaactattgggggctctgaatctatagtcgccgaataattgagcgaggcctagagggaaggtgaatgacacctggaaaaaattcaactaaacaaaacccaattgtttttttaggttgtacaaatctatttatagagaaaaataaagttagagataggtgctagttcgtagaggtggagagagtcacttcttagatgagtttactccattacaaagcctaaggctcaaggtcggtttcagatacaatactgtcttgttttgacgttttctattaactcggaatgaattttgatatgagacatgatgcgtttgaaaggtgacgagataagctttccaacaaacccaagatcatccaaatcggagttgacatgaaaatcagcactgccttcggaggccgaactggaacttatagagttacattcgtatctgatgaagtgatgttctcgtcatcatggcctcagtatggggatgaaagcccatgcagatatttttttttcaccataatgttgctattttcttttataaattactccctctgttttgttttatgttataaatcgcttttattttttctagtcaaacttttttacgtttgactaagttttttaaaacaaatatattttcaatataaaacaaatatattgtcaaatatatttgtttatatttaattaaacaaatttactgttataaatattactaatttgtctaaacatttggtaaaacgtaaatagatttgactagaaaaaaaaatcacactatctagagtacaacatgaaacagagggaataatagtgaacaagtttattgcatttacatatacttcacatcaataagttgtacgtcctggcatgaatctgaaaaaatcgtggaactccaataaaactcaaactaatctccttgcttgaaagggtgaacagtcctcggaaaaaaaatggtgaacagtaacgttcggtgcatagataaatgtcacgtacacaaatcattgaaatcaaaccaataaaaaaataagcaaaacagggcagcacgtatgatcaagggcattgcatttgtcgcgttaggccttaatcgattcagttcaacaccagatgatgataaatgcgtgcacgatgttacagctacacgcctacacctgcgcatgaccttgtggatgaggcgcgagctgctggtcgggtgctaattggttgccgtttccctcagccggagccggagcaggagcaggagcaggggagtacggtggcggtggatagttcggcaacggctcaggcacctgagggttaggaggcatcggcggccggaatccgtggatgtctatcggcgtcccgatcggcgtgggttcgtcgtcgtcgtaatcccgcggggccgcccggtctgccgccgcctcgccggcctgcggatgcatacggagcatgataaacgaggtgatcccgaggcccgtggcgacgaggaccagcacgcccgcgcccgcgaactcgccgaccaggccgacgcacgccaccgccgcgccgattgatccgtccacgaacaacgcaaacgcgatcaccgccgccaccctgcacggaagacgtagcgagagggtgtaaataacgagaaagtattttctacacctaggtgccatgcatgtaatttaaacagttatataaaaaatttataaaattcgataagatgaactttgataatataagacaatatacaaacatgcaagtctaaattcgattgacatatgaagaaacaaaaataccaaattttatctgcactatacgggtactattcactgtctgattttattatttttatttctctagttgtagatcaaatttaatcttgcatgtttgtctatatacttatatcatcacaattgatatgttactaatttttttaatttttttctataactatttgtgtcttatgtaaataatgggtgccatgatatctaggtgtagaaaatctgctagtctgcgatgatctatcgtttgttgtacgtgcgcatgaatgccgtgagctcatgatatcgtatcgatgagaatggtgatgaactcaccatgagatcgaggcgcacacgacgccgacgatccgcttggtctcggacgggacggcacgggacttgcagcacccgcagcagccgccgacggccgcaacggtgacctgcgccatcatcaggaagatggtcgctgcgatcgccaacccgagcgacgatgcacaatcctgcaaagacacataacaaaatgtcattatgttcgttgatgattaagatctactcagaaacaagatcatcatcacagttcaacaaaagaacaacaagaagcgagagagagagagagagagagagagagagagagagagatgataagatgagtgcgtgcatgcatgcttacagtgaactttgccgcctcggcagcgaaccccaggatggcgctgagcacgcccagggaaccaaccaccgacgacacgatgatcgtcgtcttgtccattttaatcgcgacaacgatcggttcttcacgcccggcgctggtgccggcgccggagccggcggccgccttcgctttcttccccatatcggactcttggtctcttcccggctgagacaatgttggcgtcgtgcgtgtatttatgtacaggtctcgcgagctagatcacagactccgacgcagttcgagtggcacatatttatgccacactaccaacgggaatatacgggaggagctcgtaatataatggcacaaccatgctgcacgatgcataaacgttgttgtggttgtgtccatgttggcgtaagtaattaatgtgtccatgactggttcattaactattccctgtacatatgcaaggtctcgggggttcacagtttgtttaattccaccacacatattttgttcccccttttaatttctaccaattttttttctattctacaaaatttggttcgatggcttctttaggtcagagcctcgctttcaaaattatgttcactgactgcatcaaagtatcaaaccatgcatgcaattagttcactattatgttccttttttttaattgaaaatactaccagggctttattcagtagttatatattaagagcagaaagatatgcacagagaaagaacaaaaaaagaaaaacaaagtcctcaaaaattacaaaccttgtaactagctaagaatggaagtgctaagagtatccctcatttttcaaacatgtagaagaatttcattcttaaaagcaacaaaccacctattaaaaatatggttgaatgttgtcaaaatcatggccatttcactgcttccaaatgtgccaacaagcaaagcgcataatctccaagaaactttttatccttaaatggtttctagccaacaccaccatttggcaaatttctaattagtattccacctgatacccaaacgctctcagcacacctcttactgaaaggacaactgaaaaacaaattaagcaaggtttctcttggtcctccactaattccatagcacaaaacatcatcttatggggcacaaattataagttgattttgatttttaaatttggctaagttatagagcaatatagcaatacttttaatacaaaacaaacatattatcaaaatatattcaatatcacatttaacgaaacttatttggtattgtaaatgttgctaatttttttataaacttggtcaaacctaaaaagtttgattgaaaaaagtcaaagcgaaacaatggagtaaaaagcaacatcaccaggtggtaaaatatagaatatatgatctgatatgaaatgaaaattgcaaaacttctgaacaatgcgttaactatataatttagtttaattataaagtccactacaagaaaaacatacgctatcttattaactattatctattaagaatagtctaaattacacacttaaagttttgcaacaatccaaattactaacttaactctaatactagatattttacacccgaactcatcaaaccggagaaattaaccctccctcacaccccaagaaaaaactggttctaggcggcgtaatgtgagtgtcttttctaaagcttgatttttcttgtgttgaatagctaaaattacatagccacgatgttttaggggtgaaatttgccaaagtttaaactgacgaggaaaacgaacaattcacttacgttatcatagactttaggttaaactatgtttttttagataattaggttaaactatgtagcgcctggtatgtacaacttagtaatatttataacttatcctcattgtcaaacttaaaaatatatactacatggaccaagtccaaagtcacccccggcactcacatggctccccatgatcacaagcattgttaattaatatcaggattgtgcatatgatcgagttgacccagttttctgtttcaagcttaatacattctgtttgctcttgttttatatatacagggaaaggagtttctttagacacagttgcgctgcagctggcgcacatagcttctgcttcttctatctagttgtcctttataattttaagaccgtgtacacatttgacaatgcccccgtattctacttgttacggcgcgcttctgatatactctgttgtgtcaacggccactataatggccaccaccaactaattttgggagaaaaaaacccattggtagccagatcatgcaggctgcgagcctctccgttgcgttgtacctcggcattgaccagaactagccgtgttaagctaaggtccatcggggcagtagatcgagtccatatcgctgttgcaccacgcatggtttggagaaaaaaaactactcttttagcgacgactttggattttggaataggctgacccccgcgcgcgtagtagtggccgcgccggcggcagttcagagaagcgcgcggagtgccacgattttgcgcggctcatttcgcccgtggccgcgtgaagacccgaccgcccgtgcgccgcgagctatacgcgcgcgcggggggagggctcgagaatcgagattgtgccgtgcgccaaagaggaggtgcaccaggcaccaccgcaccagcgcagcgcgaccgcgagcgtcagctggtcgtttgtgaaaactcgttactgactattgaggcccaccttctgaggtctgattgggctaaaactgtctccggattctctggggtagttccgccttccgtcctcttggagtcttgggccgaaggcacaccgctgaattatcaccaaaaaatgaataggtgaatgtctaaaactaagaaatttcagaacttcccacactattaaaattttaaatcttcatatgactcttactcaaaattatatttgtatttggtgtagctgtgtggggcacatactcggtccataagaacaacgcaacgttagacgcatgaattttattttatggatatggtccaaagagatcgaaggttctcgttatcttctagtttccatggctcgtctctcatttttatttgacttctcaatgtgcccccacacttatgattctattgttagctgacagatctagccataaaggggctcgccctcacccatccattagcttcatcacgaatgcctagccacggtcattgtcccagtctccatccccgactattttccatccctctccactcttgatgtggtcctgtaacccttagctcctccatgtccatctaccgtgtttatctagccatgtggcaccaccacaccctagctcctcaaccttatctaggtgtggcaacaagacaagtccgggctaagttgggaaagagcacccatgtgcccgtccctgccccctcagcatagatcgggtgcaaaacaattcccgtccttgccctcaccggatccccgcaccccgggttaatggcagtgagagtagcgctaaggataggcagccggcaaactacaacatcatcttctccatagatgacgagacaagcagcaccagacaagaaagggcaagtagccgacgagctatggcgccatttccgaagaaggggaggcaaacaactgggcagagatcgagaaagactggtgaagttgcaaggacacagggcgacgctgatcagggatgacgccgcgacctccgcatgaacgcggtgatgcaggcgcagactacgtgacctccgcatgcaggaagaagcgatacagccaagggcggagctagagaagaatggaggggggtgcaccactatatagtacaatgtatatattttaaagcaatattatagtaaattataatgttttttcgcgttgttatcatcaacgataacagtggagtgcactaacaaagaagcatagataaaaactgcactaaccataaccattcgatccgaaaaaaaaagagagctattatcacgtaattgaaaacttatatctcacggtgaaggagctcttccaatgaattgattgactggtaaagaattagtaaaaaagaacaaaagatagaggaggcaaggaattgcctgtgccctatagcctagtggttgcagtgacgtgagtagcacaccaaggtcctgagtttaaatctccgtagtagcgaatttcagattgggttatttcagagtaagttccttatttgataggctaaattcctaatttaggctctatatatccggttggatataagacatataaaggttgggtaaaaaaaaccttctcttctaaaaaaaagaattgcctatgcccatcctcggtgacatcctttcatcttgctaaggcatcgattattcatccaggattaattgtgacattggcggcaagaggcgttggcgttggtagggaaaaagaggaagagcgagtcgccagaaagaaaaaaaaacgagaagaggcgtgcgtgtgcgtacgtcctcacggtgatgcggcaagtaggactgaattgggctcctactgaggttgtggttgtaggccgttcgtgcttcaatggcctgatttctagcgtgggggtacaccaaacttggctgagggggatgcacatatgattacgaaggggtattaagcactaaattttcttttgcaaccgggtgcccaggaacccccataacactacttagcttcgccactggatacagccttggttggtggctgggtaccacaaccaggaatgcagtgatagctgaggccaacttaaaagagggaggaatcgtggagacgtctaaggttgagtatgtagatgacaattatttgatttttcttggttgaagttttgtgatttttaagataaaagttttatgttttaattgaaagttttgtgattttgagaataaagttttagatctcgaataattagatgttttgtgatttttagatgaaagtttaaatttttggattgaaggttatgtgattttaagatgaaagtttgtgattttgaaataaaagtttgaggcacaagttaaaagctcagagcatttttttttttggatcagagtccgaatttcccgcggcacgtacgcaacttaatataatagcgcatgcactcgaattaggggtgaactcaagattggagtgagctcttagctagcctgttgagttgggctagtatcttaacaatacaaactattttaaacttcaaaaatgaattaatatgatttttaaggcaacttttatatagaaaacttttgtaaaaaaaatacaccgtttagtagttcggaaagcgtgcgtgtgaaaaacgaaacaaactatctcacaatatcatgctgccgaacgcagcaaagaatacaggggcagtgaagtggccttttggtcctacaccttgggcccttgacctatttggtttgaggtatggtctcattataattttattaaaaatgctgatggtaacacatagtagcagagcttgggcggtaatttggaggtggtcgatgtgtcaaagttttctttttgaactagtggctattatacttagtttgttagcggcaaagtgaaattcagacccccaaagttggagttccacgatcaatgtaagtctccatgcagctccgtcgattcagcaatcttttgagtgtcattaattattatcatttcgagcaatttatattgtttttatattgtcacaccaaaatataaaaatgcacaattactaacttggagggatgaataggttacatcataatgatttcgttcctactaaaaaaattttaaaacgcttcgcaaattgggacctatcagagacggaccgaggccttgagccacctaagccatggccatggcccgaggcctgagaatagaagtccactatgagtctatgaagtatagattttcaccatctatagcttggcccaaaagtgtgttgggctgacccgcctgccttacttcaaattatcaaacctctccattaggatccctttaatttctacgatattattcacaatcttgtttgcttagggtgtggacatgtgattgcagagtaattgatacatcaagcaaagttcaagatggaaaatgatcgactactggatttctactactactgtttatgtttgactcgactaagtcgatggacccgcagtcgagtatgaatcagtagttctctagccgcatccagctcgattcagattgaactctctggtttgacttcacacgtaggctgttccgattcatccgcggttgacaccgtgctaaacctgcgaatgccattgaggatgcggcgggaactgcgggtggcccatcgcgatcccggagtgcagcagcggctgcctccaggacgcgaccgcgcccgccggtgcgtcgtcgtcgtcgtcgggcagctgcctgcggagcatgacgtaggaggcgacaccgagcgccgtggcggcgagggccagcacggccgcggccgcgaagacgccgtccttgaggaagtagcacaccggcgcggtgtccctcgccacgttggcgttccacgccgccccctccacgaacagcactacggcgatcaccgccgctatcctgtacgcacgcacgcacgaacgcacgcgacacttgtcgtgagaccacaccgaggttgcgcatgaaagcagtcgtcgctgcgtgcttaatttgctcaccatgaggcaacggcgaagacgatgccgacgacccggttggtcttggaggacgggatgccgcggggcttgccgttgccgcagcagcagccgcagccgccgatggcggacacggtgacctgcgccagaagcagcaatacggcggcgcagagccccagccttagcgaggggttctgcgggtacaggcactcgtcgccggaaacccgcacgtccgaaatctgcaaaatcgatcgttcaactgtcagttgttggccacgtatatgcgccacggcgcatccattccaatgaagcaagaacgtacgcttcaggggccaggagagagatcggcaatgtgcttacagtgatctttgtgctctcggcggcgaatcccagaatggcgctcagcaaccccagggacccgacgacggcggagacgacgatcaccgtcttgtccattttcccggaaatccttatccttcccacctctctgtccgatctttatccgtggtgacagatcagatttgtgtgagcttatatagagatagaccaactacacggttcgatcggcacatggttgaagtcaacgaacaggatgagggacatgatgcatgttctgggcatgttcggcgcgcctccgtttccaaatgtccgtttttaccatgggcatgttagcagggactggcagttgcatgcgtctttgtttaaggaatcaaggtattgccatcgagctgccagggtttcttctcttctggttagcaatcagcaaagaacatttacagctgaacgtacgtgcaaggtgccatgttcgttgaggctaaataattaatataattgatataggtagctactttctctccatcccaaaatagaattgagcatattctagtgctacgaatctggacatagatcttactactttgaatttggataggagtttgttcatggttactcttgttcatattcgtaatactaggatatgtttgatcctgttcatatttataatactaggatgtgctcgatccggtactaggttgcagtactatattttcactggagtagtaatttactatttggattagacaaccaaatactacgaatttgaaccagtatatgtttaaatttcataatattaagctatgtgtaattcagaaatagtttacaatattttgattttgaaatagatggaatattaattaagataggtcgtgaatatgtctggcagactaggagatttaatttgactctcttctcgttggacatgcagctatcatagctcatgggggataaaccacagatcctattcctgccccgctggcagctgattgttgtacatatgcaagagatgttggctgtacgtttgaaggaatccaaagtcacctcgctgcaccacatgcctgcacgatcacgagcatttgcaaatcacttgcaagagcgtgtgaagtgtgaaccgcgcatgatttgaccaaggtatttttacaagcataagtgcatttctttttcgtattattttcacaatgagtaggtaagagcatctccaacgaaaatgtctatttaactctctaagctaaaatttgactaacacgaaaaaaaaagaaatagcttcaatacactctccatccggatagcaaaaccactcctttggatgactaaggctgagtttgagaaaggggagatagagaagattggtaagatacgcaaaacgaggtgagccattagcacatgattaattgagtattaactattttaaattttaaaaatagactaatatgattttttaaagcaagtttcctatagaaattttatacaaaaaaacgcaccgtctagtagtttgggaagcgtgcgcacggaaaacaagtcacaatctcctcaatctctcccaaatctcctttgaaagaacgcagcctaaagcttcgttctagctggttccagctccctccgcctcgttttctgcacgcacacttcccaaactgttaaacggtgtagtttttttaaaaaaaaaattttctatacaaaagttacttaaaaatcatattgatccatttttgaaaaaaaaatagctgttggaccactccgtttttcgtgcacattgttcgtgttgggaacaaaggataatgaacgcagcctaaatgtagctagcctcctccactggctaaaggtgggtcccaccacctctcccatccctccttccaattcctccccttcctgctctcttcacaggctgcccaccaacaagcagcgacaccgacagtggcagtgacggtgctaatggaggagtaaggagcaacgacggagcaagtagtggccttgagcatgatggccgtggacggattggaggggcccatatgccaatcgttacggctatcgtcatcgtcgtctatcgccagacctcgtcagggtcgccatccgatgttgtagttgtcgtcgccaacgtcatatctgcccggatgaagaagaagaagttggatgcgctagtagccgctgtcgcggtcgaggattcactgcgcgagccgctgccatcacggatttgtcacaccaaacggcgccgccgaacactggctccccatctcgccacgagcagtaaccaccaccacctccttatctgtcgggtgggtgggaaaaggaaagagatgtggtgttagagagaggggaagaagaagggtagagattgacatgtgggatctagtatcagattggagaaggtaatagagaggttattggagtgaaagataaatttaaatctttaactttttgacaagctgtctaaattggtatttgaagaatgaaaagtcggattttgaggtgctgttaaagaggccctaattaaggaatgatcgctcgatcctgcaagctgcaacttgcaggtgtggtctcaaactctcaactctcactaaaaaagttgttgggtacttgaggtccatctaagagcaggtctaataatatagccggtagttggctgtaaaaatatacacatcgactattagagttaaccacaaagatagatgtatacactagcttgttcatcatttttctctacacgactgcctatgctttctttatactttgatttaatgatgcgtgtcatcagcttactcaattcctaacccattcagtctttgtaacgtgggtccacagataatcttgcacctttggttcaatgcaagcaggtgatagagcatcgtttattgtgttagcgttagcgcttaaataagcgcccgcttggctctctctcccctcctctctctcttccacggaagatttcaatgacgtggatgattttgccgctagctgactaggcttattgtactcgctctaataactggccccaaatttcgcccgggctacctgtccctgcacggcctcgcccatcactccgcatgggccaaggcccacagtcactccaccaggcgacagagatttcccagttacagacctatcgattcagctgttcccaattcccactgcactgcacccagccatccacgacctgtttatgcttcgaaactgaacgatcaaacgtccagccattcccaatttcccatggtggtgtattgaagctatntctttttttttcgtgttagtcaaattttagcttagagaggtaaatagacattntcgttggagatgnnctcttaacccttaacccttttccaaaaactgtgaaaataatacgaaaaagaaatgcacttatgcttgtaaaaataccttggtcaaatn

SEQ ID NO: 9972 - DNA, 825 bp, Oryza sativa
  unsure (1)..(825): unsure at all n locations
gggaatgagngtgcacgtagatcggctncttgcagnagtccatcagtcatactcgatcaaagtaaaagttatctccttagaagatcaggtcaagagagagagagcacgccattacatgacctagggtgtccggggtcagggttctctttgtgcccgtgcgctacatttctagttaataaaaagtcagaatgcagggtagatatataaaacgtagaataaaaaacgatccattgagttatgtagaaatcacgctgaccatgcccatatcacacatcgctgtttttacgagttgctcctgttggccgtagcataaaccgtgtgcccattgaactgtgtcagcgtgtaaccgagctctcgtgagacctctctatatataaacacgagacgccaatcttgtatcagccgcgaagagaaataagagtccgatatgggtaagatcgaagcgcccgcccgccgccggcctgaaaggaagaacccggggggccccccccccgcgtgctcgcgattaaaatggacaagacgacgatcatcgtgtccgcggagggtgggtccccttgggttgctcagcgccatcctgggattctccgccgagggtgcgaaacgcaccaaggcaagttcttgctaacactagctacatattatctagactctagtgggatatatatgtttaccgatttttttttttgaacttgatgactactgccttagagattatatatgtgtttaatttcccagcgtggcgaactcgacctgtaccactttgtactaactcgtcgaactcatcgtcagaaggggtcgggctgggtgtctgcggggccatcttgn

SEQ ID NO: 9973 - DNA, 808 bp, Oryza sativa
  unsure (1)..(808): unsure at all n locations
tgcgccacnngtttgaacgtcgagattgcaagtcgnccatcacgaacaccgccgatatcctgcacgcacgtacgtacgtacgcaacccgcgtacgttcgtgagtcttggcatcacaactgcaggggcgatctgtcgatcagagcatgcacgtgcgcacgcgcggcgcgagcactcatcaagggaagaccgccaaactacgccgtcgatccgcttggtcttggacgggatggcgcgggacttgtagcacccggagtagccttcgatgggagacaccgtgacctgtgttatcaccagccagatggtcccgcatacacccagcccgaccgctgttgacgattagttctacgagtagtacaagtcgtacaggtcgagctcgcaacgctggaaattaaacacatatataatcactaaggcagtagtcatcaagttcaaaaaaaaaaagcagtaaacatatatataccactagagtctagataatatgtagctagtgttagcaagaacttgccttggtgcgcttcgcaccctcggcggcgaatcccaggatggcgctgagcaacccaagggacccaaccaccgcggacacgatgatcgtcgtcttgtccattttaatcgcgaggacggcggccggttcttccaggccggcggcggcgggcgcttcgatcttaaccatatcggactcttatttctcttcgcggctgatacaagattggcgtcaagtgtttatatatagagaggtctcacgagagctcggttacacgctgcacagttcaatgggacacggttatgctctgtcaccagaacactctg

SEQ ID NO: 9974 - DNA, 1000 bp, Oryza sativa
  unsure (1)..(1000): unsure at all n locations
ttacttgacaatggagctcctagggttagttatgatggaacatgtaaagcttcgatcatgttacttcagaattcgactgctgtacgcactgtgtaggatatactgcttttttctgaccatggtttcttatcatctatggagtcagcatacttctatgctattattagttttgaaataaagttaatattgcaggatagagaatctggagcttatgctgaagtatggtgttgaggtttggaagcttcagaatagacaaatggaatcagttttgtctaggtaggctattgtgacataagtttattatctttgaatttggagctacgtatcctgtgttattcatgagattcatttagagccatttcagtactcctgtttgtagactctggtctcatatgttgatagtgtagcttagctgtttaaacttccagtaaagcacttattttgatatttgaagcacttatttcgacattcttgtaagtctcaatgctacttatcactgtaacaatatggatggtagattatttttatgcctgattgcatggtatctaagatgtcgaatatagcatttatcattctagcagcatatgatgggttgatctctttataggatgcaaaagatggctgtcgaatacaatgagaagatagaaactgtcaaccgcgagaggaaatttcaccaggtaattatattactcctgctcttgttcttaaccacggcatatttcacagccaagctgatcatttgtgttttgatcagcaaaacactggtggtcaactccatgccttgacgacggaatggcaggagctgtgtcagaaaaatataactattcaagctgcatgtgttgatctgcagaatcagattgatcagcttaaacttggagctaaagaattgtactacccctttctccctactttactccctctttctccacatccacatgactaacagatttcttaacaggggaatgcccatcgatgacagcaccggaactaatcaacangc

SEQ ID NO: 9975 - DNA, 748 bp, Oryza sativa
  unsure (1)..(748): unsure at all n locations
gtgcgnctttgatttgcttgactctcanctcngcaanagctcatcaagctatgtcaaatgaagccaaaaaaaaagatggagaaaaacagagagaacactctgctcctcggcttctcgcatggcggcagccggcagcggcagcaatggcgattattacatttattacatgggccagagcgcgacgccgtgtgggtaggcgacggcggcggcggcggaggtggtggtggtggtggaggaggcgactactgtatatccggcctactggttggacgaggccattttccccaaagacctcttttgatgaatcatattggggccgctttgagattttgatcgctagagaatggttaaaccctcttttatctctcaagttcccaaaattgttttgcaaattttcgctatataaagttgtcacattcagtaaatatatttggactaaagaacccaatttcatagatattcaacgcatgcactgtagtgggggaggggcgcgccactcctttatttttaaagacttgagacgcgcctaaagaggcctaccacgtttttaagtacggctaaagtccatgtgtctggggtgggaatggaaatggaaacccccaatttcgggttgcagtgttccgattaagggcattgtttcctgtttgttccccccctgcccgtacgggattcattgttagcgggtaacctcaaaggactaaaaaaaaatcacttttaggtacgaaaaaactcggatcagactattttc

SEQ ID NO: 9976 - DNA, 7025 bp, Oryza sativa
  unsure (1)..(7025): unsure at all n locations
agcccccttgannatgcataactanatgcacagnaccccatcatttacagcattttacaggttacctatataaatttgaagatccttgcattcatgcattaattgccaaaagaaaaaaaaatcttccacaccaaatctagattctctcacggctaatgcttttaagtattctatcatatttggtcacacacctattcctattaatttagtcttggtacaagttcatagtatgctataattcattaagttttccatccatatatatgtttcataacatgtcttaccacttcatttgtcatctcatcaactgtcacatgatattattttccctgtttcaatgtgatcagccacttcaacaactgtatatggatgtttcacacacatacctattttacttaaaaattaatctgttattcactatgctaccagtcttgattatggctgatgctcataatgatactataatgcaggctgccatcatacgaagaaccaagcatccaaccatctcaatgatcattataaatttcatttttccatcagcaggtgttctgctagaaaacatatcaatgcacctctatgccctattatgtaccttttggcttgcaagagtgttatacgagataaattatttgtctcactcacctgtatgcctgccatgtaaataatataactattttaattgccaactgactaccgtcatcaattcttttgtccgatgaaataacatatcttacatatattatatgctttttagtaagtaaacttccagtaatatttttgttgtcatgtgaaatattaaaaatatatgcattcacatttatattaacgacaatgcagtttctaatcatatcagctttgacgttggatttatatttcaaaatctacatgaataccttttgtttccgtgcttcactccatgcttataataaccaattttcattatgtcccgcggcaacgcgcggggcacatactagtttagtatatacatcgtcaagattctcacgtagtccttccatcctaaaatatttttagacgctgttaactattttaaaaatatttgaccgttcgtcttattcaaaaaatttaagtaattattaatccttttcctatcatttgatttattgttaaatatacttttatgtatgcatataattttgcacatttcacaaaagtttttaataagacgaacggtcaaatatgttttaaaaggttaacaatatcaaacatttagaaaatgagggagtattcggaatgtttctagatttacacggcgacatcctagatttacatggccctttttcgagtttttaatttacgtgtttggggtatctttacaacaaaaaaaaagtcacaaacataactcaagcaaccgattagtctcgccctgttttagcatactaacataatttgagatcttatctaaaaaaataggaatttcaacggagacagtttaaataggaatttttcaggaaaccattacacaagttgtttctacgtttgggttcatccgctcataattgcacctcatcagtgcgtgtgttcggccgtccgtagctgttcattgtctatcgccgacgtccatcatatatatcgtcagatggacggcgatgggggtgtaaaagagtgacgctgaacggaggagggtcctgtgcgttaatgtcagctacttgtcttctcctcgaggccatagtacccaagctcatgattccgcagtgtcttttatcaccattttttttcttcgggcttgttcactttaatgccaaaaaaaaaccttactaaattttagcaatgccaaaattttggtatagttgtaaaaattttggtaacttgtcaaaattttggcaggatttcttatatagttcacaaaatttagtagcacactaaatgtggccacttttttttgtcactttatcaaaatttggtaaggttgcaaatgacatcaaagtgaacaggcccttgctctccagatactacctccacctccgttcgataaaacaccaacttctgactttaaatctagatgttggttttttatgagattaagagagtaattagtagtagtgaataaaaacagtaaaaatcaaagttaaccggcttggcgacctagaattattaaactgagcggagattattaatttgtaagttattcataaactgattttgcatgcggggtccgaatgatgtgcagtgcgcatgaacctgaacatgctcgtcgacggtagagctatttccccgacttttctaactcaccatcatcgttttttgcgcccactcttttcaaacggctaaacgacgtgttttttataaaaaatttctatacaaaagttgctttaaaaaatcatattaatccattttcaataataatatatatctataactaatataaatatttggatttttcctgtcgtcacctctcaatgatcgctgtttttgtccgatcatgcgacaaaattttcgtccgtaatgtccgactgagcggcgcccaatttccatccctaataatgtctgactgagcggcgccctccctctctgcgtgaacgcaatcgtgtacggtggccaaagaaaaaatcaaagaggatacaaaatcctaatcgtgtatgacaaatcacaacatcaaaaccaaccgataatcctagaaaatcagtttttcattcactattacaagatcaacactacaaaaattatgaaggtggaagcagaaacacacaaacaaatcctagatccctaaaaaaaccaattgcagcagctcgcgatgcggcaaatccaattgtgaccaaatcagcccaaacatcttcacaacaccaatggagagcaaatcgggtaaacaccaaagatccccataaaaaaggccacaaatttccaaagaacatcgctcatgaatcctcttactaaccatcccacgattgatggaggaagagaagcaagggtgctcgagtgaaagcaggaggaaaggcataaaaaacaatgttggatctggaccggtcgccccgcgcctccttcttcgtggaaccatcgcaccgtcctcgccatgctccctgccgccgtgctggtccccagctcgggggctgttggatctagcccccgccgccccgcgcctccttctccacctcatgagagaggagaggcctcgccgcacaggggagagggaaggagaggcgcctgccgcggcgcaggggagagggagaggcgtatatcccagataaaacggacacgtatatcccatatatatataccggttttaaaaaaatatataaaatattactggtgccaacactcaacacttttaatgggctacaggtgcgtcacaaatttttcatctgtaaagtccgactgagtggcgccctccatcttcgcacgagtgtaatcgtgtacaacggccagagcaaaaataaataaataactcttaatcttacctaactaaaagattaataattttcctttcgtcacaaatttttggtccgtaaatccgtacgcgtttaaccgttttaatcggatttcatgcgcgcaggcctagacagagtccggagctagcctggagtccagtacaagcccaaaatgcccaaatacgttcgcacccagtcacaacatatcctaatctgttttcttttcctccattagtttgagagaaaattatatttgaagtataggtagatgatgcctattatagatggagtggtagctggtttagttacgttctttattatatggcgtccccacatatgtaagatgatacaattttctctccataaagcaaaattcaaacaggtaagacagatcgcaacgccgcgagacattacggatcacaacataagacaaatcttatcttaactacttaaaaatttgtaattttctgttcatcacatcatttttcatccgtaacatcaatttttttgtctgtaaatccgattgagatccaatcagacaatccaaagaaagagaaaacgaatggaaaaaaaaaaacccgcataaatcttatctcaatctttgtcaccgccagatccacccacgggaagccactgtcaccatcggattggcctgtgggaagccgcgtgccgtcggcgccagatccgccatcgacgacgctcgcgggaagtcgctgtcgctgttggatccggccgtgggaagccgcggagggcgccgctgctcgcggtgggggacggcgcagcttcactcgctcgcagtgggggagggcgccgccggcaatgctcgcggtgggagggggaggtcgctaccatcgccttttgagatagagagagagagcaaggggatcgggggaaatgatattaaggttagggtttgagctgccgaatatttatctaggtcgggatcaatcgggaccgtccatcagattggatggccctggtttctcccgcgtcaggtcgggcgttgttcccaggccacctagctattgggccgcatatcctttatattaagttgtattatttatatagacagattaatatatccagtttaggggtttttttttggcagaagacttgttttatgcagatatccaattggacaacgtcatttttcaaaaaaaaaaacaaaaaacaaaagtaccaaaacagtgtgaaaataacttcagttaaaaacaaatatttttagttttaatacgccgtagcgaagcacgggcattttgctaataataataaatatttaattaattataagaaaatgtgtcaaatgttttgcgtgcgggacctcacctcccagccccgtactatcttgttcgaaacagaacgtgctgcagcaaaactcttggtttacgtacgcggacagcagtgcagttgcaggttgttacgctttaagaaagtacgatctcatacatgataacgtacctaggcacagtttggacttggacatatatgaatatttgtcgatggtttggacgtttggaagttgtgatctgcaacaaaagtaattaacaatctaccgcccgggcaaggttttttctagtgttaacaagaagagatgcgtaaaagaatcaacagctatatgtacatgcttgtttggtttagtcgtaccaataccaatatcaacacctaaacatgtttttggcactatcaatattttagtagggtccgtagcattctaagtaagtgaagtgggtttaaattgatactaattgagagccaagttttatcaaattaagcatgagcaagctccaaaccaaaccatcatatttactactccctccattctaaattgatctacatatagttttattttagttattcctaaatgatctatacatttgtgatcattcattaagtctattcgttatttgtgtattggagtaaatggacattgatgcatgcatccatgcacacaagtatttataacccacatgcaatatcttgatttgctattggctagaaaatagtgggggtgatgcatacattaagtttgttgctagagttaatatagtataaaaaagttcttagtttttcttgatcttagtgtacctatgaaatatgtagatcaatttaaaatggagggattactccacattttagtatcaatccaaaataatcctacatcaacgaaggacagatcagggcgtaagattcactccttttcactctgtagtcatccaagagcatatgcgtgtgctcttgctaaatccaaaaagaaaagacatgcgtgatcaacaatcgagaacgagagagagagagagagagagagaagaaaccgcgtgcccgattgggccttctgccgactgctcggcctgttccggtgtgcgatgccgcggtggcgtcgagcgtgcatccacatccaattatggaaaaagtccactttcaatccatcggctatgggcttacgacccatgcgccgcgccgatgaccgatctgcttgcggcgtcactgtcacaccatgcataccagccaccaccctgactttggcctcgtcccgacagcatccgtgtcactattcatcggcttggtgtatctccgtcctaaaatataatataaatattttgtatcaaaaaatataagcatttttaaaaattgatatagatattaaaaaaatgattgaaaaattgttgtgatcggttgataagacaaaataagataaaataattaaatggataactattgtgatttgttgagaggaggggataggtggagaaatgtttttttttttcagaacagaggcgccagtaatttttagctgagacggtcgtgcattttgtttgcttgcgtgtgtacgtgacagcaccgagcagttgccgactaacttgaagccgtgaagcgagtgaagctgcgaaacatacatagggaaacaggatgctctcgtgaggagaagttgacttgagcaaatcaaatggtcctatacctggtttaattccgttaaaaaaaatggacatcggcgttggccgtcagtttttatggacaagtcaccagatacgtgccggagcggagacaagggggagcggctgcgagacaggagctgggtggtggccacaacgggcggaggactaggccttgtacaacgctccaccgtggagtgtggtcttagaccttcacgtcggattcgtgtgctcgtgacagtgagaaccgtggtcttgcgatgccgtgcgtgacctatagaggttccggtggtctcatcgcggtctcagctcaagaacaacgacgccacgacctggaaccacgcgttggatgagtcccgagagaaatgagtggcttcagtgagagaaggtggtccataagggggaaaaggagagggggggaatagaaaagggttgcgcccctgggaaaatattgttcgactggaatagaaaaagtatgtttggtggcataacatgcccacccggatttaagtgctcgcatttacttctatttattggtttaatgctagacgatatactcagtggacaagttaattatggtgacttcattgctataaagatatatcggctcagtctgtatatgagtgtgggtgtgagaattatagggggaggttggtggtgttatatgagcagggtccccccgatatttggaattggaatacacaaggtgtgc

SEQ ID NO: 9977 - DNA, 7215 bp, Oryza sativa
gtcattgactttttacaaacgtttactgtttgtttaatcaacaacatttttaatgtatgacgccattgactttttgacaaacgtttgaccttttgtcttattcaaaaaatttatgtaattataatttattttattgtgatttgatttatcataaaatattctttaagtatgacataagtatttttatatttacataaaaattttgaataagatgagtggtcaaacattgattaaaaagtcaacggcgtcatacattaaaatacggttaaaatacgttggcagtactacctaacatggaccgtacatcagctgaagcacgaaatccaccttttgttggtacacgcccacacatgccgcagccgtcatcgggtaaaccagctgcaccagcaggcccctgatggccaggccagccaccatttgaaaccaattgaaaaaggcaaaattgccaatattcaaccagcctacttttgttgatattgcggaggaggggactaaaagtttttcttttactttgtgcatgtacatagagtttttgaaatttactcaactcactttgtactcaggactcctttgaaacataaaataaaagatacaaataaacaaacacaggataaaaggtcattctgtatgaaatcctataaaaattaaaaacaaaaattaatcaaattggtcgtttggatactccacataaaacttataaagactttagagaaaaagtatcatttaagtagagtagagttaatagaagagagatagagatatggtatcttggactttcggtagtacaagttcccgactcctccttctcattttccgcgtgaacgcttttcaaactgctaaacggtgcgtttttttttttaaaaagtttctatatgaaagttgcttaaaaaatcatattaatccatttttttaaaaaaatagctaaaacttaactaatcacgcactaaaacgctgcttcgttttgtgtgccggctcccgaacatagccttaaaaggaattcaaaacttgaggtttaagctcatgcttgaaatcctccaagaagtggaggaaaaaaaatattcgtccgaaacttttccaaccatcaaatcctacaaaccaaagggcattgaatccttagaaatcctatgaaaatccctcgttccaaattaacctttaacattgcagtttgacatactgaagttcgtgattaattttggatggtttatctatatggaaatttagtgtaaaaagttgtacttcctctgatcaatatgacgttgagtgtccaagacatttagccagtgcggagtagtatacttaataaaaataatgttggcggcataacaaatcaatgtgtattaataatatatgacatcgagaatacggagtacaccctccttttttcatgttacttatctcttagctttgtccttagctaattatttctaactttgacaacaaatttttcaaaactagtatagttttttttaaagaaaacgtatagtttaccatcatgtaaattatacattacgaaaatatttcatatggtgaagctaaaaatcataaatcttatcattgaactatataatttttttagatattagtggacaaatatacacatatttaatttaaaacaaaactataatgactttgtattaacactatgattgtagtacgattgagcggctcaggcaccaccctggttttgtggactatgtaaaaggaaaaaaaacgctgccacgccgtttcatacggagtactacggaagtaccctaacatggatgtaccccttccgttgggtaaaatctaaatagtgctcgcgtactatttgtccttagggcatgtacaacccacagataggggttcgtctccaagaacctcgaagttatcatccagacagatataaagacagctcatacaacccatagacagaggatctgtctgtaagctgtttaatgcttttgcatgtagctttgatcaattgcaaatacgtttgtgtataccattgtgtggctatatatttgaaataatactatcaagcatgaataagatacatgattataataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataatgcctgtaactgaagcatgcacattcacattccagaaagaaactgaagggtacattcacattcacataagcaaataagtcctctcggcactccaacaaaaactgaaactgaagcatgcacattcacattccaacagaaactgaagtgcacattcgcatttacaaatcacattcacattaattcagaaactgaaactgaatgagacctctcggcactccaactgacctcacaggatgtatatatctcccaggatgtatacctcccagccatgaccacaatcaaatcaatatttagctcccagtatatacctccaatgatcaagctctgaatttatttcctaaattttccttttctgatcatttgcagattctctccgcgcgggatcctgccgcgccgtcgcctcgggacgacgagctcgtacaacggtgctgagcttgcctcttccgcctcggagcacgggtcgtcgccgtcgcctcgcgagaggacgcagctcccgtcgcttgactcaaccggggggttttttttgcataaaaggcatcacaaagacggggcaaaaagacccgctgtacgtgcccttatcccgttaccctttcgtaagccgtccaattagttaatggtagtcgagttacgaacacgtgaccatctaagaagcgagtctattccaatgtcagacaaagagaactgcatgccatccgccagttatcacgtcaattaacactactatttttttatagaatctttcattacttatatattctagacaatatgttatttttaaaatatgtttgaaccattatactgtacttaaaatatgtgacaaaacgaatctaatatcaaatatgttaaaattatttaaattttgttacttcctaatgagttactttcttccaacagtacagttatttctagtattttgaagaccttgtagcattgtagttatttctgcacaccataaaaagatacttttctctagcagtagagttacttctaatatcttatagagatatttctaattttaagagttagttccctgtaggctgtaccagtgtaggtacttcaaataccatagaaagttacttctgttctttcaaagttacctttgtaagcagtgtagttacttctaggatcgtgaaaaattactccgtacatgatgctaaattatatatgtatttttaaaaataacatagagatcactttgaatgaagaaagtatatgtatttatttgaaaatcgtccgtacgttttacttgtaaatttactgtaaatagcctcacgatataataatttgtagtgctataaagagttatttatattacagagctaagctacttctataatttaattaaattactttaaaattgatatatgtttagatatactcaacactatacttgttttatttgttatatattttgagtgaagtgtaatagtgcaaatagctcttaaaaatactatacggtttaggaaatataaatcattaaaaagttttaaaaagatatagtacgagagaataatatattgctatttttaggaagggttactcgttgacacacggcggatgaggtggtcgctctgtttaaccatgtgctgtgtatagacgtgtcccttttgttggtacacgcccacgccgcagcgcagccgtcaacgggtaaataaaccagcagctgcacgttagcacgtacgcctgcacctccaggcccccctgacctgtccccaaccgaaaaggcaaaattgacgcccaaactgcccattttttcatcgagaaaaccagcagctaaggccgtgtttagattttttttcttcttcaaacgttcaacttttccgtcacgtcaaatattttaacacatgtataaagtattaaatatagacgaaaaaaaatcaattgcacagtttacatgtaaatcgcgagacgaatcttttgagcctaattacaccatgattttataatatggcgctacagtaaacatttactaatgatagattaattaggcctaatagattcgacttgcagtatatatacgacatctataatttattttattttattattagtataaatttaatactttaaatgtgtccatatacttaaaaataaatttgccgcacaaactaatcacagacaataaagctgtctcggcaaagccaaagcgcggccgttttcccgggtgccccacccccaccccaccccaccccggtccgcaggtttccgtcccaaaacccagcggcgaccgaccctggccttgccccatgcgtcgtacagacgaaaccgcagtcagtgccgccaccagctgacctgcctgaccaaccaagccggcggctattcatgtcggcaccaaaataccaccctccgacccgccaccgtacccgcgcgcgctgcagtcgcggtgcgatatatagcaacccccacttgagctagaattcccaatccatccaaacccaaaatcggaggtagctcaagccgaatcccccaacagttgtgtgcaatttctagcttgcttggttttcttttccccccactcggatcgatctcgttgttgtgtgaggttttttaagctttggtcgatggcgtcgatcgtgctgctgctgtcgaagctgctcggcggcgagagcaccagcgtaatggcggctgactggtacataagcggacacagcctccggaagttccggcccgtgacggctgctccggcgacgtcgacgacggtgcccaagtgcgaacggccggcgcccgagtcagcgggggagaagaagaagaaggagtcgttcgaggatctcgccgccgtgtcccggatcgcggtcgacgtgatgtggccttagagcatccgtcgccgccatctcgccggagaagaagaaaaagaaaattctattcttgagttttttttctctatttttctccttttttttggttgccaacgaggcatgtgttgtgtactgttctttttgagatcagatttgtaaatatacgaagtgattcttggatgtttttcatgtcattttgtcatcgattttctccttcactcgtttctttcactagttctccactctttttcattccgtctcaaaaaccatcacgattcgctctgaagtcttaacctaaatacgcacttgcttcttcagacaatgcagttcccgcatccagattgcttcataaacattgcagatccttttattcccaaatataacatcaattacaatcgttcgcggtacgcgtcgaacaacaacaatttctccgctgaactctcaagcatacaagagcaagcagatcgccagacactctgacagagagagatgctacgccaagagagtcccggccatcacagtgacagcttctccctggatccggactctcctgttctcgccgtccagctccaagtacaatgttccactccttggcgaagcctgacgaccatggtattgtgccgtttgtacttatcttttttttttcagaaaagtataatgttggcaacaattgtttaccccctacttgtcacaagaaggtagcaaaaggataatacctgaaacgccgtaagtttttgtttccccagctttccaccccagtaaggtgccagaacacaatgtgcgcttccacacacaggatcctgtaagagtatatccgagttggtagtgttttaaaagcctgtgctaaaaaatatactacgagaagtttcaaattttggtcgataaggggcatagagattaacttgccaagttataccaaaagtttctgaacactgaaggaacgatacagccatacagggaatgcggataaaactatcaaatgcatgataacaagtttatggaactgtcacaagaaatcatgaccaaaataaatttcagtactcagtcaaattcacactttggtcacttcacaagtctatctaaaatgatgtttttttaattactagttgtcgataaccccttgactcaccttgaggtattaagaggttctgattctttggagagattatatcagtcatctctgcatcaatgccaatgtttttcacctagtgtggtaggaactaggaagattaaaactacgcataaaccagaactgtagagacttcaaataaaaaacaccatattatatagagttaagtattgttttcttttatgaaaggagttaagtattgtagtaatcatgcaaggtgtaatcaatttatgtctctgattgatgaaaaatagcttgtgatgatttaacaattttgaatttagacaagcaacattggtaacatcgtgacagcagagaatccttctgtacccatgcaatgactaaaaagtgtaccacatatgagattatatctacatattctggaactaaaatggccatttttaacttaacaagccacattgtctgcataaaaaacttggttgttgggtggaaagaatcggcatacctcatctatcccaaattttgggcagaagaatcgtgaaaagaagtcataatcagatccagcaggtgctggtcccgtaacaataactcctctaccatcacattttttaatttcattaatgttagggataatatcagcaacctcttttccggaagaaagttccacctgaaagccatgccagaatcatttagtactaacaaacaaatgaacaattccaactccttcctctccatcttctttttttaataaaaaaaatccattataaattttccatcttttcagaaaagcttaccaactcctcatttaatattagcatccttaaaagattagcaattctttctcttagggaaataatcgtagcggtagcattgccatggttcatgacctccattttaatctttgaacagacattttttaatcattgacaatgttgactcgcctaattaaatttggacaaataataatttcaaagctattctactttgtaggctaaaaataaaattgtaagattcattccatattactattttcataacagtgcagaggtcagagtatttacaaatttattacccaaaagtgtgggcaaagtgtgatta

SEQ ID NO: 9978 - DNA, 2041 bp, Oryza sativa
  unsure (1)..(2041): unsure at all n locations
acatcctcccctccagaaggcatacgcgggcggggttgcccttgaacggctcggccgcgaacgcgtccacttgcgacgaccgcgccgccgtggcgccaccgacacgtcagcgtcagcatcagcatcgcgcggtgggtcaacaagagaaagggcggatagtgtactgaccacggcgtactggatggcgttcttgaccatttccggcgaggcggcggcgacgacgacgactgcggcgggcggcggcggctgctccgaattcgcgcgcgtgctgaggtggctgcgcaggcggggcacgtttgtttatactttatagagagtgaccagtcgtgctgcaggtgaatgctggtgctgtgttcatcagcactgacgacatggagcttggcggcttatattccttgtaggcactgccgcaccggacaagtgtcactgacaagtggggcccatggacaagtggagccctcggtgtgggagcagttggaaagttacaaatttggaaggcctctcaccaatcacaaaaattttgaagaaaaagttgggaactaggggtgtgtttagttccaaagttttttttccaaacttccaactatccatcacatcaaacctttcatacacacgcaacttttcagtcacatcgtctccaatttcaaccaaatttcaaactttgggtcgaactaaacacagcctagacaaggcctaggtgactggagacagtttaatactactagcatatactcctcccataataccaaaatatagcaacatggtattatattaaaacctacttattcagatttgcgggaatataatatactatatcatatcgaatgtatttactggtgagagtaacttggtactagtagaattctccattcagtcaagatggaaaatgatcaatcagttcggctcccatgacaaacccaatagccaacttcatgatcagttcttcacctgctcccttcttttttctatcctcatatttctgaccagctaaaatgatagtcaaggacagagctcaaccaaccaatttggtaatccagttgaagttagagctcacgtcaatgctgacaaacatgttgcccggcaagctgatttgtaacaggaaaacaaatattctgggcgtagcaaggcagactacaaacatctttacatggatactcgagtagtcgagttttcgtttatttactacagcaaaagcatgcatgctgcatgagaaaacaaacaacgacagaatttcgttactcggatcagatttggtccaagatcacctcggcaccagaaaccttgaagtcagaaggagctacctcaacattgaaagccttgatcttcccatcgtcaacaaaggctgaccacctaaaacggacagcaatacttttagaagagaagtaagaaaaatctatccattaaccagtcacatttcacaatctcttaaatgacaaaacatgtaaattacatcctcaaaaaaaaaaagtgtaccacagcatgagctgtccatggagattatggaatggcatttcaggcttagccaaatgcatacattgtgtcaccagagtactatttacaacaaatgaaagggggcacacaaggaggttcaaaagtgactcaatgttgaatgatgttcaactttgcggaatcacgcaactacatattccttcacaaaaaaacatgcaatacatgcacctggtgaaccataattatgttccaaatatgcacctcagctcttttgtttgaaatttcaatgcacccatagatagttgtgcagctaacaagggcatgctaaagtgcgacacttaggaagtggtttggattcatttattggagtcttttgagaggttagcctcagtgcagtaaattttgtcacaacaacagcaaaatccattggaaatcgactgaataagactcacacttaaatcatgtataggcatgtgcatgcagcttgaagtaattgatcatttacagtcatgaatcatgacagtttaacagtaggtgatgangtnctgtccaagtgatagctatnnntcaananggggggtcaaccaggccg

SEQ ID NO: 9979 - DNA, 2102 bp, Oryza sativa
  unsure (1)..(2102): unsure at all n locations
aggaggctttgcccaagcaacaaccggctatgagaagctatcctctctgccaagtagggttggtctcaacagttatatttccctgcccagtatatataggttagaaaaagagacatcctagtccctaagagataaggttcttctagtgttttcaactaaagacaagtgggtctccaacgggtgggtcttccagggagtcacagatacacagagagtctaggcttaagagaaactcctcagcagggcttaaattccgcctgtttgctgtgtgcccataggccattcacccaccctgtgtgagcctctttgggctcaaacaaaatctatccccttccctcctatccccaaactctatccatctacttccttccctgcccgtcccatctcttccccactccgcgagagcgctgtcgtccctccctcaccacatgggcgatgtgtgcgtcagagccggcgccagccctctctcccccttgtcctccctctccccctccgcacgccggcaatgggacctacggcggcggcgacggacttggctgcgagcgccagtcgtccctccggtcgcatgggcaccggcgccgcatcgacctttgccccacgtcgcatggagacgacgacaacagtgtggtttcggcgcgatggagctaatggccctcaacggtgacggccacgctgcggggttcgctagcgcggggagcagcaagcgacgtcgactggtgtcatttctgcatcgcgggcaaatcggaggacttggaccttagcgaggaggttcgaaggacctcgtgtcgctcgacagcgatggcgaaggtcatggtggtggagcttgcaagtgttgtcgagccagtggcatgaagcaagaggtcgcggcgggcgagcaggggcaggcgatggggagccggggagcaggaggtcgtcagtgtggaggagctcgcggaactcaagggcggcgaccatagcggggagcttggcggcgacactggatccgactgcaagttcgccgctcctccccacctcagatcgaaggatgtggagctccgccgccggcgcagggctgcctccgtcaccgccgccttcccatcaaccctacttgtcaacacgaggcagggcacagcctgaaacaaaggcatgccggatgggccgcacgattagagatggcaatggggacgatcatcgattccccacggtgaaatcacacattaaggccttattcggtttggaggggattgagggggaataattccacaccataataggtgtgaaataaatcccctccaatccctctctaaaggggattaaccaaacaaggcctaagggatgaggatggatgatatctgccatccacaggaaatctagtggtgcaaaactcatcaccatcggggaatggcaggggcgggggcaggaccagtgctccactccccgtcctcgtcccccgcggtgacccgcgtgtcctgtagctaggaacctattgcaacccatctccgccgccaccccaccgtttctctcccttgccggcttctggccatggctttgacctctcccattagctccgccggtgacgaagcaagatgagcacatgcggtgacggaccgtgcaaggtcaaggatggataaaatgtagcaccgtcatagttggcgggtacaggtacggtgaaatttcatcaccatgggaacggtgacgcgaatgtaaccccagacggtgaattctccgttgccatctctatgcacgaggaacaaaagggaaggagtaggccggaaccgtcctacggaaaaggagatgatttctgatttttcttttgtaaatatatgaaggagtaaccaacagatacctagtttttaatgggcgaaaaaaaacttttattatatactcacgtactttgtataattgtgcgaataaataaacaaatacgatacttcttaagtacaagcgtgccaacggatagaaggagtacaatttacatctcggccacctaacggtaacatcttaatccaacggctactcttctgcgtgtgacgccttcctcacgctcgccgtctctctctctctcctccacgccctaatcctcttnatgngctnctgtncatcggaaatgcattcaaagccgg

SEQ ID NO: 9980 - DNA, 738 bp, Oryza sativa
  unsure (1)..(738): unsure at all n locations
agcgggaatggatatctgatgtactgtagcncatcaaaattgtcccttttggaaaacttatttcgaaactaacccctgccaaaaacttcaacaaaaaataggccgtcgcctcagcgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggatggcttgcgggctgggacctcagcgccagcccacctggcgctgaggtgggacttggccgcaacccccaaggcccagaccagcaagcctgctggatggcttgcgggctgggacctcagcgccagccataatggcgctgactattggaaactcagcgccagcccacctggcgctgaggtgggacttggccgtttcggccgtggcccagccccgcaagccttctggatggctgggctgggacctcagcgccaggtgagccctgctaaactttagcaaaactttgcacacaacagaggcaaacatcaaatcatagaaatttacaggcagtaatatatccagagaaccatacaaaacatacattcatccatcaatcccaacatcattccatacatccatagaatccatcaatacatncatatatgaagtccatatatataagaaataaaaacattccatcgan

SEQ ID NO: 9981 - DNA, 1451 bp, Oryza sativa
  unsure (1)..(1451): unsure at all n locations
ctgcgcnctttgattagcataagcaaatcgacagnaccncancacannatttaaatatacacacgcagccctgttatcctaactttcattgtgcatgcgaagcatctacctaaattgttttttcataaaaagagtaccttggcttatgcaaaagcaaactcagtttaaaagccaccaacaagagataaattatatagcgactcataaagggaaagctttttttaccgatgtaaaaaatgcaagatcaattcttggcagaaaacacatgtgaaaactatttgtaggttcctatggttgggacacaaatcacctatccggatcttacctaatgacccatgtaatttcttcctgggccttctgggggagtactgccatacccaccaccacccccatagccctccaaataaccaccagcaccaggcattccaggcaaaccactactacccaggccttcagaaggccctgggttaggcaaccctgaaccatttgcaccaactcccaggatgttgttcagacccaaccctacaccctgggaggtaaggatagctgtcaaggcctgtcccagagcaggattcacccctgggccaccagctacacctggcaatgaagtcaaactggatactggagatggatcacatggtccccaacagcagcaccaggcaaagaatgactatgagcttcataaccaccaatgcctttcctcccgcctgaagtgccagcaccatacaaacccccaagtcctccacctttgttgggctttggtccatcaattgccttctggcagagcagcacaaccccctcgaattgcttgtgtggctcctgaagcgctttcttagcactatcgagggtcttgtagacaaatagagcaaagcccttcggcttcccggtaaccttatcgagcccaagaggacccttctcaatctcaccatactttgaaaagaactgcagcagtttctgcgggtctatgtctgcgccgacattgctgacaaaaattttccgctgcgtgtactccgacactggcggcaatgccagctgcgctggggctggggctaccgctggggcagggttagtggccatgccgcccggcggcacaggaccaacagaggcgagctggcaggccgtggtgcggttgccaatcttcttctggggctcacggagcgccgcgcgggcgccggaccggcggctgaagaggatgaaaccgtagcccttgcacttgcccgtggcgcggtcggtgacgaccctgaggtcctcgatctcgccgtaggcgctgaacgcctcggtgagggtctccgcggtggcgtcccagccgaggccgtggacgaagatcttccgcagcgccgggtcggcgtcggccgcgcggtggacgaccgtgagcacgtcctcgtggctgagcgcgcaggggtgaacaattaacgagctggtcttgtggacgcattaacagcgcctggatg

SEQ ID NO: 9982 - DNA, 2478 bp, Oryza sativa
  unsure (1)..(2478): unsure at all n locations
gtttggtatcgcggaaccccgcggagggttgattggatatgcatttagggcatacaataggaaatgtatatatggaaatagatatctactgtacttgattgtgttgtcggtagttaggacttagtacagtgtttagttgttcacttgtttgcatgaatttcacataaaaccataaaaaagaacgtatagagttacggaattgctataaatatggcgtcatatttatagcaattagtttacagtcgatcttttaccgtacaattagttcagcgatttgtgcatgtccaaaactgctaacaccatcattactactattgttgatactatacatcgatatacactatccaggacatactaatatctaatcattacggagtaaaatccaagatgccatgcacagatggtaggcaaaaggacaagaaaaggagaagccaaggaagatagagagctcacgtcaatgtctgtttttaaactgcagttacatatgtaattatagtgtgattctattgtagttacatatcacttacacaccacttacatatgtaattaatataattttaggatttacatatataattttagaacttacatatataattttgggacttacattgtaaatacactaaaattacatattagaaatttataatataaatacatgccggctatttttttataaaaaaatatggcgtcataaatatagctactccctagagtatatggagagtctataattataatgtgtagttgcacttgaacagtgcctagaagcactctgccagtcatacttgtcactgcagcacccttttgtccatctaacctagcatgctttttgttggaggattttggtgagttggactgggccattctatttttgtaagtgtttggttgaaaaactccatgggttgagttagacccaaaagggaatactatgtatatatccaggttggcttgatccgtggaaaaattggtgaactgttttgacccacctcctttagcgcagtacacatgaggcgtatgcttgtgaaaaagaagaagatagtgaaaatacacgaaacgagatgagacgttatcgcatcattaagtattaattattttaaacttaaaaaatagattaatatgattttttaaaacaactttcttatagatcattcttttataaaaacacacatacttcgggaagcatgtgcttagaaaacgtgaaaattttctactccgtgtggtgctggtgaacttgcttgagctttttcgtcgacacataaaatgatacaggagattagagtatgattaatcaactattaattattataaacttaaaaatagatttgtttgtttctttaatgaaatatatgatatttatttatttttaaaaaaacaccatttagcaatttagaaagcgtgctaacaaaaacaagaaactttcaatttggagttgataaaaggaacgcagactaaatgaatgatgacaatcaatttcgcatcctccagaagtatctaaagtatcaaacctcatgacctcatcagacaaaatggtcaagcctgggttagcttgagccttagaaaatcttattggcatgagtataccaaattagtataacaatattcacaacaatttcagatcacattctctatcgaatatcgatcccataaagattgcatcccacattcctttgaattctagtgaataacaagggaccaaaagcatgccacattcctctgaattctagtgaatagcagaacaccaaagaagcaatgctggcataaacaaatcttccggttctcttctctctccttttttttaataaatccccaaagggacacgaatagcttgtttgttagtccaaaatatttgtgccaattgtttgttttcactctgccttttagcgcctaggcaacttttctattttatcaatagagtatcagggaaagcttcttcaacttcagccaagttattaccaattatttctgccccaagggcatcaatctcatagcgcacctcctccatgtgctcgtttatgctggtcactgcctcttgaacaccttgtatggcctctttaagagcaccatcatactcagcatctgcctctgcatcctccgtgccagcagcctcggttatctctttgacatgcacacagacatgttgagccatattgcttgacctgcaatctgcatggttcaccaggcgttccgaaggacgaccagctttcttcaacacctgaattcttgccgtctgaaataatcagagattaaaaaaaaaactttgttcagtgaattgagaaatttccaagctgagacctacagatagattgtgcgtcagatcaaaccaaaacgtgattagccacaacagctagaaacaatcgtttgtcaggcttctggactagttttgagtttaattttatttagcagcaatgccatgcgttgattaatgaaattacttttgatgngctnctgtggatctgacatgtcattngggagcat

SEQ ID NO: 9983 - DNA, 5979 bp, Oryza sativa
  unsure (1)..(5979): unsure at all n locations
acgggttttgatgccttctttgcaccagcncatcaaggaaaacaaaagtatatcagaaaatagtctcaatattaaatcaaggtattgctgctagttgctagacaagcaattcaaacaccctaagtaaacataacacgctaagtgcaaaatatttcaggggtcatcagtaagagagtaataggtgtagttttcaagcaggaatatgccatcctattgcaattgatactatcatgctcaaacagattagtcaatgtgacattaacctttgaatgcatatcaattactattattgctaaatcagggaaacaagtttatattacttcctctgtttcataatataagtcattttgactttttttttccagacaaacttctttaagtttggcaaaatttatagaaaaaaatattagcaacatttacaacaccgaattagtttcattgaaaccaacatttaatatattttgataaaatgagtgttttgtatcgaaaatattgctatatttttctataaactttgtcaaacttaaaaaagtttaactaggaaaaaagtcaaaacgacttataatatgaaacagagggagtattttatttgatcttagagcaaagtataactccaaaccagtcagcactttgaattcaggaatcgggatgcatgttaaatttgttaattgaaataggttgagttgctatttgtaaaacggtcagaacgaaaccataaaaacaaaaaatttagttctttgtgtgattaatcattccgacatagtagcttccttacgccccaattaaaagcaaaaaatatagtaggtaaccaagtaatttggtttttgaaaggaaatcagttttcagttgaaaataaagcataaggctgaaccatgtcaaatttcataacaacacaatggagtcatagacaggttaccagatgcaacttctctttctcgtgtgcctgcacatccttcagtaagttggcaagatcgccacgacaaatttctggcgttgataggagggctaccatttcgagaacctatagggaataatatgaaatatataactttgtatgataaaaggagatgagtcaggtgataactgcctaacttgtttcgagcaatcattgaactccgccgtaacactcgcgcatagttgttgaaaagctaattcacctccattagccatgtattcagaaaaacccctgcataactttcaaaatgagataacaaaaagaatggtcggaaccctcaaatatgacgatgctgttttaaataaaagatttccatcacagtatccaaaataaaccatgtatgcgatacaattagatttgagcgttgattttcagcacttcaagattgtatgcttgtgagttgagagttctactttttaagttacacttcaacatgaaacagctttgctggctcaatgtagtgattatgattttaattctgtacaaaagatgagttaggttaaccagcataccaacattatttaattgctgttagcaaatacgacagtcagtgacatctttccatatgtgatatcgtattttctgttcaacatgccacttgaagcatataatgagttcagtaataccgacgcattcctttcgtttcgttgccataatttcagttattttagcgttgcataagggtgatactacttccgtgctccaggaaaaggttttatcattttgttaataacttaatatcttcaatagctcatcttttctagtttaaaaacttacatacccaaaatggcttgctcttcatattcaattcatcgcctcaaaaatcacattcagagtgcaatttatcactaaaaccacaaagatcctgcctacaggaatcacatacacagcactctaacctcggcttaaaagttaccagggcaatgaaaaatccccccctgattctaaaagttactccaatcctagggttttaggggcgggactgcacaagttgcacggacccagcaagcagcgagatagtataatatataccttcggagcgtggagtacgcctcggcgcggcgctgctgcacggcgaggaacccgcggagcactccggccaccctcgcgttgctccgcccgccgccgccgcagtccatggcgtcgctgccctcagcggcagccgccgccggagggcactccgccatcgggtcgccgctggcgctggcgctgacgctagcaggatccatctccgccacgctacggccgcctccgatctctccccccttgatctcagctcttcacgaggtgagcgagatttttgcgtgctccggccggcgtcccgccctcccctccccttcccttctctctctctctatctttttccggcccagagatcgggtcggttcaggagttttttttaaaaaaaaaatcagttaagttaggaatcgaagagcaaaccgaatggacatttaacttgccacttttaacatgtgctaattaattatttatacttattgtatatgacatgtgggtccttatatgtatatgatatgtgggttcagtgacaattcttttatcaccactaatagataggagtgacaaataattaattattccgaatcatttctctcggttgttaaaaaagaaaaatcagtctctctccttgttaagccgtttttcttcttgttatgaatttcgcgtgtcaaatagtataagattggggatttatttataggagtataaattactactgtacttgtaagtttcactagcctggtccagacttaggctgtgttctttcctggttgatctgggtgattgtgagtgagttttgtttcgttttccgcgtgcacgcttcccgaactactatgttttttttaaaaaaaattatataggaaagttgctttaaaaaatcatattaatccatttttgaagtttaaaatacttaatagttaattaatcatcatgtgttaatggctcacctcgttttgtttttgtgtaacctaccaatctcctctatctcttctcctcaaacacacccttagactattaaactttatcacactttatactttatgacacagttgcttatttcgttgtcacgtggtggcttgccacagtttttttatccttcgacctgcatacacattcttgtgcaaaaatttaccaaatctatattcactaaggccttgtttagttgaaaaaaaaaacttttcacccatcacattaaatgtttagacacatgcatagaatattaaatgtggaaaaaaactaattatacagtttgcgtgtaaattgcgagaaaaatcttttgagcctaattgcgccatgatttgacaatgtggtgctacaataaacatttgttaatgacaaattaattaggtttaataaattcgtctcacaatttcttaacgaaatctataatttgttttgttattagactatatttaatacttcaaatgtatgtccgtatatctaatgtgacaactattcccaactaaataaggcctaatttgttagccacaccatagtttagcatagagaatgaagcaggggcaaaatttgctacgggttaggtcatgtttaatgtaggttaatgagtggattattcaaatgaattatgtatttgattatagaataaattaaatattttaagaaataaatatagtaaatactccctcctctatataatccagatttataatatataatccagatttataatggtaggttatatctattttaagacggaggatttgtactgatgggttatctatttttgagactattggagtagctcaaaacaaatactagtctaagtaactcagagcgtgaaataaataatccatttcaataatccaataaatgttcggtttcatatgcaaaacgatcacaacaaaaatttaaacgttaattttaggccctttttttggggtgtgggtgcttcgtgttagacttttaaccgcttgtaagacatatatatatatatataagtgctaaaattattcttcgttgctctttcattttcttccccgcagcttatcgccttcactcaaccaatcagagccttgttccgtgaggatcgaaatgagggtataacagaaattgcttcatctgctggtcctgaacatctcacgattagcaaaatgaatccttgttacattggccagtcccccaaatgataatccagcggtatacagttcgcaagtgccatggaaaaaatggctgcgtcgctgccgttgccggcttgccgcaacaacgtcgcaactcgttcacccgtccgatggaacaccggttcctcgttcctttctgggcggatgtcccatgtcgcttcttcatccatgcaccgtttggctgaccccattcctaaagaaagatgggatggatatgcatatgctggagtagattatctggcaaaccagcataaaagcaaacacaagatggaatttgcgtgacaaaacaatgtcctcagtattataacttgacctggttaaataattggaatcggcttaagtaaacaagcatgagctacatgagtttctgtcgttaaggctagataaccaagctaagataacaagctattagacaactctactatcccacatggtacaatgtcatgaatgccatgaactctaattcagtgcattatgatgcatccatgcaaaagagggaagcaatttctatttgcttgcaacagcaatgaggtgcttagcaggcaaatgttttgcctcgctgaatttcaccaatagaagccatattactggatttaacttcaaactattacagctagaaagataagtgataacagcactgagtgacagatcactaatctgaaaatgtcttcaagaataagagaaaagaaaaaagaatggaaggccggctagttaggagtttaacagaataaacactaatcgatgttagaatagaacacaggtgcaacagttcaacacaaagggcggcatgcatggcaacatagccaactaccatagcacagcagtgcaatttatgaaggaaaagcacagtttcatctgttagaaagttctaaaatgcaatatattcctgtagtcaagattacctgtatgcagaacaataatgacagactgggttgaaaatactaaggttactctacacaatgaaaaaagatcaactctttgtttagaaacatgtctgcatgacactcccatgcgggttaggataaaataagtttcgcaaatatgtaaaaaataatagaaaaggagctctgtacataaagcatgtgaaaaggtaacctgcattgggttcacaggtcaatttaaataatttaaaaggtaacctgatcttatgctgaaaatctgcacttatttagccaaaacgatgtagaaaagatccatggttctttaaatccacacaagctcttttacaataaggtcacaagccctgatggccattcgaaaatctaaatagttgtacatactgcttaattttgaaagataggattgaggaaacaaagttcttgtgaaaactttgaccactagagtaatcgatttgccagaaacagcttaaaacagcaagtttataagtgcgaagcaggaacacgtagaatcatctggccacagtaaaatagttataagcatcctgtaaaatagcaaggtgaataaaaataagtgaaatgggtctgcaaaaagttaaaatttgtatgtacaaaaaataagtttctgaaaaaatgatatacatgtactatggtgatttactagcagttaaaaaaacgttatggaagggttatgaaataactaatatgttacaacctagctgaacagttgcactgcatacgcatcaaaataaggttaggagcaaactgagtcacatgagaatgacaaggcacaacatgaaccatgcatgattgcgaataattgtgaatgactatggatagcgcatgtaaatatcttaaaatacttttggtaaatccgagagccagacatgataaagaaataaaccagaggtggagcttcatacaataaaatgatggggtnctgtaccaggggaagcgaaacgaaatcagcccg

SEQ ID NO: 9984 - DNA, 12442 bp, Oryza sativa
  unsure (1)..(12442): unsure at all n locations
tggcccattggnagttactaccagcatgnacagnagcncatcataacaatattaacaatagaatatacgcgagtcgaaaaattgtgcttctttagatttatcgaacctattagtgtacatatttatctttctaaattagcgtggaatcattgtaataattaagtacggctttgtgcttcttatttgcagcggccggtttatccattatgtaaaaaacttccgtgcacttaaaatagaaaacaaaaatacaaaatatccagcaaagttgattttgccccaacgtatgtacagcagtgcgaagaacgttgaaaatcttattgtcaagaagtgtccaatccaacaagagatgtaaagattaaaagtaaaccgtataaaatatcagtaataatatgggtttagctttacgctattttttctataatggaaataattccctagcttggtgatcttttttttatttagattttcctttatttctattaacttaaatggagatatccaagacgtcagacaaaagcatagatattggttaatagaaaccattggagtggagataacgaaatcctaatttaagtttataaaaaaacaatcttccaagctccatttaacacattccatgctgtagtacaccagcaacgatttcaggcggtgaacaagctggaagctaagagcaatagttcgtctaacatgtcagtttggggatctagcttcaaaggcttcattggtcaaagtctgaggcaccaaaaaaagagtaatctggatcagcagatgagccaagcaaagggatgtactctgatcctctcacatgaacactgaagcaagctgcaaaatacataaacactgtcaaacgtctacaaacatctagcgatatagtatcccagacaactgcatatgtcaaaaaggtaatactgtactaatcaactgcggacacatgaaaaaaaatgatgctagcccatatgtaaatattttcacaaatgagtggaacccgattcacacgatacactgaaataatttattttccagctgtaatatcaagtttgtgaattttgtccatactaaaacattaaacaaggtagaacaattgctatagttcaatacggtaagccgaggcaaaatcaactactcaactacagtctaacatgcaccccccccaccccccctgcaatcattcacgaggttaagaaatgactgacgaaagtcatgttaagcattttctattttgaactagaacatttggattccatcaatccatcacattaaacacttaaacttgactagtacatgcttccaagttccaaaaaaacttaaaatcaacttagttagctagttcaagtgggggcgtccttagaaaacaaaggattcaacaaaatgtcagagttatgaggttctccgtgcatagagaactaagccggttaaaaacgggattcgatatgtcagttgtaccaaaaagaacactagatcttggataaaggaacacgtcatcaaacaaaagtgtgccattttaagaatcgggaaaatatagttagaatttagcagatatagaaaccccatctttggttggcacaaaaattattaacagtcatttactagtataaatgagcattagaaatgaagatacctctgaactaaggaaagtgcatgttaactactaatctatatagcatgttaaagagtacaagtctatataacatgtctgtatatagtttcacttaaggaaaagataatatgtttcatctattattcatgttgtgataagtattgatacgtccaaggattttatgtattttcaaataaaggtcataaatgaggactctggtataaagttgatattgttgggcatcaaagaagtgataccattctcaattttcactacactttgcagcatagtctccatcttcttcttcatctcactattgtcatccatcagaggcaccacaagggtcagctccctgtatatatcacgtacaaatgcacaaatgtttttggcatattcaacttctccatcagatatacggccaattgcaagcctcatcagctctcctgacagatcgacaacctaacatattgacagcacagaaataccctcaacaacttcaagcagacaaagaaaaggatatttagcagaactaaattttggacagttgcatttacccctaaaacatagtcgagtacatttatctgtaagggctcaacagatttgtcacccagctctagcaaagaatcattgatttcagcaagacttaataaagtgccagtcttgcaaaatctgcagaatgttgcagcttcaacatattcttgtacctgaaatagtcatgacaaacatattggatccgttacaaacctagaacagaaccgatgtaaaggaacaacatttatactaacaccaaaggtataggcccttctgagcttccagaagtcggtcccttgcagttcttttaccaacttcccaatgtattggttaaccacaacagtgagatcattttcagcttttgaaagaacctcttccttgttattcttacttatcctgaaacaaatcagttcagttataaattaagtatagcagcaaataaaattgcaaagcagtataacagagagtaggtcaatttggttattaactatgaaatcatgaaagagacttttgagatgagtatgtatagttctccaatgttgtcagatgaatggacaattttgacactaaataataacttgaatgtatcatttgcacatacagcttttatcaattgccaaaggttgagactagcaataacttctcacaacgtgccacgagatgaaaataagttcatctaaaatcttgtttctgatcgccttcgatttggaggaaacaaatactccataaagcttagctcatggagagttcctgattgtccgtacagtgagagtaataagttttgcaaaaccagaatgacgtttttacactaagaataaactagaatttactggttcattgacattccacaataattttagtatcacatggcatactaattcataacaaactaaggtaatgaatgatacaaggggccctaagaatcacattatctgtcaaggaaacatacatggataattctcttcctttatttaatgaagcaatgtaatgccactagcacaattgtttgcttgtcaaattacctgtgaacctgaaagatggcctttttgctgttcattgtcaaatcccgacttgctttcacaagccttttcccttttatcattctacatatggaaaactgatgagataatataaaaatattgctaacttaagaaagatacagcctgctactaccataactgctttcagcatgtacaaggggaaaaaaatgttcaactgaagaattacacactaagagtagcagtgccgtccatatcacacactaaaccaaatatacatatcttaagcagagctacctagcatctagttcaagcagctttgaggatcagtttggtacaaatgtccaataacaataagttttgcagtgtccacaccccgtgaggtcagtaatctttacttgtcaaaacacttctcctaccctacaccactaaccggcactccaaagtgatcgacaaggctatctcgtcaataatgcactcattagcagaagccagtgatcgcataggctcaacgggaatttctccgagcacctggcccgcacaagatcttggcaccagatcacaccaacagtttccccaaaaaaaaaatcatgcctctactctactctaatatacgacagcgtcctctttgagcgcgccgctgcaggggggaggaaatagctcgagaagagagaacgtcgtcgcacgccaaggaggcgagggacgagcgctctaacgcgtgcgtacaacgtaccagggtgttgaggtactcggcgtgcttggcgaactcggccttcatcgcggagcaccccgccgaggccgaatgcgccgtcgccgccgcgtcggtggccatcgtcctggacctcttgggcgccgagccggcggtggaggctgcagaggagggggagcagagagggtgagaccgcggagaggggagaagaccgaggaggagagggaggggagtgtccagagcgtacgcggaggagggctcgcgcgaagggttttggcggggtgggagtgggactggggcgccgccatgaacgtggtgggggtggtggtgatgggagaaagaagggagggggcggtcacgccgcgcaggaagaggagtcgtcggtggcacccgcgcaggggcaacatctgtcagattgtgggccccgccccgtctcggcacttccgtttcctttgcctcacttggtgcgatttgtatttgtaaggcataatatgcttttttttattattgtttttttagaaaactaaaaaaaaattcgaataaggccttttttaatggtggtgtttgaatcagggactaaactttggtccctgtcatatggatgaatttggagtattaaacatagactacttataaaactaattacataaatgagagttaattcacgtgataaattttttaagcctaattaatccataattagcgcatgtttattgtagcatcacataggctaatcatggattaattaggctcaatagattcgtctctcgaattagtccagggttatagaatgggttttactaatagtctacgtttaatatttataattagtgtccaaacatccgatgtgatagggactaaaaagttttagtgccatctaaacagggttttagttctcaaaaaaaattccaaaaaacgtcacatcgaatctttggacacatgcatagagcattaaatatagataaaatgaaaaattaattgcacagtttgcatggaaatcgcgagacgaatcttttaagcctaattaggccatgattagccataagtactacattaacccacatgtgctaatgatggattaattaggcttaataaattcgtctcgcagtttccaggcgggttatgaaattagttttttcattcgtgtccaaaaaccctctttcgacatctggtcaaacgtccgatgtgacacccaaaaattttctttacgcgaactaaacaaggcctatgattaagttcaggagaacccacccaacccaagtacatcgacgaagagatacacggaaagtattgaaccgtcttatcataaaagaggctaactgaattaaagaaacaaactttctaatgaaactgaagagtagcataggagcagatcgatagggtattgtgtcatttgtcgcaatgattgcgtccttaggccttcgttaacgtgcaatccgcttgacatacaggtaatttccttctgttgcctccacagaatgtacacgcattagaggtttgttgttgatgttgcgtggtgtggtgttcatcgttaaatctgaagagcactaatcgcaaccgcttggaccaagggtgcacaagcagtctatactcaacccgaacaatgaaccctgcatggttaccgttgcatagaaaacgtcgagaaagatgttccctaaatccaaccaaccttaatcaagagagaacttggacggtggcagtagaacatctgtcttgctagatcaagctggagtacatcatatgaatattgagagaaattaacctttggaaaccttaaaccattaaatgctataacatgtagacttggttcaccacattcagttgaacaagcatgaaatccacaccaacgtcatagtcttcgttaagcaatacctatctactcacctactccatcttgaccaccgaccatcatccgtagcccatccatcaatcgagggagctagccaatgagcagcaggtttggatcaagcaactgttggttcgggcaaccccaccaccagtggaagggcgcagaagtctccagccaaccccatccaaatcaccgaaaagaggaacctgaacctagcattgaggcatcggatccatcggaatatggctgcaccgaaacaacagcttcaagcctccatgatgatttagccaataaagtcgatgaagggactatccaccatggtctagcatgcatgacacttgagatgtcctgcaacacataccgccaccatgggtcctaccaccttcagcaaacgctatggacatgacaccaaaacaggattaaccttaaaacacaagaggacttgacatggaactcgaacactaaactatactacacttattaaagaagaaggcccgacccctcgtttgaccatcaccgacggaaagctgtcggaagcaaggtggaaaaggggtcatggaagggttttactgtagctctctctctctcttcacctttgatgttctccagaagcctcccttgtaaggtaggctgtttaaatacaagaatatgggtgtggaaaaagacacaagatttatggaatatataatattggttatggagtttttatattgaatattgttcagaactatattaactcatctgtactacctgtctaactccgtccatactatattaactcattaatactacctgtctaactccgtccatacaccagtgtatagctgtatagccataagtaactattaattatcccacaaaatgtaacgttgagacaattttctgtataacagcaatagacttatgccactttttttttataaaaaaattgtagcattataagcacccaaggaactatgtataatttacttaacaatataaatattttgcaaagatacacaaattatgagttaaaaaaacatgtgcttttgcgattttgctatatatttgtcgacaaattttctcccaaaaatttaacagatgtaattacagtacaatcgtagtgtaattacactgtaacttgcatgtaattacactgtaactatagtgtaacttatatgtaacttgcaaaaatctctacgtgatatgttatttcggtaaaatagaagttgtgggaacaaatccttacacatatgtgtgtgccgtgattttatttttcttcctcaccaaaacaaatcttttaatagatctaaagattcaaaattacatgaaacttatatacaagttacaccgtagttacgtgcaagttacagtataattacatataagttacagtgtaattacactataattgtactataattacatctttcaaatttttgaaagaaaatttatcaataaatgtataggtggtcccgtgcttttgtattgtgtttgcgtgaaaaaaggacacggtaaaacaagacgttggaaacccagtcacccacggtcacagcccaacaagcccacacaggccacaggagggttcaaccgtccaagggacagacgacgacgagcacgagccccagcgaaaacaccgcgggagcaccgcagcagccggcacccgtgcattcctacccgctgctggccccacccgtcatatacaccctcatccagccggtattttctccccacggtcggggccccacatgccagccagcgctttgcctttcccacattccctcctaaacacaaaagtccccataggggatgtcccccttctgtctgtcttacctgacgcgctccacgcacgcagagtctagacgcgcacgccaccctgtgggtgtgtctgtctcgctctcgacctccgctcttccgttcccatcaccacccaaaaccctagttacccccaccctctcaaaaccctaaccccaccttaccacccttttcggaggcggcggcccttgtggctgtgcacccatcactccaccggataagctctagctatctatcatgcaaagcaggctactagtctgagctctctctgtgacggaaggcggcggcagcggcgcggcagctaggggaggagggcggaagaagcggcggtagagcggtggcatctggagcgttatgcggcgggggcggctcgggcgcccgcgaaggaggaaccgaacgtgggcggaagggcggcggcggtggtggcgcctaaagggccggatccggctggcgccgacggcggtggaccgggcgcccccgcgtctccctggaggaagaccacgccgccgcctgtggcgggtgagccggtggtcatgggggccaagtcgtggcccgcgctggaggaggctaggcagaaggtcgccgccgcggaggccgcggcgaggccgggggcgggcaatgctggcggcggtggcgaaccagcgaagggggcgcaggcgcagcagccgtcccctcccccgccacagtcgcaggtataatctggtgctcgtggccagccatatgcttgtttgctatggctttctatttttgttagtttagttcttaaggaaattttagtgtatggtaaagtttgctcacttcggtagatgtttatagtatttgtctctctatacgaaataggtataggttgggtctgggtatgcattggtctactggtaagtagtaaagtaaagcttggctgtttttggaaccacgtatttcaggttcaactttctcgagtgtgttcaactgtccatgttagtttttttgcttaacaagaccgcttgtccgcttatgttcaaagtaggttacacatgcattttgcattatgatgtaagtttgctatttgtcttagaagtaatgttctctctcaagtcaaccatgccccgacagcaagtggttgatacattataggtgtcatattttgatacgtaggatttgtgcattttttgtaacctattatcagattttgtttccacacaagttgtgatccaattggatctttgtatgattttgtccactgtgtctgtagccatcacattattttaggtattgctgtttggtcgcaaacttgcaatcattccaatgctatctagacggttattcaatcttaactgaacatgccttttatagctatctcctttgtaagactgctgggatggttacctaactgactcccatggaagcactttcttgggtgctatggcaatgcagtacatattgaacttatttatcatcgtgggggtaaatataagccttgcatttgtggcagttttgtaacgatcatgatatacatttatcattgttaagatgcatgggtggtctatcccatgaaactgatttgttccaaggtccactcggtaagatcaggaaaacatcattcttatttggtttggttccttgccttccctgtaaaccaaatagttgtcaaacaggtgttttgtgtttcacatgcagactaaggataattgtatgcttttcatcaaatggtttaaagtcccttaggagttattttttttattttaatgttttatgagctgaatatacattattttgtcactgttctacacaagcattttttttgctgatcatataagcattcttcctgttctgatttagtctgatgcaaagggggaaacacttgtttgtaggcacctaatcgcacgcacaagtttgatggccatggaaatcccaacaagaataatcaagcataccatagaaatggccccaagagacgttctcctgctgcgaatgggactccatcttatcctgccgcgatgccatatcaccaacatccagggcaacctttttactaccctgttattcccagtccagtgatactacatgaatatccttacccaccttttgctgttccggttccaagtcatgacccgcatgctggaaaatctggatatgagaattctatgcctgcttatgttccagtagatcaagctggtggcaatgaaggtaaccggccagtgcctccacaaccaaggggagaccttcatgcttggaggcctcctgttggtgcaagaccccagcctggccttgaaggccgtggccattttaatcacaattggcagaatccccagatgttcggtaccagggaaaacacaagtgtaccacaaggtgctgggccaagagctttcatgagaccaatggcacatctgcctcacactctgggatacataaatggtccaccataccctggtaatgctatgctcactgtaatggcatctcctttcatgcttggtattagagctttttttgcaccaatattaaaaaatgtgttgacccagggccaatgcctcccatgtattattacatgcctgctgtacccatggagccgatgagaggtccaccacgttttgtccaaaaccaaccacctcctcatcctgttttatctcctgaattaagagctaaaatactgactcaagtggagtactattttaggtaaattcttatttcttctattgagttgggtagctattttatattgggttaagtctgatttactccccctcaattatcacaaaagtacgatctaccccccttaactctaaacaagatattttacgccctcaaacttttaaaactgtacgaattaccccctttgcactatattgggtagtttttgcataagtggtgtctatgtggcaacaaaatcagtggaccttttttttaagacctatggacccacctcccattctcctttgtctgtgttctctctctgtgttcttcctacacgagcaagagcaaccatccaaatcggagatctctcaaaaccacatccggcatggcagcaacagttccatttctgtgactcgcctgatgcaatcaataactggctttgcttgaagggatgcctcccactgaatccaaggccatatgtcatcgaagtatccagctgcatatgactgattacttcctgattgatctctctgttgagctatgatgcacacctagatggagctgctgcacatggttggagctcgtcaggtgtccttttcctgaaagttcgcgaggagatcgccagcagcttgaatgggcctggctgtggatagatcggggaaatcactagcagcttgggctccgctgtcgctcccgcctcataccagtctgccactgttgtctccatcgtgctgctacagtggagataggggcagggagatgcgactcggttgctgctcagaaccagatgccatcgcgcctaaagtccaaaggttgcaggagggagaggggagagaaataagaggggatgaagaaggtagggagaggctgacaagtgggtctgattccacgttggatgccatgtaggcttaaaaccaccatatggttagcagaagggggtaaatcgtctggcttaaatagtactttttccccaaggaagcatgatggttgatgactagaaaacaggcatttgagcatttacactacctgatagagttttcatgcaatttcagaaagcagtgacaagttagtcccattgtatgtctattgaactttggaatatatgaactacaatttgattttgtcaatttcattgttgttatcctatatgcaaacactgacatgctgcactactaaaactattttgtatgtatgtgatgcacatgggttatcatatgcacttttatcatttgtcattcataaggtcttttatttacccattatgatgcttttcagtgatagtaatctggatcatgataattttcttaaatctttaatggacgaacatggctgggttccaatttccaaagttgcagacttcaatcgggtatgtttttctcagtacttaaacttttgctatttcacctttatattatgccatataactactctgctagtttggcttgtttagttgttttgcagcttaagaaaattatcaaggatatacatctaacaactctgttattgcttggttcatttgcagcttaagaaaatgaccacggatatacaactgattgtagaagcattggcaaactcaagtcttttagaagttcaggtacgtttaatgcaactattgttgcttagatccctcttagaatgtcatctctcttatttatcttatgccttttgtataccaccaggatggtaatatgaggcggcgttctgactggtcaaagtgggtttccttgtctgggacatctcttccgagtccatcttcaaccagtatggataacactactggtgaatgtaataaggatgcttattctgaagatgaaaagaagcctcatcctcgcagcgtagattgtgttggtatgggggcttctgatgagccatcacatgatacactcagtagttcagtcacttcactgaataagggcttatcaaacattagtattgataataagcctaagagcatttctgcatgctctctgaactcacaaaaacatgaagctgcttttaggactggtgatgttaaagttcagaaagtaaccacaaagatcaaagtgcctgattctcagagggaaagaggtttctgtaatgatttcataagtgactctcctagcttcagcggcgatcaaagcacattcttgcttgatgagaaattagaattggagcatgcagagctttcacatgatctctattcgcacaaaaggtgaattttaactagtttatatatgatctgttacttcatttcatgagctataatggtgttgttttattagtttgttattcatttggtagtttatagtgttgttattgtgatttgagattgttgngctntgtacaagtganatgtcattannggggttaagccg

SEQ ID NO: 9985 - DNA, 8419 bp, Oryza sativa
  unsure (1)..(8419): unsure at all n locations
atgggcnattgaatgcanatcggcatgacagnagctcatcataattacataacaaataaatagttgattgctaagtgaaattttatgctttatagggacatgccctttttatttcatgatttttgacttgattgagatacatttccatgtactgtgatataccattattttaacattatttgctttataatgacttgaattttctcatctataaatattatatgttaattagcaccttagcatccatcaagcaaattttgcagcacgctatcttgtatgctttcaccatgttaagcaagtcttgtcttggtaatagtgcaataaactcttgtcaactatctgcgttacaggacggacctcaagcattttcaaaagaggaaatatcaagaatcaatgaggggttatattactatgaggtaatattttagagcataaaaagaacaagattatcagtaattggggttgtatgtgcattttaggggccaatataatgttgacacagtgctgtgttgtttgggaactgccattcactccaacgcttgtatttattattttattttaacaattacatgctcaattttatgcaagtaaataagctttattttgggcatgcaattcaacccagtaggccagtatcctgttttatcatgaagtatccataaaattaagtaaaattcctgctcaatttaatacaattgtccaggctctaattcaggttttctgttttttagattatcatcccttttctttctcaagaattgcctgcatttgatacttgatacatattatagctttgagttatatgttagaaattagaaatgtcccagtagcatgaatctttccatgtatagtgctggatttttttttttggtatggctaatcaattctttgaatttttgaatcatttgtactaaactgagtgttgggaaaaaggtacgagacaagggttatcttggagctaaatcgaatttaagtcaagccaggttgatccaaacctgagctgttcttgcctttctttatcccaaagccctttctggatttatgcttgcctataaaattacattattctcatgctaatacatgatatttattcttggtttagaatcacgcttataatcaaagaagttcccaagctggcaccatagatattgattctaaaccagctggtggttcaaaggggaatcccattaatattgtaaacaatggtattgaagattctggacagcctatcccacgaaggaggcacaacacaggcaatagaaaagcacagtcctctcataagcagaggttctttcctggtaactttgcgaataacaccaataatagatctcactatggcggtgtatcagagagccccccaagcaattcaattggatatttctacggatctactccagaaaaccacaggttaggttaataaattaattgaggttttatttctgtaaaacaaatacttatctctatgctttgtggctggtcatattgtcatatacctgcaccattcttagcaagagatttgaaaactgagtacatgatttgcgcatgacatttaagtttcaagtttatacacttgcatggacaaatccatctctgccaacctgttttttttattgaaggtggacagacacccactgttatcatgagtgcctttttcattgaagcaaagctattgaagttatcttaactaagtgttgctgtttagctatagaagttcaaggttgagctcatctcctcatggaatccctactggtagctcgcctgttggttctgtgcccaaatctttcccaccatttcaacacccaagtcatcagcttttagagaaaaataaattccagcagcaaaggtaagctggcagtatagatctcaattgagttccagttctttctagtactcatttcttggcaagggtattactaccctttattcggtggttcatagtaaattgatccgttttaatgttttcttgtgcaggtaaaggtacaataagttcaaaaatcgatgcatcgctgaacgcaaaaagttagggatgggttgcagtgaggtgcaacttcttcgcacatctctctttatatggcaacgttctaactagatatacataaatctgaccaagctcatttattactctctttgaatcattttcttcatatgtgaaatcatttggtgttactattgttttggcaattattactgattataggcggcatgaatacttgttctgtttattgattatatacggatgcttttctatcttccaatgtaatgcaggaaatgaattcgttatatcgtttttggtcgtattatctaagagataattttaatgatgatatgtacaaacattttaagaagtttgcactttttttttcggcagcaaattacagatatgcacttgaatgtctctccagattttataggtacggtacataaaaattttatagtaatattcccatttttttccttgcattacataatatatgagcaatgttcactggctggttgtatttacagctatggtctggagaaaaacttgcaacgcaatgtgtatgaagatttcgagcagctgacactcgaattccatcacaagggtgatctttatggactcgaaaaatactggcaattcgcatttctctgttacttcctgtcccctagcaatctaattatgcggctactgtccttggggaaatatttagcacagagctatttacacctgagcaaacaccaaacagtatgcaactcaatggtgcatttccaatatcaaatattcacaaccttatgctgtggagtattggcatgataaagttgtacatgctcagtcccagcacaaagatcatcaacaagaaataccatctggtgtcactaatacgttacctcccttctcccacatgtgaacctcacactagatcgtattttccaatttatatttttttgtggtggcactgaaccaaatcttcttttgattataacacacgctattgttacatgaaagctggttcagacctggatagcctgggtacgccctgaaaagggtaactgaaaatgaatcttaaaattatgctggactagtggaattggccaacctagcagttgtaagatttttgagtttgcgatactttgttgctgacagatctgctttttgctaattgaaccagggctttccaccatttccgaaatcaagatagcagccccattatcaagcatccagaattggagaggctcctaaaggaggagttccgaaccatcgaggatttcaaggcacggaaggcagcagagaaagaaactggcagcagtactgctgccgccgcaggccataacaaggctgatgcgaagtaggtcctagcatggcatgaaattttggtggtcatcccacaaaaaggagaaagtagcaaaaccgtttttgtttggtgaaaaacttaaggatttgagtagacacctgtgcagattttgttctcccctgccgacgatacttgtgtggccttgtccaggaaattttcctctcgnannnnnnnnnantacnnnnnnnncgcnnngccctgtgggatttgtacataaagataataattacttgttgattaaatggacaaataatagagcctggagttaaaatgacacggcattgtcgtcttgccgttgcttttggaaggtttatcttaggaagtttcttcacctgtggtccggaggctggaaaccaagtcacggtcatattgcctttgtgagcttctctccatggaccatggtccttttcgaagtctctttcacttctctggtggcaatgcctttatttttgtcgtcggccgcacgttatatgtcagcacaaagtgccatattctcgttactggagatccggcgtactggcacgacgaggttttctcggtttgtgatgccttttgctgttgcagtaagggcctgttcggagaagtttccagctgcagcttctcccaaaatctctagctcacccaagcaatctagattgtcatccagattttaagaatctgtagttgtagaatccagaaaataaactagaactctagaactcagaagcttaaaaacccagctcatacagattctcagaaattggtcaccaactagaaaattcttaaaatcttaaactcccctaaatagggcctaaatcgtttcttaataagtactagtgccatgtgtctggggttggaaatggtaaaggaaattttcgattgacggagcacagtttccgtataaggggtattgttactcttttgttcccaaataaacactatgtttatttatggatagaggaaatatttcaaattcattaaaaaaaatcaacttctaagaacgagataaatgactattcagatttattctcgtaagttggttttcaggaatggaggatatgtacaagtttttcgattttttgtttgcaaaccgacataatggacgttggacccaaagccagcacggacgataggagaaaatacagtggccagggctgaggctctgcgtcatatggatccgagcctaagtggagtagatgctctcgtagttcgaatgagtacccaatgccagtgtcaaaggaccacctgttatagatgttagtccaaataatcttttcaatattgttagccatatatcgactcaatcataccaaattacgataaacaaaataatactacgagtttacgtatagcttatatctccagactctaattattaaaacacctcaaccaacatggcacataggctactacaggtttaataggctaacatgtcatatcttccatctatagtgactggctacagttgccactatgcattgttacacacgaagatattcacctctgtatttaaaaggaatacactagaggattagtagtctgatgctactttaactgtatatcgctattaaaacttcaaggttaattttactttagtatagtatagtcagcgccatattttcacttctctcttagaagtcatttgatattggcattcttgtttccaaaggccggtgttctatttaggttgtggtggtcttggagtgaaaatatttttgtcacatgtgattcattgtacatttagttaagaaattttgtattgcaactttttttcgcttgctgtttttcactctccacctttactagtaagacgtttggtcgctctctaaaacgtgtctaataattcgtcgatgattaactttagagattggtcctacccaatccccaaacggaactaactactactgtagttccggaattatttgatgatagaagacatctgaccctagatttaattagaacagtaactaagttggcgtgtacctaaaacctctgcataattgtgctacgagtcattcctaaatggacagaatgaacagctcacacatggacggtgacgagtgacgacaagccccagctagatccgataattttccagctcacttgggagttcaaatgttaaaaatctctgtaaagccgttattgcgtaattaatcgaaatgtgaccttagcaagttggcaaattgtgaaaaacgcctactaaaccaccaatatttattacttctaaaacgagccaatatttttgtaataagacgtagccggatacagactgacgtggatattgattgattttcatcattaaaagtacagtgtattcttaaaaacgattattcatgttttttaatattgaaataataatttctggcctctattcatgatgttgtacataatcgtaaaccgttgttcatgtaaatcgcataaacggtgatgtgggtattttaagataaatgggaatgtgcttaatatacttttggacaaaggaagtatctgtgtgtatctacacaaacatttactccccgatttttgtcgtccaaaacagttcttgggctgtgttaggactttggagtactggttgataactcattcccctcacaggaaaaacaagattaattaagtattagcttaaaaaaatagattagtaagattttcaaagtaaactttttatatattatttttaaaaaatgcatcgtttatatgtggtgaatggttgaaatcaatttaaactagctctctataatagtcaatactatagattaaatgtatttaggacgtgtaattactctcagttagagttaactaaatagagtattaccatatatctaacgctacaatagtgttgttagtgatgggagtgaggatgttagcatgttgcctcccaccaactaataatgcttttaaagagagaacaatcccacctactcaggttgattatatggtggacacatcccttattaagatcaactccaaggctcataatgctagaaaaagatatgaacgtacatgtataattgtgtcgcccaagcagacattataagcaacagaaaattaaaaagaaaacatacctactctaaaaactttagggagcatttgtttgcacaaagacaatattaatagctgtaatatttaaagtactatatttaattaaacaaatttggtcttgtagatgttgaattttttttataaacttgatgaaaactaaagaaatttgataagaaaaatcaaaacgacttagagcagatacaatagcaggctattagccagctgtaaacatattttactaagataaaagatgagagagaaaagcagcagactacagatctatagccagctgtagcacggactccaagatgtaatgtgtgtatgacgtatgtgaccatatattaatagtatagtaagcaactattgtatgaattggctattagattggctatagatgaattgaagctagtagtaggctatactattaaacttgctcttataatatgaaacatttggagtaggtacgaggcaagaccactcctaagctaagggcctgtttgaggagctttcagcagctgcagcttctcttagaatctttagttaccagacgctccctaaaactgtccagctttttacccagattctgagaatctatagctatagaatctggaaaatgaactagaagccagaagctgggtttcccagtttctccagattctcacaaactagcttctcagcagctgcttcttagaatctcaaactcatccaaacaggccctaagagcaattgaaaccccacccaagcaatcatcacaaatcaattttttagcttttcaatataagtctagaagtaagtgattttcacatgtaaatccgtccccttgacgaaattgaagtacactccttgtcgtttatcgtgtaaaccatccatgcatctccacgaaaacgagaatgactatcaattgcttgaatcggatagtttcttgcggatcttgtgcaagttcggaattccatttcaaaggccggaacttccgattcggcatgtttcaccggaaggcttggctgcggtgtgctcccgtgttttcgtgcaaacacctaactagaaatccgtatgattgtaatatacatgagaattaactaggattatcacacaattttccatgtacctaaacgttcctaaccatcaaacagctctaggtatcgcatgatacttgagtatcagccgatacctactaggtatcagtcgagacctcagagatattattccgttcgaatggggtatcagccgatatctactagatatcagacaatacatgtaaggtatcataccatccgaactagatactgttctcatttgccattttagtaatatgccacttcaggcttagaacggttagaagttgctgaggcccatgaaatttactcgaaaaggaagcaaaatctgatataaattcggtgaggccaccgccggccaccgcgtccctttcatcgcgtggctttcccacacatcgctgtgtctctggacgccatgacaaaacaaaccaaccccttcaaaataaaaataaaaataaaaataataaaaaaaaacaccacccttatctaaattattattattattatcattttctcccgctcccgctcgctcgcgccattttccagcccaaagccaagcgcctcggctcgctctcgccgtctcgccgcgcgccgggcgctcgccatggagatcggtggcgtgctcgtgtcgctgctcttcgccgcctttttcctcccctgcctcctcctcctccttgttctcgacgagggcgggctacgacttgtctcccttgggctccgcgggggccgatacgcctggaccacccgatccgactttcttgggtacccgataggccgccgacgccgcgccgtcgttttcgggggtgccggcggggcggacggcgaggaagaggcgcaaccgacggcggagtgctgcgaacgccttgccgtggcgaagtaccggcgcgggcgcgacgcggctaccgaggactgcgtgttctgccttgtccgggtggaccaccgcaaggaaggtcccaaagctacggtgccgtcacatattacaccgagcctgtcttgaagcctggctcggtctcccgcgcg

SEQ ID NO: 9986 - DNA, 1685 bp, Oryza sativa
  unsure (1)..(1685): unsure at all n locations
gtggcccattggnagtgatctttctcatgggcagnagntcatnnagaataatcgccattgctgtcgctgccggctgccgtcatgcgagaagccgaggagcatagtgttctctctgtttttcttcttctttttttttggtttctttttgcatagttttttttagtaattagttgctaattaatttgggactgattgcttgattaatctaatgtaatctaagatgatctggctaggtggcccatgtaaagtaatgtaataatctccaattctccattgttgctgccacacgagagaagccgagaaacacacagggatcttttggctagctttacgaggtgataggctagacgatttgaatttgaagcctcgttctttctagctatttgatactaaatctttatctaatattcacgtcttttttagcatagtattctctctgttttttcatattttaggggttttttagtagttaattgctaattaattttgggacggattgcctgattagtgcaaaagacgatcaggcttaggtggcggttgctggctgctgtcctgtcctgtcttgctctctctcccggtaaatatcagcgactgataacgatgcctcacctgctactatttctcggatcgtccgtacatctttcatctactacacgagtacatggccatatgcattcatcacgagaaaacgctgcataatgcaaaccacaccccgtcccactaatgcttcatttctgggcatatacaaatactacctctatcctaaaatataaaatattttatccacgtagaagtagtgcttcattcctgcaatcctactgatgtatatatatagcgagaaatgaagtgttatgccaattcagaaaacacaaaaaggaaacagtaatatattatttgtgagcaatttaattaaaaatatgcattagataccacctaataataggaataagtttgctgggatcgtgaaagaggaagtaattcgttggatcggttctcctgatccatcctccattatcaaaggatcagcggagtcccaatccatggtggaattccccgctccatggtggataatatcacagcaaatcgatggattgacctaacctagtgtgcaaagcacgtagactaatgcaattagggtaggtggcggtgtcaccgagcgagccagccagccagccggagttgacaacaccggtccatcgcgatcacgattatgcagcccccctacagtagtaatttctccatcacagtaaaaaacaatctagaagtacctgaagtagatttgacactatttgacactatttagtactccatccgtttcataatacaagtgatcttaagtttttacttatactacttcctccgttttttaatagatgaagccatggactttgtatatcatttcagagcatgtgcatgactaaagaaaaaccgtgaatacagaatacaaatttggattttgaagccaccttggataaaaaattacgttacttctgaaatgagtcatgaaaaccaaaccggcaaaactgggggtgaaacaagcaagatccaacagggggagtggcaagctgtttctaccgggacgagtaaagtttgcttgtgtataaaggattaaaaagcccgttgcaagaaaactattaaaacacgaacttagggacagggtcaatatgtaaggcatgatgaacgcg

SEQ ID NO: 9987 - DNA, 7811 bp, Oryza sativa
  unsure (1)..(7811): unsure at all n locations
tgcgatcnnatgacctacagcttgtacaatagctcatcattataattacgtaaattttttgaataagacgaatggtcaaacatgtgagaaaaaatcaacggcgtcatctattaaaaaacggaggtagtatttaacaactcatcttattcaaaaaaattatgtaaatataaaaaacaaaaagttatgcttaaagtactttggataataaattaagtcacacataaaataaataataatttcaaaactttttaaataatgcaagtaaaaaagtcaaatagaacggagggagtaaaacagatttgaacagaacagttcagatttgttttgtaatagatgatgtcaaatccatttctaaattatttatttttttcctaactaagggtctgttcactttgataccactttcaaccttatcaaattttggtaaagttaacaaaaaaaaaatggttacatttagtttgctgccaaattttggtaactatataagaaatcctaccaaaattttggcaagttaccaaaattttgacaactataccaaaatttgataatgctaaaatttagtaaggttttttttttattaaagtgaacaggcactaagagagtactccaaatagtagtacagtgagtgactgtgaaggccagccagccataagcctaagctaacctaatcctgcgtcgcgtagcaagttgacaaggccaacttgcccagcaaccagcaggtggcgcggccgtagcatgccgcacgtacgcgcccaccgtatttncgtccaaacgggggagctatccgtgaccgtgcgcccctatccgaagttgttaagatcattagcagttcgaaagaacgtgctaatgatcttaagtcagaaatcagaacagaacgaagccctaacatagtatgatccggaccggcattctaacaacctctggggcgtgatatatgctcccagggttcacaattccgacgaaaaccgatcgaattcctcgaaatttcgacgtttcgatacggctcaaaattaggttttaattggaatttcgaaggctaaacagtatatttggtcgaaattcagtcggaatttatcaaaaactgattgaaaatcatcgaaaatcgcgatatcaatgagacttaaaatttactggtcaaccggtaatgtgatcctccttcccgcttgcaggtgcagctcgatcgcgcgcgcacccggcaccgaagcgcagagagatcaggtgccgcggcgaccggcccggccacgacgaccaaaacatatcagcattcaacacgatcccgcgagggcgcatgctaaacaaccttatctttttctttttcttatgtttatagttatcaaccaaaatttaaaattttaaatcgttaagaacacgtgtgtgtatatatatataagaaatttataaattattttttatttgtatcctaataagcaaaaagatagccgttccccaactgccgtggcagtacagcctacaggtggtgtacctgcatatggccggcaggcgacatatccatcgccgtttggtactgtggcgtactgagttgtacgtactactactgtgtagcagccagatcttttttttcttcctaaaaaagagggacgtaacgtaacaaccgattgataaaaaactactaacctcttctgtcgcacatatattttcgaataaaccaaaacggcttattaaacaataaaagttaatttataagtacaacttctatatatttgttcgtagcgacttaaaagctaacactaaaagtaaattacatttaaaatatttaaaaatcattcaaaaagttaaattttagctttttctttggtttattagaccaaccaataaggctctatgtctgatctgatgagggaaaacaaagagcaagtttaataataaatgagctataagattatctcttttttttctcctcctctttctatctcttacctatgtatttaatgtatttatcttgaaatatatgaatagctagctattgatgagagccaaccctctttattttttaaattctcttttctccacagttggtttatagcctctaaggacgggcaattcagtttgtataccgcgtgaagccgtgaaagttgaaacagagccggtgagttccatcgtcggacggtcgccgagaagaggttacgcaaaatatgcaacgatagatcatacgttccctatcaaaatcgcgggtgttttgcttgggaaggcgtacgccgtctccgtcgacgatttaatttgtcccgtccccgcttggattcaatgttcgttgccactgatcaagaaccaataatatggtttaggcatttgcttgctcgctaaattgccctgcctcggacatcttaattcacatcgatcgaagacgacgacgaagaaggggatcagtcctgcatgtgactcactctgatttaacggtgacgccacgctgccttgtgtctagcttccctctcaatatactactactcctattcgtcgtataaagagttactcactccgtcaaaaaaaaatcaacctagaaagagatacgatctctcctagtatgataaatataaacatataatttgtccagatttattgtattaggagggatcacattgcctcctaagttgagtttttttagacgcagagagtagttttttttagaaaatctcagataaattagtatcacattgaaaaagatgtcaccgtcttccattaaaggcttctttgggacacatgaatagaaaaaacagcatagaaatgggatgccatatgtaagcaaatcccatgaaatccaaaacacaggaatgtgcaagacaatgtgtttagatagctcatagtaaaaacttggggatttgcatggattttagagacagaagagagagaaatagaggaagcattggacttctcaaagcaatgttaaaatgaggtaggagagctcatgtgcaaaattcctaggaattggagtataggattacaattcaaaggaattttcctatgcttcaaacaagctagatagaaaattttccttaagatttaaatcctttgaaattcaaatccttgaaattcctatagaaatactccatttcaaaggagccataaaccccatagttcgtagtagtgactattggttgtcctgaccatgattttcttttcaatgaattcctaagcatggtttaattactctgcagatactttttaatatttattcacttcttactaaaatatagcaaccaagtgctcgaatagacaccacctaatactaatatttagtagtacgagtatagacaggtccctttatttagaatcgttgagctatgtggtatctactatgttgctactctcttcgtccctaaattaagtactaattaagtatattttgggatatggagggaataactttttatgggagagattttatatgctaaattatagtataattttaatacagacccttgcaattgattttgcagtatatttcgcacaagctagtctgttatccaagtatggacttcacaaacaatgagaccctgtttaaaagggactaaaactagttttaagtctctatcacatcagatgtttggacactaattataaatattaaacgtagactattaataaaacccatccataatcttggactaattcgtgagacgaatctattgagcctattaatccatgattagactatgtgatgctacagtaaacattatttaattatggattaattaggcttaaaaatatgtctcgcaaattagctttcatttatgtaattagttttgtaagtagtctatatttaatactctaaattagtgtctaaatatagagactaaagttaaatctctggatccaaacaccacctgattcggttgtcggttgcaaaaacaaagagaagaaaaaaacatttcccttcaatccccgtgcatttaatttccctcgtactaccaaggaaaaaaccgaaaaatacgttcccactcccacgcacatatggcctgcacgaatcgtcatcactctcttcatttcacgaaagcaactttaatttgctaaaggaaatcagacaggttcggaaagacaaacgagtttccatttttaaaaagacaatatactctctccgtttcaaaatatttgacaccgttgacttttttagtatgtgtttgaccattcgtcttatttaaaaaatttaaataattatttattcttttcatatcatttaatttattgttaaatatactttcatatacacatatagttttacatacttcataaattttttgaataagacgaatgatcaaacatgtgctaaaaaatcaacggtgtcaaacattttgaaacggaaggagtattttcctaaaacatcactttacgtcgccttattcttatatcagtgacactcaacctatccgtaaggctagaaatgaacatcatgtggacaacgtatcatattaaatctttagttttcctaagccactaccaacagtaacttgctccaccataggccagtattttgctacagagcaacagttccttccggctgcgttgccgtgtgatgctctgtcgtggctgtgatctgtccgtccgcttgccaacccgatatgcttgccctccacacagcacacacccatcaatccccaattcatgaaaataaattcctaatccatctggttgccctctccaccacacacccatcgatgcccaattgatgaagataaatccctaatccatcggagaaatagacggcatcccctctggcccatcgatcaccagttcgccggcggctgacttttcttttcccgacctgcgttttttcccacccaccggctgtgattgtaggggttgcccccgggtgggtggcgctgggtataggtcgcgtccaactatctctatcggtcaggctgccggcgcgctgggcgcacccatcaaggctcccgattgttgccctggtcgagcgactgccatcagccagcctgtttgctctgaacagctgcttccatcctcggttttcttcagtaagtcttttttctctatactgctctttgttgctgttggatgccaatcttgctttctttcagtttgagtcaccgagacaatgcccaggctgatcaatctttgctgttgttaacagtccaaaacatgaatctatttccctatgcttccttgcgatagttaggctgagtgaatactaccaaggttgcgattttttcagattaaacactatatgacaaaatgctaatgaacgaaagatagatatgcgcttttccttgatatgttctcattttgcctgtcagtttattaaatatttgtaggccgtcaacttgcagcttggcatttggattattgcagtgctaattttgctatttattttggcttgccatattgggtcgatttagaatatatgtacgcttcagcatggcatttggtcttggtggtttgattttgaactctctgttactgcctatcaattccctatgtgcatatctttttttttaaccttctttccggtttggtgctttctttcataaacaaaatgcattatagcctcttcattacaatttgcaagtacactcacatttaaagaactccatatcaattggtcaaaaagattaattatgactagatgtgtagtgcattttatctgctttcttttatggctcttcccatatagtttaattagtattacctgatatagcaaactggccagtacctaatgtgccactttatggatgcataaatttctctttatatgtatactacttgattgctacacatataatgatgttttggctgctataaaaaatatattactttcattattatagttccagtaaaccactaattactttcataaatcagtttgaatgatgtcagtctcttctgggccatcaacacctaaaccagcttgcaagcgcaggcaacccgagagagcttttataccttcaggttagctccaagccatataaatgcttatttctacatttgaaaccattttcctattgagctctcctatttgtcaacagatgattctgttgtgccatatctatttcctagggaatattcctagcgatggcgttgttctgctggctgatgacgccctctcccatgtttgtgatttccctacaagttttcatttgccatcaaggcgctctatacgtcgaagactacttactcagtctgctggtataatatttgttgttttgatttttttttccgttctaattgtctaccctgttgttttccaaatgtatggcatttctttccatttattatgcataatcatcactaccaattcaacctaccgcagtccacatttacatatcaatttcccatgttattatcctaattcttttttgaccaaaaattgttgctcatattctaaatcaggatttccccacccggatcctgtaacagctgctcaatcacgtcgaaagcgtaagcttgctatggctgccaaatcatctagaggtttgattatattctttatccactcacatgtttatctacatgtgcactttcatgccttatacaaaagttttttttccctaacacatgttgttttctctagaaattaatagtaccactgaaatgatagagcatcggacgcatatccatgtgctacaacggaatgttcgacaacgaaccggtctgtctcagtcatccaccttggttcctatcaattgtggccatacacaaccttttgcaactgtcgatggaggtctgtcctattcctatttccacttattttactgtgtttctctcctaattcttcaacaaatgtaaccaatgatagcatgttcatcgtcgacctcttcagccctattgtctccatctcccacacatcaacgtaagtttagtcatatattagttctctacaactatcatttcatttcaccctttacaaatcatgacaactacaatgctaataatgtacagaccatttgctcatcaattctcgcggttttgctgatgtaaacctgatgctcgacatgtcaaatcagatcactcatacagtatgatgctcgacttgctgttcgactcactaatgtaattctgatgctcgacctgatgtatgtcaatcaatagcacgaaaaaaaattcccaccttttacacacacttatgtcattttcttttaattactaggcactattttctctccatcaaggcttgggcccccatgtcacacttgtccatattgtggggctttcttttggtttgaggagcgtgtccgtcgagaacagcacagctcattaccaatatacaatacatgttgtaaaggtgggagtgtcatcttaccttcatataggccacccccagaacctttgcatagtctactcacaggagttaacagatcattgtcaggccatttttttagaacattaggttctacaattcgatgtttgccttcacatcgatgggtgtcaatgtcattgattctatcaatgatggacgaggcccatatgttttcaagattagtggccagctctgccatcgcattgggtcactcataccataagaaggaagacgaccagagtatgctcacttatatatctttgacacagaaaatgagatcaggaataggataaatgttggaacctatgcaaataggagttttcgtcctaatgaggatattgtggctggacttatagacatgttcaacacccacaatcctattgttcaccttttaatgacagctcgtgatagattggctgaaaatggtgatgattgatacatcataagattatttggtgatcccgacaagcatggtgatatatttagtgcttcagttgcattcgaggttgcagggttaggtgttggtgacctaggatgacatatggtg

SEQ ID NO: 9988 - DNA, 2932 bp, Oryza sativa
  unsure (1)..(2932): unsure at all n locations
catgggcctttgnnagtgacntttcactgctacagnagctcatcagggaccattgaggcattacagaagcatcagatgccgggcagcaagttatattgccttcttcttatattggggggggggcaagatatttatatcaaaattacttagattcaggtgctctatgtagaaaatatggttgccctgatttgtttatcactttcacatcaaattccttatggtcagaggtaacacaagctttggctatcatccctgggcaacactcagcagataggcctgatattattaatcgtgtattccatgttaagctgcatctcttcatggacgacatcgtaaagaagaaattttttggccctgtcactgcaggtagtaatttaattgttcatgaatcatgacacaacatactgcacacttcatatattcaaatattttgtatgtgtcattctcacataatttttccttttatgtagttgtgtacacaattgaatttcagaagcgtggacttccacatgttcacatcatattgtggttagataagagtggtccattgacacctgctgatattgacagactaatatcggcccagcttccagatccatccattgatcgagttggttatgatgctggtgcggcattcatgatgcatggaccttgtggtgatgcaaatccgcattgttcatgcatggttgacggtaaatgctcaaagaattacccgaaggaatattatgagaaaacaacaatcctgccaaatggccatgtaaggtatgctcggccaaaaaatgatataattgttgcgaaaaatggaatttctcttgataattggcatgttgtcccccacaacgtcgatttattagtcaaatatgaggcgcatatcaacgtggaaagagttaatcgtgatggaatggaaaagtatctattcaaatatgttgctaagggttttgattgttcgagggttggtctcaagcgcaagcgggcatgtgctggaactaatgagattcatgactatttagaatgtagatgtatagcgccgaatgaggcggcatggcgtttgctttagtttgagattcattatactgatcctgctattgagcgtctccatgtacatatgccattagagaataatgttacattcacagaggatgataatctggaacagatcttggataacccacgcaatcgtgttacgaaacttacagcatggtttgctgcaaatagagaatactctcaggctgctccatatacatatgcagagttcccagaatactttacctggcatggtaatggcaaatattgggctccacggaaaaattgccgcaagaaaattgaaaggatagcacatgtttgtcctgcccaaggagatgtctactaccttagaatgttgctgcacattgtcaaaggagcaaaatcctattctgatctccggaccattgaaggacatgtatatcctacattccaatctgcatgtcaagccctaggccttcttggtgatgaccgtgaatggtccttcgcaatgactgatgcgactcattgggcacttccctaccaactccgtgagttatttgtaacattgcttcttttctgtgatgttacaaacccactgagtttatttgaagagcatctgtcttcaatgggtcaagatgcagcctaccaccttaaccatgccacactaggtataaattcttctgcaccttcagtcatacaatatgtcaagtcctatgttcgttccgagatcgatagcatacttagaaatgttggtcgtactttggcacatttccatttacctgagcctactattcaaagcacatccatccttggcaataggttgctaatagatgaacaagcatatgatctagagaagatatcgattgaagcggctgatcagttaggcaagttaaatctgaaccagagacatatatatgatgctattctcaattctttaaatagtgacattgggcataccttctttatctatggctatggagggacagggaaaacattccctttggaataccctactaaatagtgtaagggctgaagggaaaattgctttggcagttgcttcttccggtatagcatcacatatacttcctggtggccgcacgcctcattctcgctttagaataccattggacatacaagagcatccagtttgttctattaagaagaacactcacttggctcaattatttcaccaaacctcctaagtcatatgggatgaggcacctgttaatcacaaacattgctttgaagctcttgaccgaacattgagagatattcttgcatccaatgatccatcacttgctaacaaacagtttggaggcattacagatgttcttggaggagattttaggcaaactctcccggttctaccctatgaaaaaaacaggaaatcttatcttcatccatcacacgttctcatttgtggcagcactgcattctcatgcatcttacggaaaatatgaggcttcaatccccaacattgtctaatactcatcgtcaacgccttcaagaatttgcagaatggttgttagcaataggggagggagcagtagcagattcttcacctactgatcgagaggatgtttcttgggtaaaaataccagagtatttgcttttgccagatgacacaagaaacctttcaggccttatctcttttgtatatgatgcctcaatcaattctcacacagccaattatctctgtgagcgagcaattctagccccaacaaatgaaatcgctgcaagtataaattcccaaatgattgctcagctgactactgaagaaatgtcatactatagttcagacacaattgaagatactacaagtaatcgtgccactcttgatgctctttacccaactgagttcctgaacactataaaaatcagcggtttgccagaccatcaccttcaactaaaaataggagtgcttgttatg

SEQ ID NO: 9989 - DNA, 2228 bp, Oryza sativa
  unsure (1)..(2228): unsure at all n locations
tgcgacatttgannnngttgattctcctcctactgcaagtagctcatcactgccgaaagtgcactaacctctaagcctggcctcacgacaagaacagttcttccatgtttgtccttgtagtcaggcctatatatctttcctgtctctgcttcatgtgcaacatcatcctgaaggttgaaaggacaataagattacattatgttgtaaacctgaaaatgcagttacttcctaagtatcaagaatgttctgctttagcatcacaatgctttctccccaatgattcatagaatgctatcctcctattagcacaatcctgtctaaattgacactaacagcagttattcctcctgtctactccctcttttcacaaaatataagaattccaagcgtaatttgtccataaatataaggattcctatagtgccacttgaccacctctcattgaaattacttcccaccttactcccaactactcttccaccccccccccccaaccatcccccatttagtgaggggcaccaaagtcttttagtcttaaccttaatcccttctaaacaacctagaaattacctatggctctcagcatcaccaatgtttcagttataatgctatttctattacagcccataaagaaatgcatattcaattgatgattaacacaagcatacccagttaatcttttgtggcatatatgacacccgccactttacagctgacttcatcattttacttgctttctgcacgttccagtttcttgctcgaagaaatctcaggcacgaggcatttgaaaggaaatcttgtatttcttctgatgagtgttcaccaagctccttacgcaagtcatttatctgttcatcagtagatagcacaacaacaaagtaaatggttcaaagcgagagtaactaaattaaattacgaagagatatacactcaagggatttttttcaataccttctcctgctgctcttatagggtcaagtttttctctgttgtagcaccattgcttgacttgaatagaaaggacattttagtacctcgacagagaagggtccactatatacggaactgtaaagcaataaatatcatcagacatctgaagagtactaaatatgcacgaactactttctgttcagcttccttgtatgaaggcaaccatctgaactaaacaacagaataacagcttatgaggcaggtgcgagaaaaaaacttgccgttaacaaaaattcagtttcatacaaaagataacagaaagtaacaacaaatgctactttaaactgatatcagtacatggttagctagctgctaccgcatgtaattcatacgtggctggaagagcagtatcctaaatgagaagcatttcacagaattcagaaggccgtgcttctgaaaaaccagccgattcagttccacagaagacaaaattgcgacccgaaactgatttcttaagttaaattgaccatccaagatgtcactaagttaaagtagcatcaccatataccgtatgagccagatccggcaacgctaagtttcttgcagattttacaagacaagtagccgagtcaagatcacgtcaacgcaaacaatcccggtggcaattgctactactacatcttcaatcctagtagcacgacacaacacagaacgaacacccgcaattcgagcacgaacagtcacagatcgccgccgtatacctaatgctcctcacatcaaagattaggtagtagagaaatccgatctttggccgagtagaagaaaaccaacctggatcgatgcacccccagcccccaacaaccggggaggctcgcggatcaaggcccgccgcctgggcacgacagcgagggctggggtggggaggtggcgccggccgaggtgggagagtggtggtggtgggggatcccgcatcatacttaaccacccccaccccgaccccgcgcttgacccggcatctttggccggtcatacacgcggggggtctttgcctttggcacccggagcgcgtcccgtgttccacgcccgtacccgtaccaccgtccaccaccaccacgccacgggaggcgcaccgtaccgtaccggaccaccatcctttctaggaaaaacccacccactcttacactcagtttcacactgtgttttcctttttgccttttttctttacccccaaccctaccacatcctttttttaatttgtgcgggggcctcttctcacccatgccttggtcgtgttgcct

SEQ ID NO: 9990 - DNA, 6036 bp, Oryza sativa
  unsure (1)..(6036): unsure at all n locations
gtgggcatttgattacagatcggtggtacacnagcccatcagcataaagcatagtctcataggtgtcacataagctaaaatagtgaggtggaggagagaagagatgaactggagatatgcagccacctctcagagcatccgcaatggttatctataggctctctacaagatatccaagtcagcatattttcctatttgaaagagattaaatgaagagagagagtaaaactatctactaacctggagatagtctatagaaaaaaacgatgcaatagattagagagatatagatacccatatagacatactattaaggtgatttactattaatctagtctattgctgagatgtacatgttttatagaaagcaccttactttactattgcggtggatctcatgcaagatgcaaccaccacacaaaattcaagacaaaaggagagagaggaagagtagattaggcaaacaaacattggggctagtgtattagaattagtatagatgtgatatattgtacatattacctctacatttattagttgatgatgtggtcaagattagatgcaacatccacctcttttataaaacttgcctttatgctccgttcggtagtacaagttcccagctcctcctcctcgttttccgcgcgcacgcttttttcaaattgctaaacggtgcgtttttttgcaaaaagtttctatacgaaagttgcttaaaaaatcatattaatccatttttttaaaaaaatagctaaaacttaattaattacgcattaaaacgctgattcgttttgtgtgccggggagtgggctcaggcacagaagactataagctaactttaaacatatatcgataatataaaagaggagggagaagagtaggctacaaatttattcagctgaagcacgaactcgaatacaagtatttgtatgacaggtggaaccatataagtatatgtttatagataactattgtatgaattgactattaagttggttataagtgatttggagctagtagttggctatactattaaacttgctcttacatgggtaattattaaagatttatcactgaactacgagtaataaatctttaattgttatatttaaaagtggcaaataaaagagtgctcgcacaagatttttttttctaaaactagttttacatgcaatacgttatacgtgatcgtgagatttttttttctttcacttttcttgagagtttttttaagataggtttttaaggaaggaaggagaacaactaagctggtggttttttaagttccttttcttaaaaaatataaagaaatatagcggttttttaagaaacactacgcttttaaactacttcagttgcctttgtttttataattttgtagaaatacattatgttttaaaaatatacccgtgtcaccgaccaacgggagattaaaacatcgattttgctatatatatatgtcgacaaatttttccctaaaaatttgacagatgtaattacagtacaatcgtagtgtaattacactgtaacttgcatgtaattacactgtaactatagtgtaacttgtatgtaactttcaaaaatctctctgtaacatgttatttcggtaaaatggaggtcgtgggaacaaattctttcacatacgtgtgtgctatgatttgttttcttcctcaccaaaacaaatcttgtaatagatctaacgattcaaaattatgtgaaacttacatataagttacactgtagttacatgcaagttacagtgtaattacatataaattacagtgtaattacactacaattgtactataattacatctgtcaaatttttggagaaaaatttatcgacaaatggataggtagtcccttaaaacattgttacctcttgatcgagcgacactgggccatgtcgtttctcaattgaaaaacagcataactgacactagctaagacggcaagacgcaacaggcaagtgagcggaggagcacctagcacaagcatatgccagcaggcggtggtgcggcgcgtgcgagcaaagtcacattgaggacacagtctcacccagtaatccgatgtatgatatgctctgttcaggagacgcaaaacgaagtctctattattgcatgattaattgagtatttgctttttttaaaaaaaaatagattaatatgatttttttaaagcaactttcgtatagaaattttttacaaaaaaacacaccgtttagtagtttgaaaagcgtgcgtgtggaaaacgaggaaagggggttggaaactactactaccgaacgcaggaacacgaggatcgactcctctcaatcagcaataaatgtagggcttgttttgcgtcggtaggacatgaggatgtttgtttgttacaaaatttctgaagatatattcatacaaactagtgtaaaaggtttattttctccatttttaaatatttgcactgaggcactattgatacgtgctttgacaacttttttctttaaaaacataaatacttagaatataaaacatcttcttttgtcaaagtttgttgtgcgctgaacatcttagctagtgaaaagtaaattctaaaatgcttctgggatgagccacatcatccagtgaacaatggttattgcatcaagaaaaagacaaaataaaagagaagagagttgagccatcaattataaagggaaaaatggatgatgaatttctggaaccttccaacaatttggaaatgagagagagaaagagcaaagaaagaaatgtagcattggaaaagagtgggggagtcagctagcttatggcatgtgataattttgcactatgcacactcagtagaaattatgttataaataaaatctcatcctttatttataaataataattcgaatttttttataaatggactatcggcttataggcttatattttatctatagataatccttacaacctactaattccaaattactgctgtaacttgaatgtcacaatatcacataacatactaataaaatttgctatgattttaatgttatacttgggttcacttctttagcataaaagctaataggttgggcttaagaatgagtgtttcacctacagatacgctttcaggttatagctgatcaaatacacttctctcaacacatacttaacataatgaaacgatgtttattgttgccaatttaaattacatgctcatgtacacatataacatgatggttaaagtcgcgcgaacaagcgacattatatgctagtaaagttgatgaatgatttggtttgaagccaaaacttgcataccaaaatattggcattttaaacggtcattttggtaatgtttggtttgttaccaatccttgccaataccacataaatattgtcaaaatattggcattggcaaaaacttacctataatttggcatcgccaatagtttggcatagttacaaaccaaacaagacctgaaacttttgttcattgtagcctacccatcttaaaattactattaggaaaaattgaaatatatagtaaaaatttgaaattaccaagtaaacgctaccggagggagtatgtttcttttttttaaaaaaaaaaagaaaaaaaggaaatctccgccagaacgccacccggcatcgtctggactctggatcctcctggatccatgctagaggcctagagccatagattactgatttattgtacatactttcaacatggcagatgttcttctcgaatggctctcggcgttttgttaacacaaaggggcgtaatgtgtcatgtcgagttgtcaacgaagatggtagagggattccatcaggctgagcgcagatcggaatctatctatgagtataaatgataatgatgtggatacagttaattactaatgacgtggacacgctttaagatgctctagtctctttcacaggtcaaatctcgtgttcaatagtactataggagtagcagccaaggagcagtttagttagtattatgtactcctccgtcttaaaaaaaattcaacctaggactttgatgcgacataatatagtacaacgaatttgaagaaacctaactcctcttttttttcatcctccttttttttctcttccaaatttctctctccataaatattttcattttgaaattatcattgtttaagatgtgtagcggcaagtttgttctcatgcaaatgcttttcatctacagtaaaaaaaactttcactaattgaataatcaaaatttcaatttttggtcaatgaggtatagcaaaatacatatgcgacgaattatggaatagccactcgatcgattttgtgaggctattaaaaagtgtacgtaaaggattctccgtgtgatgacgcatgaagcaagtgtaattgggctcaatgctatatatgatttctgactttgttttgccattattttatttatcttgtttcagtttgtcatttaaattggcagagtttctacccatcgtaaaaattatcttcaaacccaacgccatttttgctagttataaacttataaataaagaaagcgctggcctgcacctgtctggcccaatcggctgggcttgcacccactcttgggccttgggccagtgggccgtaagggaaagagagaggaagacacgagcttttctcctcctcttcctctcccttcgcccgcggggacaaccctgaaccctcctctctctcctccaccacctcccctgcgaccagcggcgcgcggcagcggcaggcggccaccgggatggcgtcgtcgtcggggacgagggaggtgctcatgctggaggccccgccggcgccctccggggcgccgtggcgcgcgccgccggacgcggaggccgtggacgcgctgccctacatcgacggcgactacggcgacccggcggtgaagcgggaggtggaccggatggtggaggaggagatgcggcgcgggagccgcaagcccgccgacttcctccgcgacctcccccccgtccccgccatcgggttcgaggtagattcgcgatctctcatctcctctcctctccttgtgggttcttggagcagctctagttcagcgtcggggtcgttgcgttcaactatcttttcaggcgaaaaaaaatagaactgtatcttttctttcgaatgtgattcgcgttagggttatagctacttgtaagaatgaaacgggttagaggctggggggtgtatagggttagtaggtgtgtactcgaaagtgagagcgcattgctaaaaactgtacattatcctcctttagaactgtgcttatactatgttttggtgacggaattttggattatagttgagctaattaactgagtatatgtgggtcgcttggatttgtatagaacttttttttttgtaaagcttaatgttttgctctgctataatgtctgtatgttaacgttgatcctgaaaagaacaagagagtatttttttctgttgccacatgcttcaattgattagctcgtatggaggacagatgcctgatggtccgtgccttcaaattttctgaaataataataattgatagttttgactagatccaccctgctgcaaacagaaaagcaacatattttggctgcaaatatttaacttttttacttagcaacatttcttgaccaccaaatgaacctattgatttgatcggttacttgaaattaagtatacaatttgaggcaccaagaactgaaatataagctcttttccatgttctgtgtgcattgagctaaaccgacaggcaatttgaacctgtggcagtcaataatatgacctaaggtatcaaaagtgcacacggcagtcaatgaagaatagttattataagaaaaaagaactaaattgaatgggcattcacgctttgatgatttcatctaaataattcttatgagatgtaccagtctaggtgtttgcatcatattaactctgctccataatagttgtcttagagctcagagagcaaggaaagggttaataccttttttttcacaaagtttgcccttttggatgatataatctgtgcttatctgtgcaattgagtcatatttga

SEQ ID NO: 9991 - DNA, 1817 bp, Oryza sativa
  unsure (1)..(1817): unsure at all n locations
gtatgattaccagattgtcagnagtatatcaatctttttgcatgatctgcagttgccaaatccaagataacaatctaggcgattaccttgacaacccgcacttgtgattgtattccgttatccatttttcgaggacttgtgtgcatatggagacctgatagagaaacagatcgtatgcatgctgtgtttctgttccaagtgatctaacctgtgtgagaggcagaaatctcatcactgaaatagaatgtaccttgacattgaagcgtcagttaaggtttttgttatttatgttgacatgtttgtgtactcttcctgctgttaccatacagttttactaaacatgagttgtactaaccatggaggttgatatggaaataattactacctccatcctaacatagaagtaccgacaggatctttgttcagatcactagtaataggagatggtccattccatccatccggttttaggtttttatattttgaaatggacgtagtattatacttagcatgtcatggattgaattattgaagtaagcccccaccttcctggtcggcgtagtcccttgaggccatctctaagtttgtaatgaaaaacaactatagttcacctagagcgtgaatactctattttgattttatgaaccacacctcaaaagaaaatcttagttttgaaagcactaaagcaactagaagttcattttccggcatttattttttttgtttaaaaaaatactccatgtaagaaacaaatcttcagctttaaaaccaaacattattcaactactataaaagctatcaaatttaaccttcaacatggtttcttctcatgttgaagaaatgtttttgagttattttaaaacacagatagatcatatgatccaattaaccctattctgtgaaagggcatctagcctaatggttacaagagtctcagtagcacctgagtaggggtggaactgagctggaaacaagataaaacttgagctcggctcggctcatttcctggctgcaagccttcttattgaaacacctcttcatatatattttataattattagaaaaagtaaaaacaaatcatcaacatataaaatttaaataagtttgtttattcaattcttcaaaatcttaatgataaatttcaagttgacaaataataacgccatataaagtaaaataatcgatataaacacacgatggcctaggctcacgagccaaaacaagcggctcgcgagctagctcggctcggctcattttcagcaacgagctgaaaaggaggcttgggcttggcttgtttggcttacgagccgagtcaagccaaccaagctcgagccaagcctaagctgagctcacgagcctaagcttttttttccacctctacacctaaggtcctgagttcgacaccccatgggaacgaattttctaggatttagcggcgctgtactttcagtggtaggcgacgtacccgtcgacagcgaggtgctgacttcatcaatctctccaggatttgccggcctagtcttcgaagatgctcataggggtagggtttgcgtgcgtgtgttcatagggtgagtgcgcgtgcgttgagagtttctgcgttgtactgtgtaattcaaaaaaaaaaaaaccctattctagctacaaagaaataagcatcgaaacacaaaggttcatttgaaaatctctgaaatttcatcaaacacccctgtccaaaattcataaaaaaaatttgagctgtggcgccatctcccatcccacccagcttttgctgtaccgccatgtgatgngctnctgggcagtcgatcacaaaggcccac

SEQ ID NO: 9992 - DNA, 1595 bp, Oryza sativa
  unsure (1)..(1595): unsure at all n locations
gcggganncggatgagatctgtgtttgnaacagccannaatggtaatttttgggatgctttaacttctaagcaataatatgacatttttattcagtttagtggaaatcccagttgtcatgaattcgtaatgattgttatgtgtaccagtactcaacacatagggaatttagtgggcattagcaacgattaattgaggaaaagaactgcattactcgggtatatcgtatatgaatatatgatatagttcaagctgacaattagtctcttaataataccggaaggggttgtagagagtagctaggtaacataacaaaccagatctgaaaagcctaacgaagaaatacaatatattcaacgaacactccagtgaaataataatccaaatctcagtatcaaaatgaccatctcctccgttctccagaaaatgcaactgctatgtaatgtggtattctggtcatccaatcaggcctgcagtcaattgaaagatgagagcgtgacagatactgtaaaaagaacaaaaccaccaatcaaattttatcaatataacaaaactttggaaaaagagttggcatatctgtgttcgggaggaggggttggtcaccggcacgcaaaacaaagctcgtattgttgcatgattaatcaagtattaacttttttttttgaaaaatagattaatcatatagaaagtttttccataaatcacaccgtttagcagtttgaaaagcgtgcgcgcagaaaacgaaagaggtgggttgggaaaatggggggaagaacacagtaagcttcaaaccatgtaccaccatctttcaaacaccctcatggtacaattgcatgacagagtaatgtggtaatggcacataggaactaccttgtttgcaatgttgctcgagagccagtcaaggccctcatataaaccctctcctgttgtggcgcatgtactctggatatacctaaatgacagcaaaatccaacaggttatgatatgtaaaaatagcataatattttcaaggaaaaaaacgaaagttattgatccattgttaaggtgattctattcatcatgtaataatgagccacataattgtataggtgaacatcactaaaaagttttatagatctaggatggttcttggtgaaaatatgtaaatggcataagatacatacggagtaacacagttattcaccccctatgactatttagttgataaaaaagagttgaaccacaaagtggagtaaggtaaaccaaaaggctgattcattaaaatattaaaacataaagtttaaaattgaaagatagaaatcgacaaaccagaatacaagaccatcaaacttagaacaaaaataggaatggatgagatgagaagtagacagcctacaagtgacaacaaaagcaaccatatattaccagtggcgttggcgcagggaatggagaccaagcttatctgtgatctcagcagcattcattgcattaggaagatcttgcttgttagcaaaaaccagcacaccgcattcctcaactcattctgcaaatgccatatgactgaatgcttaagcagtgattggaaagaatttgtatatgtatgtaacataatccaag

SEQ ID NO: 9993 - DNA, 3798 bp, Oryza sativa
  unsure (1)..(3798): unsure at all n locations
naccggtatagtaacaaaaaattatgaggatatgtcggaagtgtaggaacatgcccaatatctctattgatgagttaataagtattgcaagcttaggaaaaaaacttaaacctactaccacttatgaggttatctgaaaaaaaaagggtacttgtgtatgaatatgacgaactaacaataaaatatgtgacatcagaaaatgagtattttatgatggtatatccaatttactcattttactaaatgtcatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggctgcaatatgaaaatggatacaaaataatgcaagtgagccactaaatacaattgtaaactaagacatccaccaagccaccaatggaaggaatccagccctttttcatacaaaggaccttacttctatgtgatctgcctttctttttgactacactatagtttgaacccaacttaccgacaacaaagtacgagtatttgaatgtacttaacagacacatccagtcaaaacatataaaatatcaaataggtctttacctattgttggaatggtggagacaatctctccaagcttgagcttgtagagaattgtggttttaccagctgcgtatagaccgaccatgaggatcctcatctccttcttggagaagaggcggctgaaaagcttcgtgaaagtgaggcccatcttgccgcagttgtgcaagaccctaaacaatcaagaatcaatatgagatatgatacaaaagcacatgcagcaaagttcttaaatctcagctcagataatgtaagaccaaaaccaaaatgggctccatagttcagttagttaaatcacaattcattcaaacgaaccagatcttttgcaaacgagaaaagtatataaggatatcgacattaagaagtactcccgtcatgccgttgtcttttaacatgacgtttgacatcttactaaaaaaattatataaataccataattttgttgtaacttgttttatcataaaaaaactataatattaacttagtacttttacatatttatactaaatttttaaataagacgttatgcgaaaagtcaagagcgtgcgttatacataaaaacctgaggtattatttgaaacggcaccgtgatccctcaggcaatgcaaagaaaacagcatctacagactatgatttcacatcccacgagtaaacaaaattcacagaccagtctgctgtgcgaaggatctatgcaatgcaacgcaacgcaacacgatgccactggaattaaaatgaacaatatacaagtctaacacgtgaaaaggggtcggcaatggaaacggataggcgatcacctcagccaaagcaaacaacggatcgccgaccagaagctcatctacggactaacaattccgcaccccacgcacgaacgaattccgcggacttgtagaggccttccaaggatctacgcaacggaacacaacacacagcaccacgccattttctcgaggaaaaaaaattctggatcgaaccgaacgagatctacacacgcgcgacgccattggaagtttacgcaccacacgctacgaactcactcggctacacagatctacgcctccactccacggatctgggcctgggcagcagcagcagcatcgccgattcgccgccagcgccagcgccaccgcatccctccccagcaatgccccgagggcgaggcggagatcggagaggagaggagagagggaaaggagttgggcgtaccaaccttgctggagatcgatctcgtgcgcgcgcgtggcctctctcatctcctccccacctcgtcgagccgaagaaaaaggagacgacgcctcgacgcgcggtggttgcagcggagggaggcttcgagccgccgcggtgggtggacgcggtctacgtgagccgggtgtggtggactggtggtggtggtggtctaggtagagtgcggtgcacgtgagacgggtgcaggagagagcggtgcttctcatttgaagcttcaacgtgcaaccgacgctttctctaagtttcattttttaaaccattttaaaattgagggagcttctaacttctcccagctgtcccaaatagtctagattttcatttagatttcaagaatttgtaattgtagaatccagaaaatgaactaaaattctcataagttgactaccaaccagttgtttcttagaatttttaacttttcaatcaggaccaaaaccaaaaagtctacaatgtcctcactttatcaaattctaatataattattcatctgcaattatttctcattttttatttccaatacaattattctttatgttcacaaactccgatgcaatgattattttaaaaataaacttattatggaacggagagagcatataagcatgtgtacatgtataaagtcgtataaaattcaaatgtttaaagtcagggtggaacccttggccatgataccaataggaaaattcgattgggctgtgtacccaaaacgttggggcagagctgcaaatttattgtgaagatgctgttgttccgctagtttgcagtcacaattcattcagacgacccagatcttttgctcgagtatacaagatgtacacatataaagtcgtgcagaattcaaatgtttaaggtcagggtacttgggatgtaaagtgttctctagcacaaaatatatttggcatgtgcgcgttggaaatacaaaatattcactctgctcataagataaaattaaatcaatcaatacctaaacacatgagaaaatagttcaattctccaacatcacttccccacaccttgaaaactaggaaaataaatacatacgatctcctaaatatcaaaaagaaaaatagatacattctcctctccctaaactgtagttcactcttttcatttcatctcctatatttctacaacatactattataaaatataaaggcgacgaagagacgaactgaagaacatgaatcaagtcttcggactgggatgcacagcatct

SEQ ID NO: 9994 - DNA, 2394 bp, Oryza sativa
  unsure (1)..(2394): unsure at all n locations
cggtggtnntttgatttactgactctacccgatggnacagcagttcatcatatcaaacaccagaaggactatatataaatcagctacctggaatagcatccaaaaccgtgttgtagggtgatcctttcatttgcatctgccttctaacagtgtccagaggataacacatcaaagttgcaaatgttgctgaaagaagagcagttgccagagatgtctctggtctactcttatacttctctggtacagatttcttcattcttacatacagaaaagaatagagggtgaggtgaatatctacttttgagaccaacttttttatatgatgaggtagaaagaatctcacaagtcaaaaacacagaagttcacagcaatgtaaggggcgattcctataagagacggacccaggcctccatagaaggaggccaaaccttcgtctctcagcatgttcatagcaacctaaaagttaagtcatcaggttacattaatttccagaaacgaaactcaagcttataaactagttacctgagacatagtactatgtccagattgaactgctagcctcagccgaagaacatccagtgggtaagttacctatcagcaagtagccaagtatatatagaagtttcataatgatcagaacacaaacaaacaaatcaaactagatataaggacaattgctcaggagtaaataaataaattacaagtgtagatgtcatgcccgcacaagcaccagcagcaagtctcccaaacacagtaagctctccgtcctttctccaaaaaaatttctgaatgcaaagcaggtacatggaaattgaaatgacaggaatccaaaataggtaattgactgatgataaagagttggcgttatcccccttgtaaacttcataagaaaacagttgcaccgcactgtaaggaactatgcggataaccttaagtagtttataaagaaactaagtgagaacaggaccaacagaataaaataaaccatgcatgagccacaatctgcatgatggggaatatcaagcacctgtggaagattgcctttccagtaacccttcaagccctcttccttccctatctctgcaatagcctgcataattgtagatgtatcagattagttatgtagtaccagatatacaactctaagtaaaatctatgaaaaagatagctatgcttctcctccttgtttgaaagtggaaagtgcaagttcatatatccaagagaaattagaaacaattatgttaagaagtcagaccgcacatagaaacaacatgttaaagcatatgcgaactggcagtactttgtgtctaactcatcaacacatgaagcaccagcatggcagcatctgatatcatattaaaaacatctaaacgaacaaacatcatgaagccataagtaaaacttaatggcatgccactgcctatttctgaaaaccattgttaccctcatttctgaaccatacaagaagcatcatgaattcaggacacagtgagtatgttacagtgtattataagtatattggaacaaattatggctttccctcagatagcaaccacgaattggtagtggtgaaacacatcagtttcatgactcacaggttcttttttaaagaaaaatgctccatgcctcacgaaagcctttttcatgatatgtttcccagaatagttttcaaatttctaaaacgtaattttgagattgtgtgttaatttttagtaaaccacgagtttcattgttccatatcagttcacatacaaccgcaagaccagaatactgcatatttgtagtggagagaagagtaccccattgttatgttcaacaccacacacacagacagaactcggttcgttctaacttatccctgatgtattcggaagctgcacttatgaattcagggaatttatcatgcaattgcaaatgacaggtactaaaatagacagggttgggatcaactccatggctagatggaaggcattttatagcaacaacagattgacattgttgtcatgaaaatcgcagacgatagtattaacattactaaaatagacagtgttgcatcagctccatggctacagaaaagcctttgtatagcaacaacagaattacgcactcttaccaacttagaaatttatagcaaactgaacagaagaggtggaggacatcatcagagttacctcgaggaatccgatccctttcttggtgctctcccccaccacccgcacgctgtgcgtttacaaagaagaagagcaggaaatgcagtgggttacagtccaagaacccacaggccaccccacagcaaggagagggagagaaatcagaaacccccgggacgggaggggcgggagtcatgtgatgaagtactgtaccatctcgaaggcgcaantcaatntcagcgcg

SEQ ID NO: 9995 - DNA, 13996 bp, Oryza sativa
  unsure (1)..(13996): unsure at all n locations
cgggcccttgaattgacttttctgatgtgcagnagcccatcactgcttctacctgtagtgcgaggaccaggcacgtcgggggtgtacctccagtcctgcgaaggagcccgccggcgtcgtggtcgagacgggccgggctgcgagatatctggctgtgacgactctggtgcgtcctctagctgcgagggaccgagctcatccgcctcctcttctctgtactgatacccttcttcctgctcatctacttcctacgcctctttgacttgctcgccctcctcgtcacccacctacccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtaccccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccctccgtaggtacgggacgtaccggtcgtcgaacagtatgtgcgccgtgtgacctctgactcgaagggtcttcaagcgctgcatcaatagacgaccataataacataaagttagcgactatatatcatatccaagggttgtggaaaatacttcatgcaactagcaactttaattttgggattgaccaagaaaactgaaaacaagatctgtgtgtttacatgctctgctttgaggctcctgaactttgatttgagatatctctatgatggatgatctatctgtacaaactaaaatcaaagaagaaaaaataaattcgatcataaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatgaaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggcagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgcccaattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattattgataaaaaaaaaactctactcctacaaattacctacccttcaccacacatcaacccctttcaaaccctctcaatcaccacaaatgcatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacagaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttaaagtttttggcaggggttagtttcgaattaagtttttgaaaagggtcaatttgtcaaaaaaacggtaattgggtggtaactagaaccaatacgtacttcatatgtacttaaataatacttttaaatattagaatctacgatactatttaacccatcctataaacaaaacctccatacaaatttataggatggtttaaatcttgtagtaggttgcaacattttgagacatggatagtatagtaatatagtagctggattagacctaacctattactaatcttatctagatcttgttatacccctctaaattgatttgaagtactaaattgtgtctaatctggtttttcggtactaaattgctatattttagaatgagattcattcaaattctaagtaaatacaatccaaaaaataaactaaaaaccagaacagattctcaaaaattaactaactaccaaccaaatgtttatcagaatttagctccctaataaagaagaccaaagagttgttgggtggatggttggattgagcgtggtgcatagctgcatatcaaaggctgacatcatttgcagcaaacgcataccacaataatactatgcatgtacgtgaagtgtttttttcgtgaggattattaaaagtttaagttttttttcctgaatgaacgaggtttattaaaagttgagttcaattatactagcacgcatgtagttagtctatattgagtaccactagagcaatgatccagctagccaagctaaaacgacatttagatcaccccaagtaaagcatataggtttagaaaccattcggatacacagcaaaacaaaaagaaaactcatgtcccagctattctttagaaagtccatgggataaattggagcaagtctatttgcttttcccttttgctcttggaaatttgcagatcagcggtaagattacatatagggcataaattagttgactttctttgccaccttttgatgtttgttattcacaactgagcactattaaatatgatatgtccacggtgtgttttgtttatttcttctcatttcaggttttctacaatactgctcagtactatttaggattctcgtgtcatattgattggccttcttctaattattttagcatttcaatacataaacagttgacaggtatgtataccgaattagaagtatttatctatgtcaaggttcttttagtaattgtatgatgtccataatgtttctttcaaaatataggatcatgtcctgtccccccaacacacacacaaagagataaaaatagaatgtggttattcttaggtacccctctgttccaaaaaaaagtctaatccttgctaatccttggacacatgtgtgtcagatttgtagctagagtttgcctttttatgggacaaagtagtaggaactacacttttttgttgttttgcaagtttgaaatttgacatttcattttacatttattattttcatgtagagggattgaactttattttttcaagtctttgaaatcacttcttacagaattaagcatttcatgttcatacattctttcgctctattagctcaaaagatattttgttgcgatggttcctacaaaatgttaagagttattgcacctgcttcaccttttgtaatatcacatatattgtttatatatgcgtgccaggcaaattatatgtgtcaaccgctatttatgtgatatatgctcctttttttcgttatatactattgattagggattcttatgtatgttttatatagcaggttgttaacgccaaaatttggtaagattttgtagtggattcggttaaggaaaaaacacaatcagccgatggaaagcttatccagaagagtccaagttcaaggagtcatgaataccatggcgtggcagattaatttctatctattaattaggtagagtttagttattttcccttatctttaggaagttttgtctagtgtccgattaggacttgtatctttccttgtctttaggaaacatggtgtcgcgtccgatatgaactactatctaaccatgggtgtttctttgtaaaatgtaatctatctcttgatcaatacaacttcagcgcatatcattggacatctacttcaacatattatcatcgctcgattggattgattgtctttatatcatatttatctaagcggtaaaatttagatcgggcatataacctattgtttaagaccatatcgacatcggctagtactgatacattggcttaatggttgatcggttctttgaacatcaatttatctatcttgtcaattacaggatcaaactgactggcacacccaaacctgatattttaggacttgcactggagctaagcaaatctcccatgacttcaagtgtcacgaagaaatttcacgtcaacacatgcccatatatagatggatgtttgatccttctttttggtgcaagctttctgtgcattatattcttattagacactctccaggcccattcatgaatgatcctatgtacatgtaagcttttctattgccttaatgtgtacatgaagattatttcgaataagcctttccaaggcttacttcgatacctaagttatcttgtatagttaggtataattatgaacaataattatttcaaaagtctatgaatgatatcgtccattcaaatatatgatccaaatgactacaattattctaaaccacaatagaaataatgatgtcggtatatatatatatctctactacctaaaaaaatcaaaacgtttccttcgtccatcaaaacaaaaaaaaggaagaaaattactaaaaaaaagtctgactcccctgcgttcgtttgccagggctggccctccggtatggaaaacggagcgatccattagcgcgtgtttaattaagtgtttgctaatgtctttttcaaaaatggatcaatatgatttttaagcaattttcgtatataaactttttgtaaaaagaaaagaaccgtttagcattttaaaaaacgtgcgcccagaaaacgaggaagaggggttgggaacaagcgggaacgaacgcagcctaaatagatcagattcccccttaaaaagagggaaaatatgagaaaaaatagcgaacaaaacaacaacaaaaaaaatatgtttcctttaagtggccaaacaaaaccgtagatccaaacgggaaaaaaaaatacgattcctataaaaggcaaaaacaaaaaaaaagtggtgaaaaaaacgctagatccgattcctataaaggtgaaaaaaaaatccaaaacatctttaaaaaaaagttcgtccgattccctaagaaagtggcgaaaaaaactgtttgtaaaaaataaaaatgggttcgtataaaataaaaaatacacacgagaaaaaaaaagggcctaaaaaagtttgatttctattcgttttagtagtcagtatatatatcttctttatctctaatctaatctaactatttaaaaagagaagttttcatcgtacaactgaaaagaaaaaatgcacaataaaataaaaacagttcaaaaaatacgggagaaaaaagtcataaaaaagcgcaaaaacacgctaaaaaggttttccatcttccaaaagaaataaaaaaccgagcaagaaaaaaatatttccatcgtcggtaaaaaaataaaaaacatgcgaggaaaaaactgtcagaaaaaacgcgccatttcaaaacaatggtttgaaaaaaccgcgcaagaaaaaaacaccgtctattaaaaaacaagccgctctgaaaaaattatcagaaaaagcagtaaattgatgcacgcttgagtcggaaaggatccatcgattttttgccatctaatacacggcttttgtttcgtcatctattctcatgtattggaataaaggaaaaagaacattcgaaaaaaaagagcaaacgtgcgagaaaataattgtcacaaaaaagggcaaaataacacgcgagaaaagaaaagcaaaaaaacatgagagaaaaatacggttttcgtcatcagtaaaaaaaaagcaaaaaaaaaacatgctaggaaaaaactgtcacaaaactgcacaagaaaaaagacaccgtttataaaaaaacgagtagaaaaaacaatcgggttcaacacgagaaagaaccgatgtttctaaaaacggttcgagaactctaacgtaacgcgagaaaaaaaattcatcatttttattaaaaggttagagtaaaccatccgaatcaacacgagacatacaaaattgttgtttatgataagaaccgctctggaaaaccatcggactcaacgggagataaaattgatggacgcttgggttggataggatccatcaatttttttctatctcctacacggtttttgtttcctcatctttctcatgtattagagaccctgcacgtctctgcacgtatctgtatgtagatatcaatatttgaataaagtggaggaggaacctatagaaataaacatcaatatttgaataaattgatcaaatatttaaaatattaggatgagataactaatttaccatttattttagttaattacaacactttgagttcacagatatcacttgaaagtaaatagataacaggatgacaaaaacgaataatccaaaataagaattaacagatatcacacctaaaaataaacttacacaaataaatataaaaaatgcattatcatttctagtgtaaggatatcaaacttaatatgaaatgcaatccccagcacaagacgtagatgtgtacatagtccatagtcctaacacaatcagatgtagagtacatataccatcctaatcctcaacacgagaaatacgtgtacatatagtactatgtatagttttaaaaaacctcctacttctcggcacgaggaaatcagggcatgagaaaatcgggatcgatccataacatgtctagtgacttgacaacgctagaactccaacaaacactgctagcacagatccaactaggaaccgtgtgcactcaaccacgcttatgcaaagatcatgctgtctagcaagcagggcagtgcttaaggctgcaattccccccacctcacatgcaacacatgagcacatgcattaacatagatataacttaatcaaattagggagcgtttgttgagggggaaatgagttgtaagacctcatttgcatggccagcattgagtcccatataaacaaagcattaattaactctatccatttccaaaatatagtcagttttataaataattttcatgaaactgttccaaagccaagtaccatcatccactgttgtttaaaaatgtatttgctagtactacatgatgaggaaagtagtaaaatgctagtagtgctttactacttcatttattgccaggcttatttttggtccattattgattggggagagatataaggaaaagatattaaaagaatttcattttattctcaatttttgctacacaaactagtaatagttgtaccttgaaactgagagtataatttattgtttattgtcatgctctatgcatattaatcaggagagtataaagggactatatggcacagctccagcttcacccctcctagagctagagctcagccaaatgtttcagctccacaaaaaataggagtggagctgggtggagctctctcacaaaatggtctagagttgtagagctgggtttaagagctggtgtgctaattcaaggagcaactcaggaactccaaagcacctcaaaccacatatccaccgagcaactccagcatctccaaaacaccgcaaaccatatatccaccaagacatacctacgcatgattctttgtagacgagcacagcgcgaccaactgctacgagtagcgcctcttctatcctgccctctccgcaccgtcgttgcaacgatgtaatggagcgaagcccacaaggaggcaatgggggcacatgcccccttacgctcatagaacaaagcgtaccttatagtaataatagttgatctccatggttgtgggttgctcatcatcaccaatggagcttaaactaaagtggagggagaacctatagaaataaacatcaatatttgaataaattgatcaaacatttaaaatattaggatgagataaccaatttaacatttattttggttaattaaaacactttgagttaacagatatcacttgaaagaaaatagataacaggatgacaaaaacgaatcgtctaaaataagaattgatagatatcacacctgaaaatcaacttacacaaataaatataaagaatacattatcatttgcagtgtaaggatatcaaacttactatgaaatgcaatcctcagcatgagacgtagatgtgtacatagtcgtaatacaatcctcggcacaaggagattatttgagccagtgaacatatcatgttgatcatgaccatcgtgataagtagggtagtggatatgtgtctcacgccacaaaagaattggtgtgctaattggagaagcaactccaggaactccaaagcacctcaaaccacatatccaccgagacatctctgtaagacaaatccagcaacccgaaagcaccgcaaaccatatatccacaaagacaaatctccataaggtcggtaagcatatccatcaagacatgcatacgcacgattctttgtagatgagcacaacgcgaccaaccgcgactattagcacctcttttatcttgccctctccgcaccgtcgttgcaacgatgcaacggagcggagcacagatgggggcacatgcccccttacgctcatagaacaaagtgtaccttatagtaataatagttgatctccatggttgtgggttgttcatcatcaccaattgagtttaagctaaaatggagggagaacctatagaaataaacatcaatatttgaataaattgatcacacctgaaaataaacttacacaaataaatataaaaaatgcattatcatttgcagtgtaagatatcaaacttagtatgaaatgcaatcctcagcacgagacatagatgtatatatagtcctaacacaatcagatgtagacatgtgtacaatcagatgcacataacagtacgagacatgtgtacatataccatcctaatcctcaacacgagaactatgtgtgtacatatagtactatgtatagttttatagatcctcctacttctcggcacgaggaaatcaggatccgagggtccataatatgtagtttcttgacaacactaagaactccaacaaacaccgctagcatagatctaacatgatataaaaggcatcaagtggaaatcctctatgttcaaatttgaaatcaactagttattgagaggatttacagcatgtagttgaataaatttggaattcttgtaatgaaaagaggtctatattgataaatgcgatggagaatgcaaatgatgagaaaagggctaaacagatggaacatgaactgggatagtgaatacaaatgggaaaaacataggtggcaaattattcatatcaagtttcgatagagatgagccaagagaagtttggagtggagggaatgaagtttttgtgtgctcctctttttggcctgatgccgatggatgcaggttttatgccctagcttattttgtagttttttttagtcgatctggtcgcacctgaaccaatgagaattaggccaaaaccttttaatttttttctcctgaacttaatttttttattttttttctcctgaacttaatacttccctaaaaatacttccactgaactaaagtatataaggagaaatggtgatcaagctaataaatgaaacatggtgtaataaaaaaaacataaacaaacatgtgagattgtgataaaagcaactgtgactatatagcagctcatccctcatgcggagagagagataagggggagaggggtgtttataacaaggataagcatgcattcatgataatcttaacaacactaaacagccttgactaacctggccaacagttcttgtgtgcacaatccagaggaaggcactaaatcactacatgtcaatcgatagaagagacaaatacttgggatgagcccctgcaatatgtccacaggcaaaaaagttgacagacttgcttaggagcaccccaaaagccagaccaagtaaatacaagcaccaaacatctattttgttttgtattttttatacaacctcccaatgggaataaactaagcatattcttattgatttagttgattgacatggatgagttattgaaatatttgttaaatctatattactttcaactgaaagtataataacaaaaacaaggaaggaggtttccgcatgtaaaagtactaaaaagataattcaaaacgtgttcagactttagtagtacctcaagatacatttcatcgagcagtccttgagcaccaaaaacctctaatgcgttcctcctcttccttgttctctttgaatcctcctattctctggccatagcagcagtgcacagcagcacatacatcatgaggtcaacgtagagcagaagtgatgngctgctgtagcagaagttgntcattccnnnngcccatc

SEQ ID NO: 9996 - DNA, 2730 bp, Oryza sativa
  unsure (1)..(2730): unsure at all n locations
gtcgctaccatctttcccctttgtccacaggaaaccgccaatatccccatccattgcatctgtagtgatagatggatggggatgaacggaagacgatggatatttttataagatttcatctcttcctcctcttatggtgacgacgttgcgatctactatctaatcccgctttgcttgccctagggtcgcgctcagccctcaactcatgctcactgccttccttatggcgaagatgcagagttgaggatgacgacaaatcgacagcaccgacagcggtgggcaggcggcgatgtcgagcggagttaatgtgtagcagccacagcgcactgtgttgaggggagatggcgacacgagacgaggcgatggtggtgggctaaggcgcacggtggtgggcctattggcgagccggcgatgacattggctgggggatggcagtggcgacgagccacctgggaaggaagaggggtggttcaaggcggcgacgaagtggaggcgtggggtgctcgaagcaggaaggttgtccattggtttcactaatcctgctactaatccatcggctaatccaactcacaacgtaggtcgttagatgagaggatccaacggttaggaatgatctgggtatattttgttaattcattttgactttttccgtagtcaaacttaaccaagtttattaataacatatttgttttgtatttaaaatgctatgctaacttgattaaacttaaagtttgattagtcaaaacaacttataatatgaaacagagagagtagatgcctactaattgacttactatactagtaatatgaacgtgctaatgctatggcgatatttcataaaacaatggtgatagacagataaatagaatcatgttgagaatcaaacaactaattatacttgttgctcacagtatactgatttaatacaagacttcctaattcataaaacccattgcatgatcagtttcacttgagctatcaaagcgtaaggattctttgaaaaacaaaaccacagacaacagtgggagaccatagtttacagggtcaacaatcatgttttctccttttctagcctccaaaaataggaacattgattcaatagttttttaaactcccaagttactctaggaaggttgactatgaagatcgtctgagttctaaaccagagatctaccgctctttacaaactgaccaaaatcaaatctatggagctttcccccgaatttagaatggatatgttttacacactttttcaagaacacacgaatgtattgcatgtccttcatacaaaggaagatagggttagacatatcgttactatggggtagtttggatacagggttagtctctgtcacatcggatgtttggacactaatttgaagtattaaacataggctagttacaaaactaattacacggatggaggctaatttgcgagacgaatatattaagactaattagtccatgatttaacaatgtagtgctacagtaattaatcatgaattaattaggcttaatagattcatctcgtaaattagcctctatctgtgtaattagttttgtaattagtctatgtttaatactccaaattagtcagagcgttcgttcgttgggtgattggagagaaagcacatcgtttttcgcgtgcacgatttccaaactactaaccggtgcgttttttgcaaaaaaaaaaaaattctataggaaagttgctttaaaaatcatattaatccattcttgaaatttaaaatagttgaaactcaattaatcatgtggtaatggcttacctcgttttgcgtgccttctcaatcttctcttttcctctcctcaaaagtaaaagagagctgaaactcactgattctaaagtttggatcactgaaggctgcaatatggactgatcacttcagaaaagagtcgacacttcaaatttatttacattgatcacacaacctaatagattcactggacaccaatctaatgacatatattttgacaaaatatgtagcagagaaagtactaattattcataaatcacatcatgagctacaaaaacaccatgaactttgcttaccacgtagagcaacaatcgacagaaagctaggcttgcactgttgtttccagcttcctatagattttcctgcaaaacctacaaaactataaaactggtgaattttcaacaccaaacatggccaatgatatgtaatcatgaaaaatcggtataaatctaacggccttatcttgttgcttatgcttatgcttattagccaaaatttgatttttcaaccttaaatttggagttgattttgtggtttttttcatcgtagtttattttttagcctttgcttttagatcgttaggaacatgtatataaaagttttattcacaaattatttttcgtttgcaagtaagaataagccaaacaatgggatgtaaaaggctaccctcaataaatggaaatcttcattgatcatgatgaataaaaaacatgaccagagctacagtactatacattaattaaaaacaatattttttgataaaaaaacagttttaattactgcatccaactaacattaataggtaactcggtaaaaaaataggaacattgattcaatagaataagatgctaatagctctcccatccctactgtcccaagttactttaggatggttgactttgaagatcgtcttgatgggctactgtggaagcagaaagccaatnncaagggccca

SEQ ID NO: 9997 - DNA, 13985 bp, Oryza sativa
  unsure (1)..(13985): unsure at all n locations
ccgtgttgtttacganctctgctanagcncaccaagcattccgacaaatatgatattcacaggcacccaaactttgattagcttccaagttagtggttcagttgggataacaccagagagcgatagagtggacactatagtcacagatacaatgttctgcagcaaaagaccatcaagagattatcaatgggtacaacaagcagcagaagcacgacacagaaataaatgtaatatattgtttgagaggtaaacaatcagaaaaaaagtaacatacctgataaagcatcagaaatattccagcactgaaaccatagccagataagatatacttattaactaaaatcatgctgcaggatgatatgcaataggcaagaccagatagaagagcctgattctgtatctttgggagactgaggaaatgtgaaggcctatctctgtctttttcagccttaccatcttccaagtcagtgttgtcaatacagaaggatcttgttatagatctggagaaaatatgatccagaaaacacaacataatgtgttagattccacgatacttccaaaacattttcattcaaatagacaagaataatgttttcacatggtattttcagttttttttcccattgctgaatcgtcacaccacatgattatgttgaaccgaacaagaatatttttatatgtaaacgaaaacattatatgtaagttgggatggagggcatgtaattgatggaaaatccactttatactttgaatacaatggcaacaagtggataaaagaacattggtcaagggaagcttacatgcctgttcccaacttctctcctcaaaggactcccaagtgcactgtatcctctaacctgatcccggaaaatactcttttcaccattcacaagaggacttgttacagtctctggcgtatttttcctaggagaggcatctgaatccacaggaatggctatagaaggagttctacaagataaaaaggatgccattagcaataattcaattatgtaagatatatgtaggactcttccttatatacagcatgccatgttctattgggtttcatctcatcaaatatctcaaagtgaactcaaacctcatgatccagcaagcaaatgaaatatatggtacttaagaatgctttgtccagaaggataaattgcaagcatatgcatttcccaaaagagtcaaaattctgttctagaaataacatgaaaaaggtcttgtgctgttaattcacacaatcaaattatcatcgctgcataacacattttttttcaaagcaattgttgaaacccaacccccacagaggcacaggcatcaaccggcttgattttgaaacatcagtagcgcattcgatggctgtcatatgaaataactatttgcttgtaaaggatgtctcatggttttgagacatggaaattctctatcagattgaagtgctgtgatctaggaagcaactccaaggttatcccgattgagcaaactgaccaaataaagtccggctatcacattcatccgccagcctcatacacacgctacagctattttgctgaacatctaatatgctcaactctgcaaaagtgcattatcagaataacggtatggtgaaccgaagtatgaattactaaatttaatcaatcatgtggggtacacgggtaaattggtgaaaacaagcgagttgaggcacgcatactactgtttcacttcccaaacatttagtttcattctattttgggaaatattgaacctaccctctaaacaatgaatgagctcttggcaagatagtggaaaccaaatcaatagctatggtcaacagaagagtgagaatctactactaccaataaaggaaacaagttcgttacatcagccattaggtagtaattaaccacacgcccatttactaacaaaacaaagttgttaaacatgggccattcactcgtttatactctcatcagccaaatgactaatactgtgcgatcaaaccatgagacaagtgtagccgcaaccctgtcaaatctcaatacatttctcatatgcaagccattcccgcttgtttgttagtttgagacttgggaggagttaaaaaaaaacaaaaaaagaggagaaacaaactagctgaggttccatatccatccatccctacacgcttccaaattacagaaaatatgaaacccggagagagagagagaaagctattgcaccgagacattcctgatgaaatccgtagctccccacaccgaaatggatcagcaaccaaaaaaaaaaaaacacttccccgaaacgaaacaaactctattagagcaatcgaaccacctcccgtactaaaaagttccctaatccaaacccagctagttataaaccgcattagtcaacctcctcgtcttcgaagggagcggcggcggcggcggaggtgaaagccgccaccaccggggctggaagcctggagcaggagccgcaaaagttgttgccgtacaggggaagaggagagagagagaggtcgatcggaggctgacctggtggagcccatggcgccgccggagccgggcggcggcggcgaagaatggcgcggcggaggaggagaggagaggaggcgtctgaaattttgcgaggcggcgacgactcgggagtaacggaggagggggggattcgctttaaaatatccggcggcctctctctctctgacgggtgggccccacctgtcgggtctcgggcgcagctgcttcgctgtggcttcctcgacaccccgagccgcctggtacttcgtgccgctgacctgcgggacccacgtggtaccgggcccacgtggcggtggcgggggataaggctgggcgttgccctggtcgcgtcgactccgcgtggcgtttggagttgggcgagccgtgcgaatgtcgtggcgttgactggagcccagcgatagcagtagcaggctttgcgtgacctgaccatggaggatgggctttgacctcattttgtttgcttcagattcagatttgtttcacacatctctttcatcttgcgtctgattatgaattactactactgtttagtttaggttaggacatcaggtggaagcaaattactttgaaatttaaacaagtagtaccaagattagtactaatccagctatagaatggagtggcaggaatctgtggaggttgacttaacattggtttagtattttctttccaatacaaggacgttatgagctaccacatatgccatagattccattgattatactgtcctaacatcagataaacacgacgtcaatcatatgcattatccaaatctcagttttgctttgcttgtgctaactatcttctgttgagaatggatacatacataccaaagatgtttgtttggttaagttgcagtattaattaggtcacttaataattgattattagttgtacaagaaatgtcatactattatatacatcatatttttgtttaatttaatgggggcgcagaacgattgagtttggttttgaaggtgaaattaattactccttacaattcatcaacgatgcatgtaatagcaagcactaaagttctatttaaaaaatccatcgcatacataaccggtgaatcaataaaagtagaaaaaacaacactatggtatcattcactgttttatcagcatgggaaaagaaaaggaaaaaggaaaaggagaaagaaaagctttcctggaggatctcgtcgcagcgagaagcagatgtcggcggcccatttacacgggcctctcatccggcccacgaaccagcccaattaggaggcaggcccgacacgatacaacttatcgtctcctcttcccctctcgtctcgtgtcgtgtcgtcttctccaacccatccaaaccaaagccgcggcggcgcgaggaggcagcgagagctagggtttggggcggcggaggggagatgtcgcggacgctggtgcagccggtggggcagaagcggctgacgaacgtggcggtggtgcggctccgtaagcacgggcagcggttcgagatcgcgtgcttcccgaacaaggtgctgtcatggcggacgcgggtggagaaggacatcgacgaggtgctccaatcccacaccgtctactccaacgtctccaagggcgtcctcgccaagtccaaggacctcctcaaggccttctccaccgacgaccacaccgccatctgcctcgagatcctcgacaagggcgagctccaggtctccggcaaggagcgcgaggcccagctctcctcccagttccacgagatcgccaccatcgtcatggacaagaccatcaacccggagacacgccgcccctacaccatcaccatgatcgagcgcctcatgcacgacgtccacttcgccgtcgaccccaacctcacttccaaggagcaggtctgctattcgaatttttttattccaatagaggaatactaatagggcttgctattcgatttgttaactactaccatctgctgctgcctgcttttatactgacaaaatagaaaccagcatcgttaataaacatgttatcgcaccattgggcttcagatacaactgatatagttagtgatattgacattgtgttaaatcaattgagttacttggtttcctgtttctctttacaatttaatatatggagatcatggtttaattgtttaagcacaaatttccatgtccttatttgcattctagcgtaataactttgtgtgtgtggtttggtacctgcggtcgcatttatttaacttggatcttcaattcttcttcaatcacggtaagaaatgtgcacacccagtttaggattttctgggccaaccaattgtattttaacatctagtttcttcagacacagaaccaatgatagtgtaaataacagaatatgcacaaaaagaatgtgtgaatgtaggtgaacatacctgcttgcttgcatatacaaattagacactccataaacctcgtgtcttgtggactagtgcttattggcttagcgaaggacactaatgtgatgaatcgttcctgtaagctcccagtggactattcctctgcatttgctccaattggtaggaaatagtctgttaggcatttagccccagaggcccagacttgatgacatggctgagtcaaaccaaacatcatggctgaataggaaacttagatcactagaaatatctctgtctctcatcatctgtagaactggtagcatgactaaaaaaggtaatggtacctctaaatgtttcttagttgtgtatcgcttgcaacaattctgttctaccttctttctacagttgatcaaccttgcagtgacagtgagtcaatttcttataataacatcatactttttgtgaataaatcagtaggaaacaggcatgacaataccgacaacataatatgttcatatttgttttgattacctatggtttcttcattgcacaggcactgagagttattaagaacctaatttattatgataacctatgatttcttcattgtgcaggcactgaaagttattaagaagctaacagagcatttccccataaagcgtgcaccattgagggtgcgcttcactgcaccaaagtcaaaatttgcaagccttacagagaagcttgaagagtggaatgctaatgttatttcaaaggacgagtctggtagccagccctctgttgtaagtgctttcttccagctattactatttcactgattatgattcgcttgtcatcagtgttccctgcatgactagagtctagaggcatttcgcaaatcatattggagctcatgttttcatccacaatgttatgaagctgttaaaagattttttttttgctgtcttttggaagttgttacattcagatttatgctgctttatgccacttaatatttttaggctgcaataaatttatgctgctttatgccacttaaatatttgtagaatttagtggaatccttcagaagcttgtcctaggatagtaggctttttttcattgataaatggattgtcatatactgctatgacttggttgttagccgtgctagtcagaagcttgatccctattgcattgttcattcttctgtgaaattatttcctataggagcactaccatcctgtcatgcttaactttataaccattatgtttgtcccatgtgtacgatgtttttcaggtgtgtgagattgagccatctattctacggtcatgtgaggagagattgaaggatgtgcaggggagggtggaagtactctcagtgtcagcgcacgcagaaggtggctcttctgtggatcaatatgaaaacactgaagaatctcaatcagtgcctgcagtggagattgatcctgttgctcggataggtgaggccatgcagaaacagtccatctcaagtgagccagaaaatcctgggcagggacaaggcaagcagcagagaagatgcaaagaatgtgacgtgcttgtggaggacaagttgtatagggagcattgcaaatctgggtggcacaagcacaactacacacgccacaagaacggccttcctccactcagccaggaggagtgcttggtggaaatggaattagccgactccaagagggacctaaaagactatgatttctgaggtgaattccctgtagttccacaatgatattgtgtctgtattctaataactttgtctgacttctggctaacattttggttcaacatgttatcttctaggctgatatggtaaacattccgtgtggtacatggagatgcagtgtttttgtctgaggagaaaggttgtctgtttgatgctgtatagggaagcagggaagggaatatttgtgtaaccgcaatgtacgctacttgcaatctactgaaatggagtggtctatccacattgtctaaccgccaaagagtagcagaaacctggttgttgctgtatagctgggccagtaaatctggtggcagttttgaatgttgcttattctgtaatgggatgctatgctatgctatgtgagactacatgttagtatatcatgtttcttgctctcattcctgtggacagaagtgaatgaaaatttggagatcgattttgcaatctacaatgtgccgattttgctagcgattgtttctgggatttgtggagtcgattgctgtaggattgatctcgtttgattcgatcttggaatagtcggcacgaaacaaatgaaacaggcatacatgttggttgcgttgaactggtttttaactcaatgttgtgtgtcatactcttgtcgctgaagaaaatagtgcagtaactgaaacaacagaacttaaacaaaacaacagtgcatccagactatcacacaaacagcaatgcttaaacagaacatcatcatgccaaaaaaaaaaagagaaaaaactttgagccaactaggcaagacgaggagatacaataagtacattaggagtatgatgactaaattcttgagcaaattaagcggcggtaaataatcgcgcgaaaaattgaaatgaaaaactcccgcctctctgcctccaaaacaaaaccaaatccaaatcttcttctccacagtcgtcgccgccaccgcggccgccgcccgtcgccgcggttgcgctgtgggctgcggttgacgaggagggagggaggtcgcgatgccgatcgagctaccgcgggggctgcccttcgccgtggacacgtggacggccgcctccgccgtcaagcgccaccgcttcctgacccacgcccaccgcgaccacatcgccggcatcaccgccaccaacgtcgccgccgtctacgcctcccgcctcaccatcctcatcgcctgccacatcttcccccaggtaaccttcattcacaaatggataattatctcaaatcaccaacaaaatcaaattattaccactccaattcaaagctcgatcgcgccgacgccttcgtggaggtggagctgggcgcgccggtgctcgtcccggaccccgacggcgacttcaccgtcaccgccttcgacgccaaccactgccccggcgccgtcatgttcctcttcgagggcgcctccttcggccgcgtccttcacaccggcgactgccgcctcacccccgacttccgcttcctcgccgccgactacgtcttcctcgactgcaccttcgccgcctgctctcttcactttccctccaaggacgactccatccgccaggtgaggtcaacattgctgctgctgctgaatcactgacaactcttctcctcaactgtaactctacatttttgctctctcatgatttcaggtcatcaattgcatctggaagcaccccaatgcaccggtggtttatctcgtgtccgacatgcttggccaagaggagatactcatggaggtgtcaaaggtgtttggatccaagatttatgtagacagggacaagaattcagagtgttatcacaccctctccctcgtcgcgccggagatcctcaccgacgactcgtcgtctcgcttccaggtgattggtttccccaggttgtcggagcgagcaacggagatgctcgcgttggcacgggcgaagcaccagcctgagccactcatcatcagggcttcttcgcaatggtacgcgtactatgagccaccagagggatcgaccaagaggaaaccggcactgacagagccaatgcgcgatgaattcggggtgtggcacgtctgcttctcgatgcattcgtcccgcgaagagctggagcaggcgttgcggttcatccagcccaaatgggtcatctccacaacccctccatgtatggcgatcgagctgtcctatgtcaagaagcactgcttcgcgtcccggttacgcaatgatgatcccctctggaagctgctcaggttgtctgatggaaattctgcagtttcaggatcaccactggctgtaccaactgtagagatgatcaagaaatgtgaggaggaagaggtcacttgttctgtcaaggactctttcagttctgatggtatcaggatgcgggatcaagaaccaactctggaagactttgaaatcaacgtggagccacctgtgacactgttcgggatagcgaggtttggattgacagaggaacctgaattgtggaaggatgagcatgagagtgtcgaaatcgacgagcttaaagtgcagatggagaattcagctacagaatgtgagcagtggaaggatggcatatctgtcttaggctctgaagtaattgattcagttgaaattgtggccaaagagcaggactcagcaatagaatctgaacagttgaaagattgcgaacctaaagatggaaccaaagcaactgatgtaactgaagttgaagtgaatgagcacacatcatgtacagaatctgtactttggaaaatggacagaagtgatgagtgtgtgacaactaagagaggtgaatttgaagctgaagaacagaaattcactggcagataccagttttggaaaatatgcaagcccaaggagatggagggtgctaaattgactgtacaaggtaaaaacactgttgaagcacttgatcaggttttggccatcgatcgtctagcctacttgcatgacaacaaccaagaggtaacaaaagagggtattgctccatcagaaactgatcaggagaactctaaagttcctgacaagggaagcagtgactcctcgaatgctattggatcatcaaaaggtctgaatgccaacctgagaaagctgtacaggtcgatgaacgtgccggttcctcgtcccctgccctcattagttgagctcatggcagcctcaaagcgaccaagggtttctcctgctgtgcagctgtaggcctatcatagattcatctgttgtttccggcctctactttcagtcattatttgagttagacctgtcattcaagaatacttccattgtaacagcgatgctatagcataataatatactataattgttcttaatagctaactaatttgaatgaaaataccatgcttacaaagttgcaagcttgcaaccttcaggaactttgggcagtaaggattgttgcctcctgccttgtttgggaatatataatgatttcataattcaacagcatcacgaacgattttcttgatacagaacttcacatccaagattgcaaacaatattcaacagggaaaagagcttttggtctgtgagaaactcatccagtgaaagatatacataaatttaaggagcatggtgaatttttgaggccaactagatagctacaggctgtgtcaaacagcccttgttttcacaacaggacgatacttttcagggatagcatttatatgttgatcgtatttgccacttgaaaccagcaaaaccagcgactcagccgtggaagcttcaagggagaagttattttcatcaattttggagagataaaccccagccttgcgtacctcccctttctgtagtaactttccaactaaagcatttagcattcgggagttagctgtacaaccattcttctccaaagaaagaaataaatcatccaactcttctagcaacccttgttctatcaaacttttcatcattaaccagtaggtcacaacattcggcactaaacctctagccaagagagaagcaaacagatccttagcttcatcatgcctgccacctttaagtaacgcatcaatcataatgttaaaagtcctattctctaggtggaaatcaatcaaatataggttctgaaaaattcggagagcatcatcagtgcaattgttttggcaaagtcctagaagtattatgttgtatgtgccgatatcaaactttatcccacttttaatcatccaaagatagagttcttttgcggctgcagttcttctagcctgaaacaacccctggaggattgtgctataggtaacaatgccaggattaacacccttgcttgccatctgtctgaaaagagaaaatgcatcctctatcctaccgttcttacagtaaccattaatcatggtattataggtaacttcgttaggtttcaccccatctaacaccataccttcaagtaactttgctgcttcatccaccttaccatgtaagcaatatccatctatgagtgtgttgtatgtaatgacatcacgctgcacatctacacgtaccatcaagtcaaatatgtttttggctcttgcaaccattccttctttgcataggtggttcaacaatgtgttgaagaaaatgttgttgggacagatgcctcgaccgatcatttcaacagctaactcctcagccttgtcccannnnnnnnnnnnnnnnnnnnnnngaattaagtttctaaaaacaacagcatcaggagttagtccttcagagatgagcctgccaaattgggccatagcatcatccactttacctaccatgcagagcgcgtccattactattccgtaggtgactgtatcaggattcaatccttgcctcctcattttgctaaataaaagcatggcatcatctacttttccatgtttagtgtatgtgcctattaatatgttaaagatgtagtgatcaggttgaataccgtttcgtaccatcatatccaatagatgatgcatcttaacaagagatccttcagtagcatacccatgaagcagagtaccgtaggtagcactgttaggcttgtggcccctcttgaccatagagtcaaagatctttctagcttccatggatcttccattcttgcagagatagcccatcaacgtgttataagtgaatacatctggttcaacaccatccctgcacatccttttgaaaaccccaatagcgtcattgggctttcctgatgagcaatatccatgcaaaagactattgtgcgtgatgcgattaggcatagcaccattcttaaccatcctaacaaggaccacagcggccttgtccattgctcgagccttggaaagggcagagataatcgagttgtaagtcacaacatcaggcgacaacccctgatccagcatttgatcaaataggtgataagctgtgtccagctgacgaccctctctaagcaagccgttgatgactgtgttgtatgaaaccacgtcgggtgggtatcctcctctggtatcatcagccaccatcatggtgtggagcaggtggagagcttgttgactccggttttcatcacagaggcccttgagaaggatggtgtaggagaagacattgggtgtgcaacccagaacaggcattcgtcgcagcgcaatgtccattgcttcgctggtcctctttttgtcgcagagagccttgagcagaggactgaaggtgattgcttccgccgtccatccagacctaatgacacggccgagggcggcgaaagcgaggtccaagtggccgacgcggctgcagcagtcaatgacgacgctgtaggtgattaagttaggaggcaccttgggtcgggccaccatcaccatgcggcggaagagggagatggcgacggctgggctgtgacgcgcggcgtcggagagggcgcgattcaggtcgacgatgctgctggtggtgggtcggtgaagcaattcatcgaacgcgtggtgggcgtggtggctatcagtgccagcagcagccgcttcttgtcgaccttgcagcttcatgaggttgaagcgggagaccttggtgccgtccggggcgctgaggacgcggcgggacatggccgccgccgccgggccgagctagttgaaggaggagagatggcggaaattggggaggaaagatgcaagttgctcagctgctgctgctgctgctgggagagagagagagagagagagagagagagatagagcggcatgtggtgcgggaatggcggaggaaacaatcggcgacggccggcgaggaggtggccgccgactcgccgaggccggccggagttccgccacaaagttggcttttttttttccagagggtgacatgatttatatcagtaacacgtgatttgttatcaataatattgtttctcaataacttaaccgtgctcccctcatttcaaaaaactccataaacttggacttaaatctttatataatttaagcacttataggacattgatggtaatacacgatattttatgtaaaggacacgaattaagatttacctgaaaacttactctatcgctacacaagtcttatttgaattacgcgcaaaattatcctgaggctgatttaaccatcgttatatctgcggtcttaccgggactagcaaccggtctaaccgctggttcacctgtggtctaaccgccacctggtctgaccgactagacagtgtcggtctgacctcactactcgaaccaaaatccgattttagccaccgtcatttcacaaaagcaatttccctttcctttttctgtttatgggtaaattaaaataaaaaccaaccaaatgtccatcttttcaaaaaaaaaaaaagagcaagaataaatctcacaagtttatgaaaatagatggttttacaaccaaagactgtttcttgaaccattgaagaaacagaaagcaaaatcccagcagttttaaaaatcgttttctttggttcaggttttgtcaaagttttaccttttttttagttattttcaaaacaggaagttggtgatctgtaaaacaggcagtagtatcaaaacttacaccctgattgtaagtgctcattttttattaatccaaaatcgcgttaagtttctttttaccataaaaaaaaatctttccaaagaacttttcagataagaaactttttttctcaaatttgtaaaattcaactaaaacacctttgttcttgtgacacctagaacaagaaagcacatcatcagatttcacaatattctccatatgcttaacacgatctaaagcatctttcaattcatctcattcaaaaaaacactttgagcaattttagaaacaaaaacatcctgtgttgttaaccctttttgcactcaaacattacaaagatcttgcaaaaaacaactttgtattttttttcccaaacgtttttcatcaaaatcaactcatcacaacacgaatatgcaaagcaaatccaagagcaaaagaaaactccaagtttttaaatttt

SEQ ID NO: 9998 - DNA, 7616 bp, Oryza sativa
  unsure (1)..(7616): unsure at all n locations
ttttaattttcaaaatctcatattccaatttaagcaatttancggaattaacatctcgtaaagcattagttttagaaaacaaaacttcacgagatttgcaatcatcattaggaatcaaagattttaatctatcaattttagcttttagaatctcaatagtatgatcactctcatcaagcatatagaacatgtattaagtttctcagcaaacttgaaaggagcatgttctaattgatcagaattaagcttttcttcactatcactatcagattcatccacttcagaatttgcatgcgagcaacaaaagctaaatcaacaacatgcttactttgccattgctctatttttcttactctaattaattgtaatctcaagcttctatgagttctcgagttagcctctgcatgcaactctttttcttctccttcttgttgttcttcttatccacttcctcctttattgccttcttgcggttaggacaattgaacttgatgtgcttcaactctccacacccaaaagcattgaacgggtccacctcacttcctgctttttactttttcaaaagcccgagaaattatattagcaacaaaaactaagtcctcctcaccaagttcctcccgttgatcatcagacaaagcattaaaagcaaaaagagccgacataggagaagtatccaaagaagatccagatgaagacaccaaggcaacaaatttagaattattccttttcaaaagaatattcatctcataagttttcaatttttgtataaagaatattcaaagttaaagcgttcatgtcaaccgactcctggatagatgtaaattttaacattgcaaatcttcatatcaagatcattcataaagttgatgtggtttgggatcttagaatatttgcatgatgactctgggctaacttaaataaatacgagcttttctcatggttttcgaaattttctttgtgacatcttatattagttttggagaggaaactaaatgaagctatgcagaaggtgaaaacttagagggacaaatagaatataagaactgggacgccccaatccaaaagaatgaagaacaacgacttcaaagattttcgcaaaaattttaccctaaaaatctagtaagttaccgtatataatttatatatatacatataaactttgtgtatgtacgtatacaaagtttatacatatagatataaagtatgtatacacacacgtatataaacttatatatatatatatacacttttaatgtataaaaaatctctactacttaaaaaattgaaaacgtttcagttgtccgtcttaaaataataaaaaaagagcgaacaaaatcttcgcaaggtccgattccgccaccacaggaaacacgatttggattcaaaatcggaagaaattaaccccataaatgtagcgcccgttccgtcgtggcgcctagcgggaaaattatctcttaaaaaccctaattgcgaaatttgtttctttgcttgttgtctagtgtccgtgccatctcaagatctcaatccgcgatcgatcgtcgagatcaattccgaatccaattccttccaaatcgaatccctccgcaaaagtctagtttgcctcccccgggttcgatgggccgaattccgctcggcccatctcttccccggccctcccctctctctcccgggcgccccctctctctctctctctctctctcgctccctcctcccccccggcgcgttccccccctcgctgctcgcgcgtgcgagagccgcgccgagcgcctctctctccggtccgcccacgcgccgcgcgcgcgtgcgcgggagtcgcccgcgccgagcgccccctcctctcgcgcgagctccccgctcgcaaagccggccccgcgcgccgcgtggtttctcgcccgagccgcgtcgtctgcgccgtccgcgtcgcccggtcccgctgcccagccgcgccgcccgttgcttcccgcgcgcgcgtgccgagtggccgaccgcctggtcgccaccggcgtcaccctctgccgcgccagcccgcgcctgtcgcccgtgtcgtcgcgccgctccaaaccatcccaccgtcatcgccgtcgtcatcccccggcccccgccactccgcgcgcaagccgccaagaggcggaggccgagctctcccttccctctgccgcgtcgccccgctccctcctccttttcccgattcggcaaaggggcaagcccctttctctccctccttttcccctttccttcctttttcccctctcgccggcgtcacctcctgtcgccgctttggacgctagccggagcgccagctcgccggcttgaccgttcaatgtcggtttccctcgcccaaaccgacaataccgcccatttaagcccaagccctccccctccaaactctctcattttcgcctccgcgccattgccgccctctgtttcgccgtcgccgatcgtcgttgcgcgtgtcggaggagccggcacgagcaaggacacggaagaggacttcggccgcgccctcttcttcctcttccccggcccgaggccggagagattactcccgcgccgtcggcctctcgtcacatcgcctcgtcccgcacggtagtgtctccctccgttcttcctcctcgctccatctcctccccttagatttcggtagtagctcgagtagcctccccgtagttagctggcgccgccccgaccgttgccatcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcgtcgccgtttccctcttcccttgccgccggttgccgccgccgcaatccgccgccgtcgagcaacctccggcgaatccgagccgttggctcgtctcccctcgtcctgtgcagccacccggtgtgctcgctttcgccggtatcgccgtggctcgctccgccgctcgccgctgaagaggaacaatgaagaactttgaaccgcagatgcagtgcatggcatggcagtcaaactgcagaatcacaaaaggcacagaccagaaaaggatctggggagttggtggcaggtgatggggaagggatataagttctacaggatctgagcaatagaaggatggaaaaatctgaaccgttgaaagattgtaaacctgacttgaagtgaaagagcgcactacaagtataaatattcagcagggaaaattcttcttgtatgcaagaaacttggccaaagaaaaatacacgtaactccaaatacatgaagctagcaactgggaaaaaacaaagggatatgctacatgtccacataggaactgatttgtaaatgtttcaaatccagatgaatataggatagtgataaatgtttttgtttggatcatagtataaggataagagagcagtactaacatttcatagaaagctaacaaaggaaacaaaattagagaactataataggaattgggttatttttacttctccggagttcatatacagtgtaacaagagtgctcttcatacctacaatccccacataagaaacaaaaaacgatccccacagcaggcagccaggcagtatcatcaaagagcctgggatttcacacaggacgatatttttcaggataaactttatatgttgaacgtgtctcccacatgaaaccagcacaatcagcagctcagcctacgactcttcagggggaagttctcttgattaattttagagaatggagaggtaatccccagccttgcatacctgctctttgtgaagtaacttagtacagccactcttctccatatgaagaaataaatcatccaattcttctagcaacccttgttttacaacattttctatcattaaccagtaggtcacaacatttgtcactaaaccattggtcgagagagcagcaaacaaatcctcagcgtcatcatttctattctcaatctgtaaatccatcaaacacggttctgaaccattggagggaatctgaggtgcaactattttggcaaagtaccagactgattatgttgcaagtgctaaattcaaaccgtatcccacttaatcatcctgagatagagttcttttgcagctacagttcttccagcctggaataacccttgcagcagcatctcatatgtaacaatgccaggattcacacccttgccatccatctctctcaaaagagtaagtccatcctctatcctaccattttgagagtaaccattaataatggtattataggtaacgtcactaggttttaccccattgaacaccataactccaagtagtttcattgcttcatccatcttaccatctaagcaatatccatcaatgagtgtattgtatgtattagtattaggttcaatacctatgcgcaccatcaagtcaaacaagtttttggcttctataacccttccttttttgcataggttgcccattattgcattgaagaaaattgtgtcaagacagatgccgcgatcgatcatttcgaaagctagctcctcaaccttgtcccatttgtcacaggtacacaggccatgaattagggtggtaaaaacaacaatgttaggagcaagtccttcagatttgaggctgttgaattgagacaaagcatcatccactctgcctgctgtacaaagtatgtctaatactgttccatagttgactatatcagggttcaatccttgctgcctcatattgctaaatacaagcaaggcctcatctaccttgttatgtttagcatatgcgcccattatcatgttaaagatatgatgaccaagttgcatacctttcttcatcatcaaatccaaaagatcatgcatctcaacaagagctccttcagtagcatagccatgaagcagagtaccataggtagtgctatcaggcttgtgtcccctcttgaccaaagaatcaaaaatctttctagcttctgtgcttttcccattcttgcatagatagtccatcagcgcagtataagtaacgacatcgggttcaacaccatgtctgcacatctttttgaaaatcccaatggcctctttgggctttcctgaagagcaatatccatgcacaagactagtatacatgatgcaatcaggcataacaccgttcttaaccatcctagtaaagacttgtgtggccttgtccattgcttgagtcttggatagggcactgataatcgagctgtaagtcacaacatctggtgatggccctcgatccagcattgcatcaaacagggaataagctttgtccagctgaccctccctaagcaagccattgatgacagtggtatacgccaccacatcgagtgggcagcgccctttatgatcagccatgatatggagcaagtcgagagcttgttgacttgtcttgtcatcacagagacccttgagaagaatggtgtaggagaagagatctggcttgcaacctagctcgggcattcgtcgcagcacaatgtccatcgcatcgctcgtcctcctgcggtcacagaggcccttgagaagaggactgaagaggattgggctcatcctcaaccccgtcgtgatgacacggccgacggtggcgaaagcgaggtccaagcggccgaggcggcggcagcagccaatgacgatgccgtaggtggcgatattgggagccgcactggtggcgccggctctgggcatgcggttgaagagggagatggcgacggcggggctggcacgcgcgacgtcggagagggcgcggttgaggtcgaagatggaggcacggtcgcctcgcttgagcaatctgtcgaacacctggtgtgcgtccccgggctcggtcgctctctgcctccctccttgcttcgtgcgcttggccccaccccgtcctccttgcttcgtgcgcttggagctggaggccccagcccgtcccagcgcgcttccaccgccgcggactcccatggccagcctctccaactccggcgacgccgctcggccgccgccgccgcgtcgtccagagagagaggagagttctgagctggtgggctgagaaactggaatgtggggcccgcacgtcagttcccgaggagatgacccaaatgtgggcctagtgttgggccgcacagatcaccatttccggcccaattaaaggcggcccaagtaaggggagacacatctcagcacaagcaagagggaggctgcggcgccggcggaggcggaggtgagcattgcaatggcgacggtggccggcgacgatggcggcggcggcggtgagttctacctgcggtactacgtggggcacaaggggaagttcgggcacgagttcctggagttcgagttccggcccgacgggaagctccggtacgccaacaactccaactacaagaaggacaccatgatccgcaaggaggtgttcgtctccccctccgtcctccgcgaggccaccaggatcatccacgaatccgaggtcctcttctcttctcttctcttctcttctcttctccccacgtcaatcaatcattcaatctctagggtttagatggggttggtgtacatactacagattatgaaggaggatgacagcaactggccggagccagaccgcgtgggaaggcaggagctggagatcgtgatggggaacgagcacatctccttcaccacctccaagatcggctccctcgtcgacgtccagaccagcaaggaccccgagggcctccgcatcttctactacctcgtccaggtccctctacccaccctttgcctctcacaaatcactcaaggatccattgctagctagctctccatgttttacgctacttgaattggcggcgcatacataaagcgcgtatgagaggtgaaattgttaccatatgcctcatcaattgcatctcgtcttcatccattccataccagcagtgtgtaagataagattgtgtgtttaacttaatcagaattgttcacttgtagttgtgggaggtactaatggctccatgttacaatagtgctcagaagcatgaactttctgttactatacatctcgatgcataaattaacttggcattaggttcatgtcttggaactacatatagttaactatttgctgggttgatagaaaaacatccatatttgatcatgttcacctaggtagtgtttggttgctgggatgggatgggatgggatgggatgaacccatttttaggggtgtttggttcaggggtgagtgggatgggttggtccctacagaggaatattcctctcagatccgggaccaatcggtccggccaaaactggcggacgaactcgtcccacctgggacgagcgacggcgtgaaaccaccgctttgctcgcgcgctcttcctcgggagacggcggcgggctcggcgacggcggcggtgggctcggcaacggcggcggtggggggctcggcgacggcggcggtagatggctcgggcgacggtggcgccggtgggctcgacgacggcggcggcggcgggctcgacgacagcggcggcggggggctcggtggtggcggatccattggtgggagggcggcggcggtgatganctnctgcncggagggacagtcaatcaaannncaccagc

SEQ ID NO: 9999 - DNA, 3765 bp, Oryza sativa
  unsure (1)..(3765): unsure at all n locations
ncgacgtcgacatctcctagnacanacnnaatagattatattggtttgttgctgtggatgatttgggatgttgagatgtgtgaacgatatgtgatgagtgatgtgggaacacaaatatgtgatatttggcgctagaaaagaaaaaaaagaaaaaaaataacttttgtaccggttggtaacatcaaccgggactaaagatttagaatctttagtcccggttggtgttacgaaccgggactaaagatttatttttagtcccgaattcgtagtctcggttagaaaaccgggactataggggggttcccaaccgggactaaaaagcgattctccagcagtgatactgatctccgccaatcttatttggggcttagtacgtgtaagaccatttgatggtttatattttgcgatgaaaaattaacaatatatttgaaaatttggtttggaaaatcgaataaatgttggctttgagagtgtgtgtgctaataatgtgaatcatgacaatatctatatgcttgaaaacaatttgttttggttattatattggtgtgtaacttcttttggatcaaccttggtcaatggtagatcgagactaaattcatcgatgagttgagtaaggtccaaaacaattaggaatgccgggtgacaagcccatacagtggctttgagttgttggggaaaaaaagctaggagcataagagcaagtataatagtgagctataagcctactataaacttttgtggaggagagaggtaacaaaaaatcaagggagttggctctcatgcaagagctagcttaacacaatctccaagacaaatacattaaatgtataagagcaggtacaatagcatgttataagccagctacaaacatattttaaggagataaataaggagagagaagagcagcgggctataaatttgtagccagctgtagcacggactccaagacacagtgtgtgtatgacaggtggggccaggtattaatagtgtagtatgttactattgtatgaatgagctattagattggctatagatgaattggagctagtagttggctatactattaaacttgctctaagtgagagatagagagaggagaagaaaattgtagccaaccttagagaaggtacaatagcagactattagccagctacaatcatattctaatgagatatataaaagataagagagaggagcagcgagctacagatctgtagccagttgcagcacggacttcaagacacaatgagtgtatgacaggtgggaccgtatattaatagtatagtaagcaactattgtataaattggctattatattggctatagatgaattggagttagtattgggctatactattgaacttgctcttatagctaatttattatatatgttgactttaagatggactaatagtagaaagtaagctatactactatccttgctctaagtgattcctcagtttagtacagagtgcccagtagagatgctgaacagaaggtgagcaaactcacatgagtgaaaaccctactttattactccctccgccccctaatataaggatgtgtttggttggatggttttggtgggtcgggtcggggccatccctttttcggagctgtttggtttgaggattatgtgggttgggttggttccaaaaaggaatattccaccaatattcgggatgaactgaccacccaaaaacgaccggaccgatcgaacccacctctcttcctctcgcgcacgtgagttgcacgcgcctctcctgagcggtaaccctatccttcctcagcgccttttcccatcgcactttcaccatcgaaaaaaaaagaaggcggcggcggcaacgcaagaagcagcggcgaccgcgcgtgcaggagccggagcggcggcgaccgcgcgtgcaggagccgaaggcgccggcgacagcgcgtgcaggagcaagcggcggcagctcgcatcctctgtccgtcctccatcctccatcccccttggctactgcagcaacaagaggaagaagaaccagcgcctcccacctgtcgcctcctttcctcctctgtactcaactgctcatcctcgtcctcgcatcctcagtgagaaaggtaagaaaaccctagcacttgaaaccctagatcttgctgaatttgtttcctgagatgattttcccttgttgttgaaaggactaggtgaagcagttaattcacagtagatcaatttatagttgaatagatgtttgcctattgatgtggtatttttgtctatttattcacagtgattaatttctgacgtgagcaagtaatttgtgattacatgatgtgtgattgagaagagtttttgtgctttactttgattgttgtattgtagatggataagaggaccaagcttttaatttttgctgctgctgcacatattttattgtcaatgatggccattattattcaatctagaaaaagaaagagatgtgcacggagacaaggtgttaagtatggcccaatggatgaaagggatcgaatgagatttgaatacctagacacaaaaatttggaggaatgatacaacttgtatcgacatgcttagacttagaaaagattctttctttcgattttgtaagctgtttagagatcggggtttgcttgaggataccatccacatgcgtgttgaggagcaggttgctatgtttctaaatacagtgggacacaaccttagaaataggttagttcgcactaattttgataggtccggagaaacagttagtcgttatttcaacaaagtacttcatgctattggtgagctacgagatgaactaatcaggcccccctcattggacaccccaaataaaatagccgggaaccccagatgggatccttactttaaggtgtggcatttatctatctccttttcagatttttatttccaaatatatatgtggtccctaattatttatggtactgaacacaaattaggattgtattggagctattgatggtacacacattagagcctctgtccggaagaatatggagtcttcatttcgtggtaggaagtctcatgccacgcaaaatgtaatggcggccgtagattttgatcttcggttcacttatgtcttggttggttgggaggggacagcacatgatgctgtagttttaagagatgcattggaacgtgaaaatggccttcgtattccacaaggtaatagatatatttagttccatcaattttgtccatgggaaatgttaaaaggtagaaatttgatcaacttgtccctcatttgataggaaaatactacctagttgatgctggatatggagccaaacaaggattccttcctccctttcgtgctgtccggtaccacttgaatgagtgggggaataatccggtgcaaaatgagaaggagttgttcaaccttaggcactcatcccttcgaatcacggttgagcgtgcatttgggtcactaaagagaagattcaaaattcttgatgatgccactccattcttccctttcccaactcaagtagatattgtagcagcttgctgcattattcataattgggtcataaatgatgggattgatgagcttttcataggtccaaatgaaataattgaacccaatgaaacatctattggcgaagcaaatgaacatgcattgatggttcaattcaggcaagcccttgctgatcaaatgtgggaggaccgtcaaaaccatcgtggacactaatatgtagcagttctgtgtgatgnggtncgaagagntagtcatccatgacaggg

SEQ ID NO: 10000 - DNA, 11717 bp, Oryza sativa
  unsure (1)..(11717): unsure at all n locations
aggtatgatgactgctggacacnacntcatnacaagtttggatttctctcacgttgatggtatgtcacctctagaattcagtgatgtttgaactggacttaaatacttgctgggaatatttacttcgttgctgcgagtagcatctagttgatttgtttctgaatattaaagtatagatgttcatgaaacacttgttagaaacaacagtgtattacctttcacgggctgactcacatatccctttttgtagataatttcagcaattgcaggaggaataacagatttgtcttttaatgcaattggttatacttggcagatcttgaactgctttctaacggcatcatattcggtattgtttttgttcattttaacaaaaacctgattacatatgcagcctattcttgaactgttattcccagttgtttcaaattcctaaaccatgatgtagccagttttcagtatattcatttctaaagtgctccacaattattttaactaatgaactgtttttctcagcttacattacggcatgtaatggacagtgccaagcaagccaccaaatctgggaatttgaatgagttatcaatggttttactgaataatattctttcagtaccacttgggattatcctcgtgcttggtttcaatgaagtggagtacctttttgaaacgtaagcaaacttcactcgtttgttctgatgtgaacccaatagacttggtttgttctgaggttcataacgtgaacctagtagactacatgggagctgtggaatctccatttatttcacaaaaaaacctctttcatgaaagttttctttctatgcttccttaggcatgtcaatggcaagttaatggtgtctaacagaatcggtaatggtaatgacctccacacatgtcaataaggcatgtctggacactagaaacaaaaaggtgatgtataggattaaataggttgtcaactagtaatgcatcggtacttaggatccttctgaattacatgcaaacctatcttcttgttgcagccacatctcctgacaaaaccagtatttacttaatctggtggcataatgtatttacaatgtgaatgaattttcaggcctctcttaaggatgcccatgttttggatagtcattactgctagtggagttttggggcttgctatcagctttacttctatgtggtttcttcaccagtcaagtgcaacaacatataggtactgaatgaattgtagtggctttttaaaaaatgtttatcttcatgtgctctgtcttcatgaatttctaatgtcaatattgctcctgatatagtcttgtgggctcccttaataagatccctctctctattgctggaatccttctcttcaaagtgcggacgagcatggagaattctttcagcattttgtttggtaggcttttttttaataacaagggaaaaggtactatgttatagatatcacattcactaataagattcatacccattatcgtgcaggtttattggcaggagtattcttcgccagagccaaattgcttaataactctcagtcctagtcgtaggccaagctttataggttatacaaggcagaattattctagtcagtcagattcagaacaggatgctcgctcggattatgttcctgggaaatttgtgcagatgtaaagatccttctccagctaacaagaagagagattggcaacacatttgttactatggggccatggggctgcttcagttctttttcctcgaaatcagtatggaccccctgttgtcgctctcgtggttgtggtatacgtcctcactttcacttacgatcgaaaggccgataatactcaaatgcaggcagtttgggggaaaaaaaacaattgacgggtcgccgcatttgtaatgttgtgaaattgcagcggttggatcgaaatgggattggtgtttttgtgcgttgcacggctgcttggcctgctgctgtgttgagtatactgtatatacttgtgcagtttaattttgtgttgcccttccctatatgttcttctacaccgtgtagggctgaaggaaaatgcccaagctcctcatgtgcagaactcaaactcatgggatacagtgatactagtgcagaatttgaactgacctgacttgtcccaaatttcttctgattcactttattctcctggttgttctggaatttctgctctgcaaactgcctcttacatttgagaatctcagccaaatttctgccttgcaaactgctcctacatatagtctcagacactggactgaaacatgaattaagccccccaaaaaaaaggggtgaaaaaaacatttgaacctcccagcctagcacggccaacaaggccaaagcggtgagcttcagatgatcagatcttcggtctgacacactcccaatgccagcatggccccactcacgatttagagcagctagcgattcatgttaaacagattcaccgtagcacgtatagacaacacataatttgcatgcagtgaaaatgattctgtaagctcatttcttcatgaatatattctcccttttacaattgataaaacctgaactttgtgctacatacaacctgataaactaaagaatacagctaagttgtaaaatctgactgtatgatcctgaaatcctctgtattatcatcctataatggcaaaagtagacacctcattgcaagaattccagtgtctgtcacaaaaaaattccggcttctgtacacttagactcaagaatggccacaccaagatgacgagccatttctcctaaactcttcacatggcgctggaagaacatcatgtgcctctccatacacagactcgcaatgccatctatcctgacgctttatcactgtcaagctaacgtttctgaagcaaatcccttcatacaccgcaccgtgcactgcctccagcatcggtgcgcgctgtaaatccacaccgacaacgtctctgatgcgcacatcactgatctttggcagcgcacttcggtcatacttgtcatctgaatgatcatccgcacctcggctgaatcttataggcaccttgaccttctccatcctgacattctctatggtgatgttggttatgtagccacctcgtcctacatcggtttttatcctcaccgcttgcgcggaattccatacgtgcaggtcgcgaatgatgacatttgatattccaccggacatctcgctcccaaatcccacacctgagcatgttggagttgtgcctgaaaccctctggatgatgatgtttgagcttggtttccctaccgagatgccgtactgatcccagccactcttgacagcaaccagatcatctccactctcaatgtaacagtcttcaatacaaacttctgaactcgaatctgccattatacatcaatggaaaatgtcatggatagccatgcatgctcttcgcagtttgaggttttataatgaagttatcaccagtttgaagcataagtatgttctaattcaaatttgtagtgctaaaaatggcgataaagcagtatctaactacgtcagcttctaaagagcaaacaaataggaccacttcttttatcatatgaagtacagcaatcaatgatggtccagagttggaattaacattgcgtaaaagaggaacaccctctaggagcatgtacctggatcaatgccatcagtgtttggagcattcaagggagctagtacagttaagttccttatcaccacgtttctgaaagaaaaaaaaacaacatgttcactttatatgattccaatataatgaatatcaagagggcaagtgcaattgtttattcgctgtacaaacataacaaactgacctgcagtagacgggatgcactgtccaaaacggggagttgcgtagagtgatattggagatcatgatgttggttgagtccactagctcaataagatggcctcttgtgtggttcaacgttcgattccaccataggtcccaccaaatcctgccttggccatctatggtcccattgttacctaacatgtgttttcgaaaactgattacctaacatgtaaaggggggcacatgcaagttacaagtcaacgctagttcttcacatgtatgatatgctatacctctaaacataataatgttttatgtaattatgtttatgttgtcattataatgacttaattcagcacatacaactttgctaattgatcagaactgaaatagacatagctaataaaacaacttctgtacccgtaataacaacatcatccaggccctctccatggatgaggctgatgtggcgtggtcctaatctttcccgcccacgcccatacgacggcaatggggctatgagaggccattcttccggatcctgtacattacagtccaaagcaccagtcaatgctatgcagatttccattcaacatatgcaacactatgaagtgctggagactgttcttcttaaataccaatacaaataatttaatcaagaatctagggtatggtccccctaccccgtcaagattgattgttcttcctgctttcatgttggtatcattatgagtagaacgatctacactacttttttattcatgcatctgtcttctgtgcgattgatgatcgttcgattgcctttggttccacccaattcccataagaaactatatggcgcgatggttcgggaactggcattagacttaagtaaaatgctaggctgcaattttcagttggttcactcactccaactgaccagttttcacttttcacagtaagttgttcttggttctacaacaagcatttgaatggtgttttttttttttgccaaaaagactaattggacacctggccatgattgtattagaatattaaggtgattctgctgtgagtgcaagtggcatcatgtcaaaggcatagcatctaattaaagcccttaattactgttactaatttatggcctctatcccaacaactttctgcctcaaacatgaatgcagcactccgtacccccatacgccatacgagggaatccatggagcaaattctactccctactactacaaggtagaagtagtagcaaccaattgcatgaacaccactctacaattaatttataggcaccaaaaatgtggaatatttagttcctgtaggaagctccaaacaagcactgcagaattgtctacaaatcttttagcataagcagataaagacggcagaagaagcaaagtacaaaagcagaatcagggtgtggtcagtccaagcagcagtaaggacaaagcaaaggcacatgagagtagaataacattttggtaggctgcctggtagtggtagcagaagccacaagaaaccagacagtccaagcatgtgattccaacccacccatgtcctctctctcatgtttcaatgaaccattggcatgtgagatgagagatgtgacaacacacaaccgctgagccaagtttcacaatgcaaagtacagatgatacaatccagcaagaacaggaaccagcctagtaactgatatcctaatgctgtacttagagatttttttccagtgcaaatattaatttcacttcgcatatcaacatgattatccacaatcggatgaacagaatcaggatttgatttccatatatgcttaagtcaacgaactcttgttgcaactgctagaagccatggatcataaactaataaagaaaaaaaaagaaatcgaagggaaaaagaaaacgaaaaagggaagatgaattgatggatcacctgggagccgaggatgattgcaccgtggtgcaggaagagcgtgaagcggctggtgaggttaaagctccccgtgacccacctccccggcggcacctccagcctcgcgccgccgcctcccgccctcgcctccagcgccgccaccgcgcgccggaacgccgccgtgttggacgtgaccccgtcccccacggccccgaactcctccaccgacgccgacgccgcgcgccgccccgacgaccccccgcggtagaaccccgcgcagctgtccctgtccctgtccccgtcgacgcgtgcagtagcaggggcgacgagggcggcgagcggcgcggcggcggggaggcgggtgagggcgaggtaggaggaggcgaggaggagggcggcggcggcgacggggaggaggcgcgggcgcgggctgggcgtgggctgatgggcggtggcgtgaggaagcatcgcgtcgcatcaatggcgccgcgcgcgcatgtggcgggcgcgccgaggccaacacgaaagacaaagctaagctaggggaagaggacacaaaagctttttttttttttcaaacgactctagtgcaaaaatttagagactatagtagtatatcaacaaaatgtggatcataaacattttaaatcttatgagaatttcttgggatttgaattagttctatatgggatagtttcctagatgaaatttgtatgattagaatggtccgacccagtattaatatagcagaacctccgacctatagtatatgagtaaatttttatttgtgtttatgtctctcttaaaaagtattatacccctccatcagtgtgttctacaaaatgttattaataaaaacatagataatattgcttattctttagaaaggtcaatgtgggagagattcaccatacgaattgtctcatttgataagggaaatgtgagcaagagagagaattgttgttactagcacgacacaacacatggtgttcgttagttgcatttgtttagcgcacgagaagtcaaggatgcatcctcaacacagatatgtagagcataataccttgtatcgatgcgaattcgtttcttaagaccacattgtacccgtggttccatagctaccaaaaacaaaccatgaagaaagcatggaaactatagtgagggttcagggtgcctccatcctccctaattcttccacatgcatcgtggaggagagatgcggataacgatccacataagtaacactcaatttttttaaaaaaatattggctttccttagataccttacttgaacagatggattattatttttatgtagagaatccaaacaacatattagttatttataaattttaccatcgctaagatttatctagacatggtgtcattcgatatcattaaacactgcctgcacggttttgcctgatctagacttgattttgattttagagtaaattgtattggcggtacacaaacttgttaggtgggtgcaatttagtacataaatttataaaatgttcgtttcagtacacgaacttgtctagtttatgcgaacgaggaccagaataacttggaaatattaattttatgaagctgacgttgattaggatctaacgtgcgtacgtttagtgagtatacacaagaaatgctatatttataaatttggtctctactttatccttcatcatggaaatgatgaatttcatatatttctaacccttatatcatttcttgaattttttttaatccttttctcctatcactatatactattctattttttattgaagatgtgtatatctaatagcaaccttctcatatatatatatatatgtctatatagtatcctaatctgcttctaaatctaagattagacatgtagtgtccttttcgtcttcttccacatgcaccagacaagttcatgcaccaaaacgagcattttgcaagttcgtgcactaaattgcacccacctgacaagttcgtgtaccggcactgcaatttactcttgattttagattttgctaaaatagacattatattcattaaaaaatttgcaatgttggttatatttaactattagagccatattataattattgtgtcttttaaagatttcaagaacagactcataatatatgatttgttgcttcttcgatgtatgccttctggaacagagttaatatctaagataagaagaaacatgttactactagattttaaagaaatgtgggtacaaaaaaggaatggttgcaatgagaatggatgctactcgatagtggccactttgccgcgcatctcatttttagttggacacgggtggctagcgcgatcgtgtgtgtcggcggatggctagtttatctcaaatagcagttgtaagattacaagctctcaattcatatatttataaacaaaagatcaattatgtcatcgcatcttggttagaaaaaaaaacaaatgattgattttcgtatgcaccgatcggtcattgaatattgaaaattatatatgtgttgtgtaggtaattagcagcaaccagcttgtaaagcgagagaattgaagtgagggaaggaaattcgctttccttgtacggatggaccgacggaggaagaagaagggaaagcaagtcagttgtagaaatgggccgtgaaaggccaggagaaaaggcccaaccatcccgagcacctaacaattaattgggctggacggcctgcttcgggagaaagttgggcctcccctatctggcccatccagtatattggtagtatatgtacatgttgggccggcgtctcttgtttttctgtgggatccttttctgtgtgtttctgttcggaataagttcactttgactccctaaagtgacccgaatctaatccatgaccctaaaccgcaagaccggatatctggacccccaaactattgaaaccgatgcaatttgactcccttggcggttttggagagcggcttctctaacgtggcgctgacgcggtggtgttgacctagtctgtgtgctgacgtggcgcttaggtgacatttcaattaaaaacatatatgtgggacccgtttgttattcacacacacaaaattgtgggtcccactgacatgtgggttccacatgtcatcctctccctttcttcttcctcccctcctcctcccttctctctttctttctccctctccccttcggccgtccgccgggagcaagcggcggcgggcgggagctgaagcggtggcggcgggacgagagaacgcgaacacggggaacgccgccgagctgaagtggtgctgcctcgccgattgccacacggccaatcgaacagtgtgggcgcgggcgcgagttatcggagtgaccatttcgtgcgtcgatttgacatgcctttgttgctgttgatttgaccaaacgttgaaggaacaattatagatttaccacttattctaatcggtaccgtaaagacaataactgtaacttaaaaaaaaagcaaacataccattaaaattattattcgagtggcatctttataaaattaaaaaaaatcagtgacagatttacaaatgtccctattattttactggagtagttagtataatttttaatttattttttttaaaaagaaacaggacctgttggttcgttcgttggtctgtgtcttgttgtctgaagcctcaagcagaggagagagagagagagaggcagcgaccgacgaggcaccctccctgacttgaccaaatcaaccatcgtctcaattcgacaccacacggagacgaccattctcttggtctctcccccaaattccaattccaatttcatcatcttcttcgtctacctccagctcgcctcgcttcccccaccaattgcttacgtacgactactcctccacgccccaaatccaaaattccccaatccgatctctcgcctaccaccaagctcatctcgtttcgttagctacctaccaaattaataagggtagctacagacagcgtagcggacgaggaatccaaatcaaatccaatcctcaatcgaagaaatggagtgcgagccggaggagctgcaattcctgggcatggtgggtatctacagggaggcggcgtccatcctgcgcgcccaccggccgctcttcgcccgcatcgccgccgccttcgtcctcccgctctccctcctcttcctcctccacatcgccatctcccacgccctcttctcccacatcgactccgacgactccgccctcgactccgccgccccgggcacccccgcccagcgccgcctcctccaccgcctcgccgacgactggctcgccctcctcctcttcaaggccgcctacctcctcgccctcctcctcttctccctcctctccaccgccgccgccgtcttctccgtcgcctccgtctactccgccaagcacgacgccctctccttccccagggtcctctccgtcgtcccccgcgtctggcgccgcctcgccgccaccttcctcgccgccttcctcctcctcttcgcctaccacctcctcttcgtcgccgtcttcgtcgccctcctcgtcgccgccgactccggatcgggcctcgccgcgctgctcgccttcctcctcgccctcgcctacatcgcgggcctcgtctacctcagcgtcgtctggcacctcgccagcgtcgtctccgtcctcgaggactacaagggattcgaggccatgcgcaagagcaaggcgctcatacagggcaagctctggaccgcctccgccatcttcttcgtcctcaacgtcgtcttcatcgtcgtcgaggtcgccttccgggcgtgggtggtgcgcggggccacccacggcctcgcgccggctcaaggctcctcctgggcctcgccatgctcgccgcgctctgcgctgtcgtgatgctggcgctcgtggtgcagacggtggtgtacctggtgtgcaagagctaccaccacgagagcatcgacaagagcaacctctccgaccacctcgaggtctacctcggcgagtacgtcccgctcaaggccagcgacgtccagatggagcaattcaacctctgatcatcaaccctccgctccatccgatccgatcgctgtgagttgcgcttggattatatctctgtaatcatcatatttttattctcatcaacacagatactcataccacaaaaacacagtttgggatggctcaaaatcaggctggatctcaattgggagaataacctgtcagctgtatttgtaccagtagacattaaaggttgtgtattgcattttctgttttgatcgaattcaatcccaaaaagcaacaacaaagtatactagtgcaaattagaacaacaaaggctagctacgttgattcaacggtttcttagctgtgaaaacatgatcatgcattcatgctaagctttggataattcagtgcgctcctgtattactagtacactactatcatttgaaggttatgcaatcaatgttctgatactagttgtgcagtaacaaagtttaagttgcttttacccatatgattgagtcgaatgcttcatctcgtgaattgcactaactgggaaataatcgtcattaactggtgctgggaagatcctcgatgcatttttcagtgtgatattgtttttttttctctcaccaatttgcttcagtattcagaagctctaaagtcatgcggatggcacactatactacacacatatggcaccattgcttctaaatgaacatgctccatgcattaagtggccttccatggataattcggcattagattatttgccagacgcaaatagttttatgcaaactgaaggcgctaggtttattagctatttagcttaaataaactccgtttgaaaattatcaagagtaaaatgtaaaaataattggttgccattggacaactattcttctaactctaatccttcgcctgaagtgcacttgnatatctctctctataatcaatataatctaactttcacacagatacttctaccacaaaaaaaaacatttgggaatgttaaaaaacccggtgggt

SEQ ID NO: 10001 - DNA, 5858 bp, Oryza sativa
  unsure (1)..(5858): unsure at all n locations
cgcgtatgaatgcatgactgcccaccncancannattagctatttagctcaataaactcgcgtttgaaagttatcaggagtaaatgtcaaaataattggttcgccatggagcacttatccttctaactctaatcctcgccgtgagttgcacttggattctctctctataatcatcatatcttactctcaacacagatactcgtaccacagaaaagacagtttgggatggttaaaaatccggttgggtctcaattgggagaataaccgtcacgccattagaggttgtgtattacatttgctattttgatcgaattcaatccccaaaagcaaccacaaagtatactagtgcaaattagaacaacaaaggctagctatgctgattcaacggtttcttagcggtgcaaacatgatcatgcatttatgctaagctttggagctgtggggtgtgaatgatactgatcattatcttctattctgtggataattcagtgcactcctgtattagtatactatcatttgaagatttctgcaatcaatgtactaatattaattgtgcaataacaaagtttaagctgcctttgcccatactcttgtatgattgagttgaatgcttcatctcatgaattgcactaactggaaaatagccgtctttaactggtgctgggaacatccttaatgcatttcttattgtgatagtgtttttttctcatcaatttactccagttttcagaagctctgaagtcctgccaatggtacactacgtacgatacgtacatatggcacttctctgcttctaaaatgagcatgctccatgcattaggtggccttccatggaagatttggcattagattatttgccggatgcaagtagttctatgtaactggaaagacgctaagctttattagctcaataaacttgagttcgacaattatcaggagtaagcacgtgtcaaaataattggtttgccatggagcacttacccttctaactgcacattactaaatggtaagaggctactccatctgggagttgaggggcaatacggaattatttgatcgtgtagtagtagtagtgcaatcaaaagagctatttaccccccaaattcttgtgcgttttggagtgaattgaataattcctgtcatgagtcttactggttggcctggccatataatctggtgcttattaattttatcccatgttattagttccttaaattacatgtcatagccagaacttgctatattttgggacataagtagtatgcatgacgtgcaggagcaaagcatttatttgcggaagagggcatatatcgcttggtacaagttaagtatgcacggcctgctatatatagcttgctaaaatgctaataatacaaattcaagagcacaactttggttccgaagcactaccttaaacattaagcataacaccatgtgcacaaaattaaagatgatttgattctggggagtttgagatagattcaaaacaggactctttgaatcaccgaacaccggcccatgccctgatgcattttattggcctggagctctgaaatcttcccatcggtgaacttgtttattccaagtcgtctgcgggacagaccatctctgatagcttccttgttagctcgatctgtccacaaggagcacacgtcgatctcttgaagatttcgaagcgctcaaccatctcagccagcatggtcacgcttctggttgaagagaagccttgcaccactgctcatacaaggcccacagggaatcatctgaagcaaaggtccttctcttctgccacaaacatcaccttacctacagggcatacaggcagaggtggatcatactacaaagtaactagcaaagtgctcgtattttgttacgggattagaagaaaaaaaagaagaagaagttggtattgtatgttcccatgaaaaatttatatcgcttcatcattctattccttaagatcaatccaataatataatcgtaaaggaattaattaaagaggaagcagatcgattaccatgggcgtcgatgtgggaggataggcccctcctgaaggaggagatgatcgaggggaatcggatccgatttgcaccgcctgaagccgcaggacgtaggaggagcaaagacgccatcagcaacacctgacctagcaccgccaatgtcgacaggatctggatattgcggcgtgattggggatttgtgatctcggcaactcgcgggctcccatcggatggcctaataagccaaagaaaaagcctaattttaaattttcaaacttaattttaagattgattttgagatatttttaatgtagttttttttgggtgaatagccaattcagtccttcaacttttgctcaggggttgaattagtccttgatgttttataatgtccaaacaaagaccctaaagattatcatgcggcttaatatagttcttagacccacttaaaacgccacgtgtacatgccacgtcattcgtgcatgtaaaataatatttaaatgtccattttaacatttaattttctatcaaataaagaaaagaaaaacaagaagaagcaatcataaaacaaagaaaaatgtcaattttttagctatcaatgctacatatttttgccaatggccaaaaacttttttttgtgtgttttctcaatagtttttctttatttcctatgaaaacgtaagggtgtaaatgacatttaaatattgaatttgcatgcatagatgatgtgacatgtacacatggcatgtttagagggactaaggactatattgaatcacacaatgaacttaaggtacttgtttggacaatatgaaatgtcagggactaaattgatccttaagcgaaaggtcaaggatcatgttgggtattcaccccttttttttagtattggcttttaaatcaccaagaacatatacataaaaatttttacctataaattcatttttattcccttataagccgttttgatttattaggaaaaaagccaaacgatgaggcctgcggtttctccccttttctaaaaaaaaattggcaacaatatatatattcatcctctatgggtttcctaaactgaatgtagaaagtgaaaatatatatactgatgtacctccgatccaagaaaagtctaaaactgattctctataatcaaaaggtgggccctccgttaaaccacaaccgaaactcgataaaccacaatcaactgtttccgcaattggagttacattatgagggacactataaattttgaggtgaaggatgtcaactgtgattgatattaccgagcaatttacactgcgattgttattgtacagaggtcgtactgtattctcgagtcacgatgataatcaattggataggtaatcttcgttgggacttaattgggacgaaccatcagctgtacttgtacctgtagcctgtggttgtgtattcaattttttgttttgattgaattcccccaaaagcaacaaaatatactagtgcaaactgcaaagtagtttaaggtaagctgtcttgattcaacagttctttgcaatacaaacatgattatgcaattggattgatgttagtattccatggaaaatctggatcagctttggggtgtggatgacaatcatcatcaacatatcatctgctctggatgggcgatatgatgtcatggatattcagtacactccagtgttgtgcaatcaatgtactaacagtagttgtgcaataactaagttacgctgcctttgccatgcatactcttgtctgattgagttgaaatgcttcatgtcatgaattgcattcattggggtaatagttgtctttaactggtgctggaagatccataatgcatttgttttattgcgatatttgggattttctctcatcaatttactcctgtgtttagaagctcaaaaattatgtgaatgatatacacatgtatgttaccattgcttctaaatgaacatgctccatgcagcatgtgatgtgaccctccatggaaaattcggcatttgattatttgttggatgcaaataattttatgtaactgcaaagacttgtctgtgcaaattatcaagagtaaatgtcaaaataaatggttcaccaaggggcaccagatttaattaggagaataatcatcagctgccactagtgtgcttataattttaagtcactaatttgggatggttaatcatggttgggacttaattggtaaaataatcatcaactgtacttgtacctttagccagtagaggttatgccaatcgaagattctgcactgaatgttgtagtagcagtaatagtgcaactagaagggttaagatttacccccaaactccttgtatgttttaatgattcatgtcatgaatctcacttgttggtcttacaaatctgctgttgattaatttaatccagttttagccaccttaaattacatgattggtacaatacttatctcaccattgttatttctgaattgaatgagtatgctgattactgcaggcagatcattctgctttagatcccaggaaggcgtctaaggaaagatgctttatttgaggatggctgctgatttgtgtgtgcacaagaggcggatgtaggagatatcatgactgtggaaacacaggtcattaatgttaggtcggtgaatgtagaaaagaaaagttggtgcattattatagtatatatagactccctttttatgatggtttgctggttcatctagaaagagcgtaatgcaaggatcttcgaacaacgttcgtactcagtggcacgggtgtataatgatataagggaggaaatcatcatttggaaggaagcaaggatttttcgagagtgtgattaatggaaacccttgccctgtctttgtctttttgggctgatatcggtttggttgtcaccccgccttgacagcttaatgtctatcttgtaaacactagtaaacctccttttcctcttaataaaatttggtcgggaaaaaaataatagtatagaagaaaagatgaagatgagtattatcaatccaatgaaggaaaccatacatatgaaaccaataaaacgaaaagagggacaagtatttatagtcagctgtagaaatcagacttgcttgacaaatttgaaggaaggccggttggggtttgctccagtgatttccctgaacgcacgctccatggcgtcccatggataagttgctttcagctcctcatcccggaggtatatctccacgcagatgctttggaggctcaggaggtgctgcataccctccggtgttacgtgaatgcccgactcacaattccggaaccacagatggaggctttggagcttgggcatcacccctgcctggaactgcagccttgaggcaacgtgttcacccacacgcagcttgagtttcaggagagcagggaataatgannnnnnnnnnnnnnnnnnnnnnnnnnnnnctcttgtcttgagtcctactctcagctcgaggtcggcgagggagggtagttcaccaagaaggtcaacctcgctactcgatgtctccgatacctccagcaacacatgttggaggttacggagagtaccgttgatccatcgaggtactttggagaagcaccaaccgtgtagtattagtctctcgatactttgaggaaaaatgggtaatgagcccagcaggtcaacatcacctaaggtagcaggtgggacatgaatttgcaaactcctgagttcatccagttttccaatggaagaccccagagcataaaggctaaggatctcatcgtcccgccacctgttaacagagatgtttaggtcccttagatttttcagctcaccaatggcctccatgccttgataagntngatcagcaagtcactcactcattttttt

SEQ ID NO: 10002 - DNA, 3754 bp, Oryza sativa
  unsure (1)..(3754): unsure at all n locations
cgtgttgttgcgcctcttttggaannaccatctccaaagtttagcccacatattttgctggggagatctatctcacaaccaggcgtctccactctcaaatacctcaattgaagcacatggctaatggcagtgaggtcgacttgaccgccatggccttccaattcgatgtgcaccacccgtatatacttggatagcatcagaaatgggagcccacgtgaacactcaccaaacactgaaactgatcgagcacgagccatgcttgtagaaatgacgctgccctcaattgcgcaatctgatcttgcagccttgcactgcagggatagccgacggaccttattgcaactccgctcatggtgcatagccatgcgcatgtagtctttacaactgtgtgcaacgctgacaaaattatcttctgcacacttgatgaggatcagatcaagcatcatatcatgcaccttgcaactcaacacctccccaccatagccggtgctctctggttgaatcaagcccctgttgataagctcactgaagtagccattaccagtagcctccaagttttccccatgagggttacccataataccttcagctatccactccgtaactagttcatccctcccgatctcatagtcctctggatatttaccaatatataggaggcatgttttgagatgaagaggaagattcttgtaactcaggtttaaaatattcctcatgccttccaagctcttgtttttgtcaaacggggcacccaaagaatcccgtatgctcttccattcttccattgttcttggtcgacaggctaagaggctccctacagtaacaattgcaagtggcaagccactacacttctttaagatttcagttgaaatttcttcatactgcaggacacaactatcttcaggcctaaatactctatcgaagaataactttcttgagtccttattgttcagaggctgtattttgtaaatttgtccatccttgccacatgccaacctggccacatctttcactcgtgtggttactatcactctgctacctttgccattgtttggaaaggcacaactaataataacccatgcttcttgtttccacaggtcatcgactataataatatacctgccaattttttgtttcaaatattatatttacatgcaccactttaagatgtgttataaatgaaacattagagcaatatatcctttacaaaataaagtaaatctatccaagctgataatgtgtggataatgctagaaaagcatcactgaaatctccgtcgatatcaaattcagaatatgccataggcgatccaatatactccctcgatctggttgatattataagacgttttgacttttttccttgtcaagctactttaggtttcaccaacttgataggaaaatatagtactaactccgtcccagaatataatgagttttagagttggacatggttattaagaaagtaggtagaattaaatggtgaaagattgtgattggttgagaagtggaggtaggtgggaaattgaatggtggagggttatgatgggttgagaagagaatgttggtggaaaagttgttatattttgggacgaattctaaaggctaaaagttgttatattttgggacggagtgagtagcatttttaacacaaaacaaagatattatcatattatatttaataaaactaatttgttttgaagttgttgctaatattttctacaaactcggtccaattttaaaaaaagtttgtatacagtatgtataacccaaattatctgtatgagagttgtatgaggaataattagcccataaatatatttttattatatttatagaatatatttttttgttcctggaggaacctttattttacaatagtttcaatttattttggtttaatataggcaaatgttcaacctgaaacttttacttataaaataattttttttgtacttggaagaatcataattactaaaactttcaataggattttattgaggttgaggatttactgcggggctctcgtctatttgatcatgtgttaaggactctgcataatccattataatatatgttcggctttccttttttagtttaacattgttgaaatttgtaataataagtatgtagtcacatttgtgtgttgagtcttaattttagtatacttctgaatataacaactctaaaattcaaaattaataaatactgagttgtactactccctccgtcccataatatagcaatctagtatcagacgtgacatttcatagtacaatgaatctatacaacctcctgtccagattcgttgtactataaaatgtcccatctggtactaggttgctatattatgggacgaagggagtacattgttttgagtctcagtatacgaagtagttcctttttccatgatctaataatttcaatattccataattaagtaatgcatactgagttgcatgtactcggttagagtctcaatgatagacattatttaacatttggaaattccaaaataataataagttggttgtgtttggcagtgttttttcccttttgtaattgaataacctgttaactaaaaactaaaacctaaaaaccatagagttcacgcggtattaacaagatgcatgttttattgaagacaaatcctcaatatgatttacacaatcatagcaataccattgatgtacctaacgagcggtcatatatttttggttaattaacatagacatatatggcagatacagatatagattgaacatgacttgattagtacatgcaagtgaagtgaaattacgtagataaatattaattacctttcatgctccagataggctcgtatgtcgtcgatgagttgttgcacgtcgtcgcaagcttgagacgtgccccctatgtcaagcttggattggatgctactgaggatccttgttatgtcaggtttgtgggatactgagacgaatgccgtgcaatcgaattgatgcccgatcttgtcgtacacatattttgcaagagttgttttaccgagacctccaaatcccacgacggacaccactttgagttgtcgttgatcggtatcacgatctaacgacaacagctggattagttcttggcttgggccatcaatacccacaagactcccggcattttggtagagcgatgttatccgtggatctatagcaggattggcagaaacaccatgtttgttgttacagtcatcaagcctgtatctcacgcgacgctcatttgcctcgaccacacgagccttgagctcattgatctggctggctatgcgatgacgcacccgcaatgccctgagacggcgagctatcttgcggattaaccctgcatctgaggaagagtaacgatgatcaagatgacttgtgaagtaatcatcaatgcagtcttccatgtcataggccatctccctgacgtggttcctccagtccttggccagaggatcgagctcaccatcatcatcatcatccatgagcgcgagcttctcgaggaaagcgctcatggtggtgagctcatccttgaggaaggagacctgcttcctgagccccttgagcttcttgtactcgtcgcccatgagcgtggtgagctttgccatcagcgggttcatcacccccatggatgcactcaccaccatcttaatttctttggtctctctgctggctgatcgatcgggttaatttcctctcctggttgatgaantnctgtnccatctcgaaggtcntcatcctacacaggcg

SEQ ID NO: 10003 - DNA, 1350 bp, Oryza sativa
  unsure (1)..(1350): unsure at all n locations
cgtaggtagacnnnctcttcaanaccncatcatttcctctcctggtttgatcaggcagtacctagctagtggctagtgtgaccttacgtacgtgtgagaggtagctagctactccagctacaacaagcctgcaactgggcaaccgatcgagttttcctgtatatatatactatatacaattagccccaattagtgcagccatttgttgggggcaaacatttttcttcccttgagatttgcgcaaccactagttaaatagagagattacagtaatgatcttactagcttcgagatccacgccgactctctctcgttctcaaattgatcatcatataataattttggtaaattgatcatcatataaccgcatgaacacggatttcatcggaatacaattgatgtagcaaggaggatgtagttggtatgatattttaatcgatgcatgtattgtgagataatatgtgtatggtgtcttgattgatgcgatttaaattagcgttggtctgggtgcataaacatgtaagacgatcaatttagaatggagtgactagtttagagcaagtactataagcatccagacacaatgatgtataaagttaacggtatgatatattttaaaaaaaatgaaggtagttttacttgctcttgcagttcttgcgatacattcgtcgatacgtccagtgctttgatccgttcgcgggaatcctggagtaagatcgatcaatctgctgtctctaggattcgttctgatgagctggctgtttcctgcatatgcatcccactatctcagcccccaagtccatcccaaccaatatgcatgagctggctctatgcagttggctatattgttacaaaaaacttgctcaaaccaatccggccatgatgtatatgtgtccctcccgaccatactcacctaccatagtaccatgtcatgtgccctgcaacttcagcatcttacacattattaagtatatacactggtggagaaaccatctttggtcggttgaccaaaaacaacaatagtcccggatgcttaaaaaactgggactaaaaagcagtttaaaagtgcaatgatctttagtcccggttagtgttaccaaccgggactaaagatcatcttttgtcccggtttatttattggcacgacgtggcaggtttcctaatatttttaatcccggttagtcccggttgtttataccaaccgggacaacaaatcagtttcccacgtatctctctcttcccttgttctctccgcgcgcagagtagtcagtactcagtcctcacccttatctcttcctcccctccactctttatgagtgnggtaccaaccagtagtacatcatgcccatc

SEQ ID NO: 10004 - DNA, 1457 bp, Oryza sativa
  unsure (1)..(1457): unsure at all n locations
ccgtgttggaatgcatgtcngcctnagcncancannngtatggacttgttggctgatttgtatggacttgtttgctgatggtcatttgaatggatgagctagttggttgaatttaatttgtatggttaaatatgctgttgatggtcatttttcttcactttatgtgtgaatttcatttaaatggacaacttgtttgctgaaaggtatttttatggtcattggtttattatttctgtaccatatcatgcttgctgaacttaattttcatttctaaatattatggcttgtaggaaatggatagcaaaggaaagggaggaagcaaccatgcttcatggacatatgcaatgtcctctttcatgttgtctcatctagccaatcttgtggctagtgggacgaggacttcttctggcttcaaacaggcccatctcaacgcatgtgcgagggctctcaatgagatgttttgtactaattttaccggtgatcagattaagaatcacttgaaaacatggcaaaagaagttcacaaagatgaacaggcttaggaaagtgagtgctgctggttgggatgaagttaattttgttattactcttgatgctgagcactacaatgaatatatcaaggtataaacactcctgttccatgaaaatttctacagacttttcatttttgttgcaagcacttattttgttaaatatgttacatgataggatcacaagaccgatgctgagttttttaacaaacctcttctgcactatggtgagatgcttacaatctttgggagcacaatggctacaggaaagtttgcaaaggactcaagttcagttcttggtactgaagatgtagaaactgaaaacgaagaggtgaatcgtgctccaactactattgatcttgatgctgaaacttcatctgcaagcaagccaaagaaggccaaaacatctgaaagtgaagatgatgggttgattagggcaatcaccaatgtgggtgacaagcttgctgctgctatagtgaaggctggtgagccagataatacgctaccggtaggtttatttgacaccctgaaaagccttcctggttttcaggacatccacatatcattttactatgcttatttggtggctaaccctcacattgctagagctttcgatggacttccattcgaaaacaagctacattgggttgctatgttcattagtgacaagtttcctggatcaatgtanggtggttggatgagttatctagttcttttgctattatgaatgtgctgccagtgggtggacattacttgtaaggcttgaacttgtagggaacttatgtgtggcttctatgcttgcaatgccactatggttggactgctatgtgtaagaattcaatgggctactaactcattatttgtgttggaaccttctatgtgtggattgatgtatgctatttatgtgtgattggttctggtctgggtn

SEQ ID NO: 10005 - DNA, 3494 bp, Oryza sativa
  unsure (1)..(3494): unsure at all n locations
cgatgtgnnaatgctctacncactggtacagtagttcatcatatttttcttcaacttaaattatgatttaatggatgcatgtgttatatggtatgaaaagataacatggtttggagagccatatattttgctgtaatcgaaagttcagaattgttgatcttcttgtgttgatcatggcttgaatggatgcatgtgtcaaatggtcaactttcctgtgttgatattggtttgcagtaataagaagttcaggagtgcagtaataagaagttcaagagtgcacgtcattgataatcttgtgttgagcaatgttccttttttttataatatgagcaatccttttgcttattcagttcaagcacaaataaatttattttcgcttcaccatgagttctacattttattttctaatatagtgatatgaattgttagtgtggtattcatggataagaactaattgcatatgtgagaggtaacctcaccaagaggtatccctatctaaacaacccaccttcatccctctatccaaacaagggatcgagccatttcaacccatcatatccctcaaaccaaacaagaaacagggttcgctctgtccctccaaccaaacagaaactaggtccatcccatcccaaaaaaagaagaatggacctaacccatcccaccacatcctcaaaccaaacacatcctaagggattttgatattttgtttgcactgtttgaccattcatattattcaaaaaaatttagaattgttatttattttatttgtgacttactttattacccaaagtactttaagcacaactttttgttttttatatttgcacaaattttttgaataagatgagtggccaaacagtgcaagcaaagtgtcaaaatcccttatattaggggatggagggagtagttatcactatgatttctcgctcttctcgatacatccgagtgatagactttaaaggtatggaaaacatgccttacaatgttctgatcgtgccttgggattacaactgataagtaaatgcttcttattcaaccaatgaaggcaggtagggcttttctttctttgtttaggattggcaaaaggatagcagcttcagtttcaaagttgttagagaatgcactcttatcactagagagacgcgagagaaatttcttgaagggggtattagagggatagggcattacaccttatgctgggattagcaaagagaagcacttgacgatgtcttagggttagccttagggcgtaaacccacgacacaattataagtgccaaggtccaaattagacttggactagatgagttatgtgacttgttttgcagaatcccaacaacccaataggaatgttgacgtgagactaaaaccatctgaaagtagactacataagttttccaaaaatactcataagctccaagattccttctagattagtagttaggtccgcttgaagttaatgttaacaggaggcccgaatccgaatccaaaacgtgtaaaatttcatctctcatcttttgtggatcaaaagtgacgtggtgacatgggagtagacaaggggaaggatattggttggtccccaatctacttcacaacttctttgatcatccaagtattctttgtgcttagtctctttctccatacccaagtaagtacttctgtaaacgagaatacacaaaattcgtagtgcaataatgtttgttcaattatataacatgtaaatctaacatataaatcatgcacctttacttgatgaatacataaggtagctatggttatatccatggtggtgatgtctccatcaccattcataagagaaagagccactacaatatcccccgaaaagacgactataagggtaaacttaattaaaaggaaggttgaggtacaaattccatttgttgggtcttatcttatcagaaatataatttttatgggacaaactttgaatcgtagaaatgtaattattatgggacgtaggtagtagtatcaaattgacttccctggttcagagtgatttttaatacacacgaaaggagtactacatccacgcaaaaagaaaaaaaaatattaaaattgtataaacctctctgaagattaattagaccacacaacaaattttggaacaaaaagtttcagctgctacatatccatcctaatcctattagatattaataagctatataagagccaagtacctcttatgctgcagagattctcttaggctgtcgatgaggtccttcatactgcaggagtgagaagacttttgccgcccaatttgtaaaattatgctgatgagaagagctgtcatatcaggtctttgggaaactgatacaaatgccttacagtcgaacttccctccaatatcacggtacacttccttgacaagtgtggttttacctaaacctccaagtcccacaacagataccacattcctttcttgttcatcacccattaaccatttgataaggttcgcctttgggtcatgaatacccacaaggctggatgtctccgtgtagagtgcggacagtcgaggatcaatgggaacaacagaagtagggacacaattgtcggcatgtaccttatgcgccgtttattcgcctccaatactcgagccttaatctcttggatttggttgccctcagtgtgttgagacggtgagcagtcttgtgaagaaaacttggcttggctcctttatgatctgatactgcgcggtgcatgaagtcatcgatgcagtcctcaatatcggagaccatctccctgatatggttcctccaatctcatccctatcggctagctcctcaagtagcgcattcatggtgctcagctcactgttgagaaaaactatctcctttctcacgcctttgagcttcttgtactcatctcccatcagtgtggctaacttggcgagtagggggttcatcgcccccttggaagcggtcaccacaatctcagacataccgtagatgctagccctccctatgcttgtgtttgattatggctgccggccggagtggttgatggagtggcttcatgggccaggcccaggccaaaaggcccaagaaagagaagagggaaacaaatactgtaggaataatcaaggtccttttgtttagccttgctagctagccatataatcttgctacacccaaataaaacaagtactagttgtttcattgagccttttttttaagctacgagccactcttgtagtctttcttgtacgagtattaatttagccaaaagttatactcgtcgtggactacagttgtaacgcactcatacatgtatatatagtactaactttgtttctgtattatatatagtacattttgattttcttattcaattttaagtttgatcaaatttattaaaaaatatagcaatatttttaacataaaagaaaacatagtaccaaaaatgttcaatatttaatataatgaaactgatttgtgatgnggtnntgtnccatntgatgcgtcattcatcaacact

SEQ ID NO: 10006 - DNA, 3672 bp, Oryza sativa
  unsure (1)..(3672): unsure at all n locations
nnnnnnnnnnnnnnnnnnnnnnnnnnnnnnnnnnnnnnnaagttcaaacatctgtaatatatatgaaacattacaaacggatgaagtaccagtataagttaaatgaaccataaaattttcgcactgacataagctagtggttaactacgctcaatgcgagcgtgtatattgcctatgagttcaagtaataaggttggctttttttttccgcccagcataaataaacttggcactcgtttccacagaaaccggccatgatatcaacaaaaagtaatattctggctacatatatattatagcagtcatataccagacatgaggggtgtgtacctagttcaattattagacataaagtcctgaaaaatggggcaactgcatgttgtccaaactgtctctggaaatgctatcgacgatgctccatcatttcacttctacttatacttatcggtatgacttaatacttgtaagtaagcaaagaccatttaatttatatgtaaaacttttatatgtgttcttaactataaaataaactataatgagaaaaacacaaaatcaatttcacaatttaagttatataaaaaatttcattattgaagtataggcatacgcgaaactatataacgtcgtcgtacgtgaataaatgtatggcgatacatgatgcatgctttaataatgtgttaataaactcccttcttcctaaaacaacaagttgagcaacacaggaagtatacatgatactatgcggctagctgtacactagtcataacctagcttgcacgccatgctcttcagctactgtgtatcgttccatgctacttatccagtacaatcaactgtaattgcttcaccaaaaactgccgtacaaatgcccagaaaactgcaatgatttgtgcgctactagcttgtttcttcacatcactcaaattaaattccatttcacagatgcgttttcagcaggcgaagcatgcattctgctagaattgtggttaaaatggtactgtagtaatctttttttccccttgtactgctgaattagtgcttgttcaactacagcatatggctaaccacgcacttggcatctcgttgtattttaccactataaatacctagagcgcctaacaaacttaatttgtccattgtgcacaccgacctaattaattaagctagctgctgcctgctatattgggtttggtcctgattgctcctaatcatggaagatgagtaggcgatgacacaagactcttgtgcctaattcttcttgattcctgcaacaaaacaagaataatataatctacacactatatatcattaggagtatatattcaattactaccgcaatcacaggaccatctacgtacgtgctctagctatagcctctaggtaccataaaacctaacacaatttttaatctcgctgctacgcagtataatcatgcttttttttggataaataaataatgaaaagggcagctgcaaccgatgttctaaagagtaaagaattaagctgcagctaagtagaattattcagaaaaaatattcattcagtagaccacagaataacatttgtatattatatctcattccaaaaaatattcatgcaaactgccaagcactgtctaactatcaccaaaaaagatgaacagaaactttacaaaaagggatacataattacatagtgattaacatgaaagaacactgatctgtgattgatgatcattccatctgcaactgcaaggccatctcaatcaagaagtgaggaaactgacacgtataaattaaaatgaaattctttttaccactaaaaccgcaggtttctactgttgcattgcatggtcagtttcaccatcatttcttgccggaattactgcaagaggaggcggtggtgtggtcgtcggacttgtgcaccttgctcttccccttgtgcgccaccagcatcctcttcagcgaccgcatcatcgccaccagccccggcgcccgccgccgcgagctcctcgacgcccccaaccccaacaccgccgcgcctccgccgccctcgcgcttctcggcgaggcccgcgccacccacggagcggcggcgcgacacgtcgagggaggcgaggaacatgtcgccgcccttcttcccggctgcgtcgtcgtcgttgaggtcctcccagagactgtccatcctctcctcctcctcctcctcttcctcctcctcctcctccgcgccgtcgcagaagccggccgcgtagtcgctgagggcgggagagcatgcgccgccgccgccgccgccggtggcgtggcgacgacggagcacgacacgcgcgtttcgccacggcgagccggagcagtcggcggcggagaagctgcggcggatgggggaggagagtagccagacgggcggggaggaggatggtgacggtgagcaggggaggtggcgggtggtggcgaaaaggtgcggctgcggcggagtcgggaaggtgaagtcgtcgtcgtcggcttcttgtcgttgcttctgctccggcgccatgggcatcgtcgtcgtcgcggcttgctgctgctgctcgatcgcgtggagtggagtgatgtcgtcgtcgtggtcttggttcaaatggaaaatggaaatggaaactgaaaagagaagagaagagaagagatgcaagggaaggagaaggaaaggaggagagaatgacggcagcgagcggcatcgtcgccctttattaccattattactaggagtggactaccaatgacgataaagttataattaggtcaatgctttgtttctttttggattttttttatgtcttgtatatgaaatgaaaacgtgtgtctaaatttgtgttgagtaaatataattttataaagttgaaatatcactgggttgtaaaatagaaagaaagtaatacagttcaaattttgtttgactgttgttcctggtataaaacagtgctcaaagtcgcttttttatgaccatctcaatgttaaaattacttactactgtttgtgattcggtctaaaacaaggtttgccattggatttgcaatgtacattataaatggtgggattatatatgtgtcaagtaagagggaaaaaagcaaaatgtacgaattttgaaatgctcatttcgatctggtgttgacttgacccgaacaaatattcaaggacaataaaatttaggaaaaagtacgaattaccccccgaactatcgcggtcgtctgaattacccccctgaaccataaaaccggacattcatcactcccaattatacaaacaggatgaattaccctcctcgaaccaattcagagcggttttatccaacgtggcgcacacgtggcaatccagtagcgtttttttaataaaaaaaattgtggaacccgcgtgccatactcttctcttcttcctctctctcttgctcttttctctctcacggctcgtgctgcgcgcacggtgagaacggcgtggggacgggcggtcggcgacagtggaggcagcgagcgcggtggaggaggcagcggcggcggtggccggcgaagtggagcaaagtgcccgcagcaagaggcaacgggcaaacacgcggtatgcggagtggagcgggcggcggcaagcgaccggagcaagtgggcgagcgcgcggccgccagcagagtggagtacagcggcggtagagggggagaggaggccaagcatgacatg

SEQ ID NO: 10007 - DNA, 24926 bp, Oryza sativa
  unsure (1)..(24926): unsure at all n locations
agaaacttttggttgtttaatccaccttcaccatgtaaagcaatatccacctattagattgtgttggtaaggaaatgaaatcccagctgcgcattggacagggtgccatcaagtaaaatatgtttatgggttcgagcaaccattccttttttgcgaaggggggtctacaatgtgttgaagaaaatgttgttgagccagaagcctcgcccgatcgtttcgcaagcgtactcctaagccttgtcccattaatcacggacccaaaggccatgaattaagtttctaaaacaaccagcatcaggagttagtccttcaaagatgaccttgccaatttgggccatagcatcatccactttacctaccatgcagagggcgtccattattattccgtaggtgactgtatcagaattcaaaccgggcgcccacatttcgattaataaaagcagggtataaacccctttttccatgttaaagtgtatgtgctaatatctacctcnnnnncttcttccctcccccatcttcgtttganaacttcccctctccccctctccctcctcccgttgcaaggtgttaacagtgaaatttggtaatcggcaaagacatcatcggcttagaatcatatcggctgcagcatctcggaatcagccgatgggagttatcaagtcgccaatagtcggattcctactatattcggttaaggaaatcaatctactaaaggaagcttatccctaagtgaccgagtttaaagaggatgcggcatggcagtttatctattaattaggaatagtttgttagtttccttttatctttaggaaagtgtgtaaggactttatgttttccttttatctttaggttagtttctttcttgtccgacaaggacttgtatcaacccatgggtataaatatgtacacccggggtctatgtaatctatcttcacgatcaatacaattcggcacatcgccaccttttaccttttctactttattttatcgttcggcgggacttggcacctgacgcggggctgcatcagtgttcgatctccggctaaggggtaagtccaatgttccgtcggtccaggcaattgtctcatctacatcggcgtcgtttaaggctgcatcagtacattagacctcttggatcgctccggtttggatgatatatttgtctacctatttatcatatgcctctgttaatatagtcttagcatatcaatttacctctatcggctgcttctcgctttagggtttctgccggtatcagctaaatcgtgttgctagattagaaccataatctctagcctgctttttgactgccaataggggtttcatcggggtttcaaccggtgagttatctggacgttgcattggcttgtaaggattgcatatacatataagttggatttagccgatggcaataaagatttaattgtttaatataatcttttggattttatggcatcggacctcctgccgatgtatgctttaaccttcggatcaatgcttattccatcatattattatcagccgattggtttatactggattatattgttatcttattacatcatcatcagccgattgcctttatatcattatctacattggacatatagccgattgcttacaccctatcgctatcggctggtattggcatcggctattatcggctatcggctggaactactccatccgcttgtcagccgatcggctgttttgatctactatttgcatatcttgtcagttgcaggatcaaactgactggcacgcccgcatctcatcaacctttggacctgcactggagttaagcagatctcccaggccggtgtgttcgattttttcgtcaacacaaggccctcgaggcggcgaagctcgattgggctcgccggccacctctctaccgccgccggcctatcccctctttgcaacggaggcagcgcccgcgacgaagcggaggaaggcacggccgcaggctggggctggttgtcgcgcatggcgtcggccgccgtctcgctgctgccgctgcctcctccaccgcatcctgccagcagcatgagcttccgccgtcgctcgcctcctccactgcctgcctcgccgccctgccccgccgctcgcctccccacgctcgctgccttcgccgccgttgcctcctccgccacgctcgctgcctccgccgtcgccgaccgcccacgccgaccgcccatccccgcgccgtcctcgccgaccgtccttgctgtgcgcgcagcacgagccgcgcaagagagaaaagagcgagagagagagaatagagagagaggaaggaaagaagagtatagcaggcggatcccacaattttttatttaaaaaacgctgactagattgccacgtgtgtgccacgttggacaaaaccgctctgaattagttcgaggggggtaattcgtccggtttgcatagttggggatgaagaatgtctagttttgtggttcaggggggtaatttggacgactgagatagttcgggggaggggtaattcatactttttccaaattaaagcccactgtcccctgctctatcaatatatacgatatatatgtgacaaaggttttaccctctttacgaaagaaaagacccagcttaatatgtaaactattgagtgtgttattgccattttctacttactatatggataaattagaaatgaactcaacaaacaaatgatctaaacaatataatacaatataagaatatattataagaaaattcttttttcaaaattggaacaatttataatttggtgaataagttaaaaagaaccaggcttacctgtcggagcgatttgatcacgatgacctcgtcaattacaggatatatcggcagcgttgttttaaaggtgctcgtaggattaggatatgtgtgtttgtatttataaagatgagtatatgtgtctgtaccgcgtgtgttttttttttttttttttagaaaaaaaacaggttcaagttagggtcaatggggtccgaccgaaccgtgccagattatatggacattggtcaatcaaggcctaattcgatcgtttgagagagagggagtcaagggctaaccagttaacgtttccatgcatcttttggattcaacttggatccttctcccatatgtatcctttctactggtggtggacgatcgattctctacggtttgcgcctaacattggacaaatttaaagtcctcttgcagagatatagctctactcgcatcgattgcaatttcatacttgactattcactttagatagtacttgactcacttttgccaaattaatatttgtaaacttttgacaggaaaaccgggtgctaattaattgcaattggacaacttgccatcagctgtggtacgtttttgttcttcattcccataaactacagcagcagctcttcataaaaaactgtgattagtgagagcagcacagattgacaaattaactgagagcacaatgtaattaacgacatcctatatggtgagtagaaacatatatagcatatgtagggaagtggagtagcatagttaagtgactgatctcctgatttccatgtggaattaatgttgactcttaataagtgttcatgtatgcagaacaaaaacagtagtggtacttgatcattaacttatatatgctgcctaatctacctacctatctacctaacttaggactaactactattagctgtttgcactacaattatatggagtacttgttggtagtacgtaccatacatgcacatacatggattaattgtacatgtcccgataagcaagataggtgatgaacatatcttgacgctaattctctcatcgatggacttattgaactactgtacaatacagcaaattaacgtgcgtgcacttaatttattagctaattcaatacagatcgattgcttcagtgatctggagaaacaggcaatgaacaggtagctaaattgattatccgatctgatcctcttaatttgcaactgagctgattgggcccatcttgagttcagttcggttaatgcaggccttgcccctctaacttaatttaagtcgcagcagaccgaaggcccatttcaaaaggaggttgggcttcctttaagcccattacaccgcctccttactcaattccggccgctctagctcaaccccttctaatctccagtctaatcgatgctgatttaaaaacttaagggtgtgtttggataatgggaaatgaagagtaggattgtgattgggaaatgaataaagggttaggattaaatggaagagggagaatgaatggttagtatttaaagataccttttgatgggtgggaaatcattttccaatcccattatccaaacaatacctaagggttttgataagagtataagtgcaaaacagagaaatataaaaaacatgtgaaaaatataagaatggcaactttgactagacaattgtaggaaaagaacaccgtaattagaggaggaaataaagactataaaacctcatattaacattcctcagtttttttgtcttcatttcaaagcacgaattacatagaaacatttttatatagcattttcttgtctgttgtagcattcaattcctgtggaagaccacggcaacaatacatggatcgaatgtatatatatacttgatgttgctttgttcccaattctaaaagcaagacatgcatatgtgccacacaattaatgaacagtctctgtcatagggccgggctacatgtgtattatgctatatatctgccagctgccacgtcttacttatattttcgtcatctatcgattcggttgctgcaacttgcaagcaacgacgatcgagtaattaactttgttcaacataatcatgcatgtttacactcacctcatcttcattaattattattaacaacacgttttgttcacgatcgatcgatcaaaggaggattagctatgacgtacgttgcaaattgggtatcagttcttgactttacgccttcccaaaacaatgtgtgattcgtcctgctacgcctacgcgttttgcattgcatgctgctgtcgtcgtcgtcgttgcttctcaattccatcagcacctagcagttgatctcttcaagccacattattttccttctcttttttttcttttttggtcgatacaacaataacatatatgcttttctatttcttccagcgcatgcatgttcatgtccattccttcacgccttgcacaatctccattgatcaccaattcaccggagcaaattaattgagctatctagctagctgcctgtccaagaacaatccagtgatcgatcgatcatggcgtctcccgcagtcgtcaggcagaggccaacggtaggtaagcaagctggagaaggagagagcgctgctgctgccggcgacggcggtggtggtcgtccgccggcagcaaggcggccgtcgctgttgtcgcaggcgctggcgtcgacggcgagcctggcgaacctgctcccgacggggacggtgatggcgttccagctgctggcgcccaccttcaccaacaacggcgcctgcgacgccaccacctcgctcctcaccgccgccctcctcgccctgctcgcgctctcctgcgtcctcgcctccttcaccgactccgtcaggggccccgacggccgcgtctactacggcctcgccacgccacgggggctctggctgctcgactaccctcccgccggcgccggcgcgccgccgcagccggacacgtcgaggtaccggatgagggccatcgacggcgtacacgcgttgctgtcggtgggcgtgttcggggtggtggcggcgagggacaagaacgtggtggggtgcttctggccgtcgccggcgaaggggacggaggaggtgctgggcatcgtgccgctgggcgtcggcgtcatgtgcagcctcctcttcgtcgtcttccccaccactcgccatggcatcggctaccccgtcaccaacaacactacttcttcttcttagttacttgcatcgatcaaagtatatattactcctatttagtagtaattactttactcgatttgatccattattaattacggctcaattttccttgtttcaattaattgtggattaagtaaatttcattaagtatactacagttgtgttgattaatctttgactgcaattctgaaagttttgtctaaaattaagaagctactagcatttgttatgcgacaagatttgtcacctgatgcacacctagcacagggttttctttgggtaagagtctgtttgttcttaggcaatttcttgcaaagctgggtcaatatattttgctctgttctctcaaaaaaaataaacagctaccacatgatgaatattgaagctcaaccggaaacataaaagaacgagaagtggcttcgccggcgtcgaacagctcgttccatctcttgttcaccttctctgctctcgcgtacatggtgcgtgtaaaaccatgtatggtttgattcagttgtgatgaaaaattggcaagtgccggattaattgcaaggaaatgtgtgtgtggattaacatatgtatgtatgtatgtgttaacttggatgcatccttataagtacaaaagtacatacatatgtactacagtatgtgttaacttcttttaatttggtcgtttcttggaaggaaaatgcaagcaaaatgatggtcagtagatgggccgggccgtattggatgggctacactgtgtacatgtactacgctaacatgaagtccagtgtatctagcttgggctgcaaatgttaggcgattattggccttgtttggattctgaatttaacttgcatttcgacatgtacgaattgagctatgacctaaaagtgaaagccaatcatatcattcttttttaaaaaaaaattcaccacggtagttaggattccaacaagggccaatgaaggttttgttgatgtacatccaaaagtacaaatggagtgcgacacaaatgttatacttttatgcaaacattgtaagttgacatgtgctaagaatagcttattctacaagtagttgaacacacttacaggactgtactcacgataacatctaacactgataattaatttagatggatactgtagaccttgacccaatgttgtaccgcatgcatggctatatatgcaggatgcatatatatcgacacaatgttgcacagcatatatatctatcctcaataattagcaatttgcgggactaagaagagcttctccttccgatgtatggccaatccaaacacatctgtcatatcgatatcctccttcttcatccctgacggtagcttccagttgaaacagtatacgaggttcgccaacataatctcgagtgtgacctttccagaatgaattccagggcacattcttcgtcctgatccaaatggcaagaactggaagtcttgccccttaaagtcggtgttcttattacttccatccatgaatctctcgggtaagaactcatctggcttgtcccagtaattagcatccctactaagtgcccacaagttaataagtacacgtgttcctgctgggatcatgtagccatcaacgttgcaatcttctctggcgaggtggggaatagtgaaacctcccggtgcatgtagccgaagtgtctccttgatgacagccttcaagtagaccatgccgacgatatcatcttcggttaccatatgttgtcctttcggtgtgatgcgtctcacctcatcttgtagctttgttagaatgtgtggtttgcgtgtgagctcgaccatagcatattctagaactaggtgtgatgtatctgtaccagcttcaaacatgtcctacgataaatggcacataaataatttggagttaaacagttaaaatgttccgtgtggtttatagtttcaactatccttagttttctaaatttattgtaactatatttgtaataaataatgtttatgtaaattttttttaataaaaaaaaaatatcaaacgtcatgtcaaaaggcaagatgtcatacatacattaataaagaaaaggagaaagtatatattttgtactacctccatcccaaaatgtttgacgccgttgacttttttaaaaatgtttgaccgttcgtcttattcaaaaaatttaagtaattgttaattcttttgtatcatttgatttattgttaaatatacttttatgtatacatatagttttacacatatcacaaaagtttttgaataaaacgaacggtcaaacatgtttaaaaaaatcaacggtgtcaaacatttagggaaggagggagtagaaggaactcactattgatatggccttgatatggtctctggtgaagccatactcgtcctggagggaaagaaggacatggatgaagtcgtcgtcgtcgtttttagcgcgatcgcgagctgaggctacatggtcgtcgatgagcatgtcgaggagttggtcccacctcctcctgatcctgatggccctggcgcagatgagcttgctgatgagaggcatcctcgccaaccccgggaagtaggcctccaggttgaaccctcccagcagattgctgttcgcctccatcagatcccggaacaccttgttcctcccttgctcgcacaagaacttgcccgacaccgcgcggcagatgaggtcgttcgcgaagaactgcagcgtctggctcaagtccaccgccgccgccgccgccgccgcgccgcggagcctcgccatcaccagccgcacctcctcctcccggacatggcggtaggcctgcaccctcttggagttgagcaggtggacggtcaccaccttcttgacgctgcggaagtggtcgctgtagggggcgaagcaggagtccagcgccccgtacatgatgatgtcggtgaccatggagcgcggccgcgacgcgaaggcgaggtcgtgggtgcggaggacggcctcggctgcgcgcggcgaggagacgaccagggtggggacggagccgaggcggacgagcatgaggccgtcgcggccatgtttggcggcgaggtctcggagggagacgtacgggagggggccgatgaggtgcatgtgcccgatcaccggtagcttgaacggcggcgaagggagcttgctcagaattaactcacgagttttactatccctggaacttattgcggctcgtgcaaagtagaacagaagagcgagagggaggaggaagaagaagaagacggttaccactgcttgtgctgcagtttttgcttctagctgcaggatgagctccatggctcactagatacatgctagctgaaagctcccaataagctctatcgtgtgagctagctagcttgcatgcagttactggctgtgctatgcatgtgctgatattctcttcttgagttcttcatatatataggcaaactataacaccatgatcgagatggagttctaatttattggttgtattgtactacttgagaacgattgatctagattgtgcacactataaccatgaaatggatggagttttaatttattggttgtattatacttcttgagaacgattgatcaagattacaactacgccagaaccgttcatctgtgacggcccaccagtgacaggctgcagtgcttgtcacggatggccggcttcacctttgacgggtctatccagagaccgtaataggtatttgatcacctgtgacgggccagaatttacatccgacagagagttgcttttgttgggttcaaattctggcccgtcacaggcgatcaaataactgtgacgggtgtactgttctgatctagcccatcacagatgaggtattcacctgtgatgtgtgtaaaatttgtgtgcccgtcaaagatgataaaaaaaaattcactctcataaccctcccctcgcctcccggttcacaagcccacgcccatccttatcctcttctcctttcttcttctgccttgaccctctctctcccttcttcttccgccacctccctctctctcccttcttccgagcacctcccacaccaaagccgccgggcgctagctcttatgagccctccttcccgttgcaagcccagctagatgcgtctccgaccgccggccgtcgttcttcttgggcctcctgtgatccctccttcccctctggctcgatccggcgagcagtcgtcatatgtctcgtcctcgagcaccggtgtggctgcaggcatgacgaggaagggcaagatctggccgccgctgcagtcgtcctcgtggttagggggcaccagatccggcctctccgaggtcgggggtaaccagatccgggtcctgctcctcctccttcaccgagtagccacctccaagagctagccgcctccatccccgagaggcaactgccacagcgtccgcctcctcctttgagcattggtcctcgccgcatcctccatcttcgagcagccgacgccttcaccatcgagtactacgtgtcaatgcctcccccgtcatgcattggatgggtattgatctatgtgtttgtagtcttgtgatttgattttagaccttgcaagttatcggtaccaagttttcgattggggtgtgtcattcttgtttccgcatgatgtgttgccactgggaattaattgaaggaagggttggatgactgatgctagaaaagttgcgctctttggtgttttgtttttcttgaaggtggtgaactgcaagtgtttagagtttcgttgtctttggtgatgttgctagaaaattggaatctgaacattgcagttctcaagtagttttgcgctagtttgtttttatgttccttgtaacatcaacgttgtaagttcttggattagaaatgtagtctaaaatgttttggattattcagcgtggatctgttaccgatttttcattgttgcagcggggcacccttttttttgtttgatttttcacacctgtgacgggtcgactgcttcaactcatttgaggtgacataatctgtgatgagttttaattataactcgtcatagatgtctctcaccactaacgggttgctcattacaacccgtcacagcctcacaggtgtctctcaccactaacggatcttcacccgtcataggtgaggttaagtcatcactgaccactaatctgtgaccagggataaacccatcaaaggtgaggatttggacccgtcacagatgacctgattcggcatagtgtgcagacatccaacttggcaatcaattaattgcaagtccctctccatctattaggtcctcgttttgagtgcgtttgtgtacccttaaggccttagattgcacactaggctccatcggaatgggcgatcctaatgggcaatcgatcgctggagatagggggcagcgatcgattccctcccccttcctccctccacctagtttccttttttggcaccgcattacttttctattttagtaaatttatgcacctaaagtttatacacctcaagtttacacatctaaagtttagagaccaaaagtttataagttaaaagtttatatatccgattcaaatttgaatttgaattcaaatatttttttatatatagtatttctatacatctaaagtttatacacctaaagtttatagatccaaagtttataagtcaaaagtttacatacccgattcaaatttgaatttgaattttatctgattcaaatttaaatttgaattcaaatattatctatatatagtatttctatacatctaaagtttatacacctaaagtttatagacccaatgtttataagtcaaaagtttacatacccgattcaaatttgaatttgaattcaaattttttatatatagtatttctatacataaatttttctaactttttgttttttaaaaaattttgtggtgtagaaagagaagaaggggaggagaaaaggggagaagagggactataggggaaggagagcgcggggtgatcgctgggtctcccgcgcattagcagtttcgcatcggaattgctatttagcttggctagctgtattcctatagcgtatatatacttttttcaggtgaaacttctcatataaaagttctttacaaagaagcgtgctcttggaacaaattaaagccgcgtgctacacaacaattccacatattacaaattaatatgtactgcaacttggttgtaaagtgacacgagaaacacaacaatagagtagcttagcaagcgtcatcgtcgccctcttgccctcctcctctttctcctgtactgtatgtggtccttgttatattatatgctgaaattctatcatatatacagtataaccatgagacgaaggttttatcagctatatattgtcttttcaatggtgtactacttgaaaacgatcgatccaaattgcagaaacccaacttgccaatattctatagtgcatgcatgtccctctccttccattagataaaactcttttaatcgcacgtctactcatttattatagatcaattaaatagttataaattgttttaaaaaataacaagatatattatatattatatatatttattttagtatgtaatatattaccttacatgcaaacataaaagttcaaattcgacccctacaaattgtaacaaaaaataaattctactatatgtgtatactaattggagtttaatttattatttttgctataacttgtattatttgattatgaactttcatttatgtgaagtgatatattatttatttatctatcttgttatttttttaaaaaaaatattataactatttaattaacatgtgataaacaagtagacaccacacacgattgattataatccctctccgtcctttagccctcctttgagggtttgcacacatatgtacgacgatatatagcgctaaaataacaattccccgtgcggaggctaacaagtgtagatgaatgctctcacttccacattttacaaacgtgaaacttgggtgtaaagtgacacgtacgtgcatgaaacacaataattaacagagtagattagtcactattttaaaaaaatagcctggtcaagatttcatttgaattaagagctagatactagaaagtatggtttagctatgttaattcaagaatattaaaatgcacaattaattggtcagaaatctagaaattagagctgatgaaaatatattgcttcatggtctgatggtacgtatatatgcaccatgttaattagataatagcaacgttacaaaatactacctgtgctgccttttcactgtacgttacaaaatactacctgtgcaacagttgcgaatatagcgtgtattatttatatacaaatttggtaatttttttacttgtgtaagttaaatttaaacttacgtatttttaagtgatgtattatatatacctatcttatcaattggtttagactttttaatgacattaagataacacacaagaatgagcgacatatccgctcgagggacaaatatacttcccgaccatatgcatcatgtatgtgttatcttcaagctaaaaaggtatctataggaaaggaaatatagaaaagattttttgttttccgtgcgcatgcttcccaaactgctaaacaatgttttttttttgaaaaaaaatctgtagaaaagttgtttgaaaaaaaatcatattattctattttaaaagttgaaaataaataatacttgattaactaatcatgtaatgatggtttatcttattttgcgtattaccctttcactcaaacatagtctaataggtggactggtgaacacaaaacaattaaatgtaacacatttatatcttcacattaaaatctccatgtgaaaaacgaacggccagaatcttaaagtacaaaagacgagcagtccatgcttttatttttatagttgtctctaatgaaacatacgtgtatagtatatgcatgctgtcaattccacatattataaatgtggaaaatatgttgctgagtgattcaagaagtacaattattaataataaagtagcttggtcaagaactcatttgatttaagaaattaaagagaaaatattttttagctgaaacacatacaattagagaataaatataatcaatttgtttgaaatgatatgcgatgttggacaatagctaaggtggagaggagcagggttaaagacaacttgtgggtaaacttttttttaaatagttatcacaatttttttaaaaaaagatcacaataatcatactccctccattaaaaaaacctaatctagatgagttgtaacactacctactacctagtacgacgaatctgaacaacttaattaattcgttgtactagatagtgtcacatcatatcccgacctagatttgggtttttatatcactattttttgagcagatttatttgttttttatttgtaggttgattttggaattgatatttagtggagtgacagatgatgtacttacactgtcacgttttttcataaccatttatattaattttagagaaaaagttaattgtggctaagtaattataggcatctccaatatgcatgtaaaagtgagcataagtaataacttaatatttgtagtataattttatgcataggaagctatatttgtaaaaaaaaattgtggctaatcccatacggaatataaaattactttatgtcttttcaacatgtttggtggtttgattaatccttcatgcatgcaagaaggactaatagaaattattttattaagtggatcgcagcttaagatcaacgagagatattcaacattatagcattagctatatataagtaaaaaagacatatgtctatggatcttattgagaatctatatatttaactatttatgttggctcttcactgctaataagtgtggtgtcttatcacatactagctccatctaaaaaagggaccaagctatgtaggatatgcatcatgttcaagtatatagttagaattgattttttttttaatgaagggagaatgccttatcttgttggtgacatataaaagttttctttttcgaggaacatatatgaaggtgttttgaggaggtatactccctccgtaatcataatggaagttgttttagataacgacacggtctccaaaacacaactttgactttttgtttctataaaaatatttattgaaaagtgatatatgtatacttttatgaaaatatttttcaagacaaatctatttatataattttaatattttctaactcaacaacttgagagatgtttatgatttatatttttaaggtttgacttcaacattgtcctaaacgacctcctttatgagtacggagggaatataagtggagtaccatgcaagtacgtgataataatattaaaaaggcatcgatctcataggtgggtgaagacagacagcacgtttcccgctagattatcacatggacgacacgcttttcaaaccgtaagatattcgattagaccgtaatagtgttgatgggaggggggcttaagttgtatgtgttgtaagctttcaagcagacctcatcgtttgccttatgatgtatcagtcgctactaaaattaaatttttaaaagagatattttcgacatagttttttttacagcattggtttttaactcgctaaaaacatatataaaagtttacttacaaattattttttatcactaataagccgtttggcatgctattaactccatttggtccgccggtctaggcctgcgggtgtcatcgatcatgtgtgcaatgtttgctaatctgggtctacaacgtctgcaacgtttggcatatcaattacttagaaaaaaaagtttgtctcgaaaaagaaagaaaaagattaagtatttcaaattgatagggaccaaagccacccgtgaatatgaaaaacaatgatggacggtgacatatatgtatatgcatattcaacggacattttaattaatttgtacaaacaagtaaatgacatgtgccatgaattcttatctctactattataaaaattaaagatgtttttaccatgtgctttggtacgtcgtgaatctgtagcttagtttccggattttccgattctgtttttttactcgtatatcttcctttcgtgtgtccgattctattttcttctaccgagcgcaacgcagatgaccggtgcaaccctggggtcgttctaccgtacggctgacctccgggccgagcgtcttggccaccacgggctgagtgtccctctttttaactgatgggcctcatctgtcttggcccacataattcttagtaaattatttcttggtatttttctattgtttcagtttggtgttctcccctaatttttctttattgcttctccctatttcttccgaatgcatgtacacttttataaaaatcaaaagatattataaaaattaaagatgtttcagctgtatcgttacatcgttcgtatttgagtcagtttttaagtttattcacttttgaaaatatattaaaaaattattttaaaaaacttgcatgttaacttgggacgagagtcggacaactaattgtttcataattcttgccaagccattagaaagcaacgtacatgacatgaccaatcgtcctaataagagttccgaattagatataaatactatcaaaataaaaaatcccatagactttttaaatagaaaaaaaaatctaacaataatacgattaaaatagccttcacctgttgcaacacacgggtatttttttctattttttataaaattataatttttttaactgggcaaaaaattaattgagaggctaggaacatgctgagcacatgggctagcgacgttgggccggccataaaagaagacccatatgcatgcatacgtggaagcgctctcctaaggcggcctagaacaaataaaacgagtgatgtccgaatcagagcaaacactagaccgcataatccttaattattactccctccatattttaatgtatgacgtcgtttgctttttgatgaatgtttggccgttcgtcttattcaaaactttatgtaattatcatttgttttattgtgacttgatttatcatcaaatgttctttaagcatgacataaatatgtttatatttgcataaaaattttaaataagacgaatggtcaaacgttgattaaaaagtcaacgatgtcatacattaaaatacggagggtctaccttgtagactataagggttaggtctcggcgatcgatggcttttcttttctttatttattttttctagcttagaaaaacagctcgcgcgtggttgcggcattgcgtagtattacgaaatgctctaaaattaaattagagtgatgtatgcatactattatctttactatattgggctatcagctcctctcgtgatgaaggggccgacggtggcctcccacgcttgcacccatcgaacctctcgctgtcaacgccgcactccgaccccgacctccagttctccgatcggggtcgccatgagaagcggctcgggaggataaaggagcagcagagtgaagtagcatattgtcacgctgctggcctcccgctgccgcgtagtctcgtgtgggaagaagggaggacgaagaagaaagggataagtagggctgacaagtgggccccaccgttttttatttttacttttgtcactaaaatgtggggcccacttctatttttaattcttttgatgattgggctatcacattaggatacttggaccaaatcaacgtgccacttcaacataaatcgctttcaaaaccaccaaaggagtcaatttgcaccattttttgaagctcggggaggcattatgcccggttttacgattgagggatgcgatttgacaagggcaacatatgaggaatgcaaaatagacttattcctaattaggatctaggccaatgcaggctgggccagctcaagatctaggcccaatatttattagatccaccctgtctgaattaatatatatatatatatatatatatatatatatatatattgaagagtttgaatttacagaaggaccaaattaaacaaccaatgaatatcacaaacattaatgatgattatattgtttgggtgtatatgtagtatacattatacaagtaacagcacaaatggagggtgatccacatggacaatttgttttacaaacaagtgaaatgacatgtgccaataatagctcttattattacacgaacaattaacgacaacatgtaacactaattgatttagcacgtgattgctggatgaataatataacttgccccaacgaacgtagtactgattcttgtataggcatgtacttaggcagcttgcgggactaagaagagcttctccttccgatgcactgtcaatccaaacacctctgtcatatcaatatcctcctccttcacacctgctggtagcttccagttgaaacagtacataaggttagccagcataatctcgagggtaaccgttgctgagtgaattccaggacacattcttcgtccagacccaaacggcaggtaatgaaaatcatgtcccttaaaatcaatgtttgaatccatgaatctctccggtaggaactcatctggcatgtcccagaatttagcatccctaccgagtgcccatgcattgacgaatacacgtattcctgtagggatcatgtagccgctgatactgcaatcttctctagacaggtgggggatgtagagaggagctggtgggtgcagccgtagtgtctccttgataacagcctttaaatagaccatgtcgacaatgttatcttcattgactacttcttgtcctttcggtatgaccctcctcacctcgtcctttagcttggctaggaggtgtggcttgcgcatgagctcaaccatggcagattctagaactaagtacgatgtgtccgtgcctgcttcaaacatgtcctacatatcgcataaataacataaattaatagtgtatggcggtttgtgtaatgtagcgtaatctgtacaacatgggaagtgtaaactcttgattctacatcaacagtagctaaatttaagttggcatgtagcagctagcactcaccacaagtatagctttgatgttgtccctggtgaagccatactcttcctgatggtagagcaagatgtcgatgaagtcactgtcttgttgctgatcatgatcgtggcggcgcaccaacctggtggcatggtcatcgatgagcttgtcgagcagctggtcccatcttctcctgaccctcattgccctgacgcagatgaccttgctgagcagcttcgtcctcgccaagctcgggaagtaatcctctaggttgaaccctcccaggagcgaggcgttggtgtcgatgagctcccggaagagcttgttccgcccttcctcccggaagaacttgccggacacggcgcggcagatgaggtcgttggcgaaggagtggaggagctcggtcatgtccaccggcgcgcccgccatcgccgccgcgccgcggagcttggcgatcaccagccgcacctcctcctcccgggcggggcggtaggcctgcaccttgtgggagttgagcaggtggacggtgaccgccttcctgaccttgcggaaatggtcgccgtaggggccgtagcacgagtcggtggcgccgtaggtgatgatgtcggggaccatggcgcgcggccgcgacgcgaaggcgaggtcgtgggtgcggaggacggcctcggcggcgcgcggcgaggagacgacgagggtggggacggagccgaggtggacgagcatgaggccgtcgcggccatgtttggcggcgaggtctcggagggagacatgtgggagggagccgacgaggtgcatgtggccgatcaccggcagcctcagcggcggcgaagggagcttgctcagaagaagctcgctgttgcgatctcctgccattgtcgttgctcgcgcaaagcggagaagcagcagcaggagcgcgacgggaaggagcaagaacacggctgctgcttgtgccctactagctgttaatggctcggtgttgttgagctccattgctaattgcttcatcgattgaggtgagccagagtgttaatctgcgctgtgattttatagccgatcgagccttggatgcctaattcatctatatcattcattagtacgtacttgcgtgtttgtgttgtctgtcttttccttgtattactttggactgccttatcttttcttatgtttatacttatcaggtaaaatttaaatttttaactttaaaattgaagttgattttgagattttttatcgaagtttattttttaatatttgcttttgcttttagatcgctaaaaacacgtatataaaagtttcttttcatttataaatatgtcatttcgcttattccgcaaataagtgaaacgatggctccgagagtattgatcacttatcaatagtatactcgctctccgttcccaattgatcaacatacaacatgatggttttacagaaaaaagagttaataactattttatactggagtactattgtcaggttatggataccacatacctaatagtagttgactaaatctcggcagggcccaccacataccatgtcctatacggaaacaacctgcggatatggagggagttccggataaagaaagacaaccagagttttacatggaaacgaccaggactactcggattgtatccatattagtttccctagttctacttggacaaggagatacctatgggtataaatacaaaaccccctaggaggagaggggacaagacaatcgacagacgatcgacatgatcaacatgatcaacacggtcaccatgatcgagacccatcacaatcaacaaccaccgcaatatacggaacaacagaagccaatacaagccaacatacgccaagacacgccgccggatatcgacttcagggataggcatggctatttccctatggtgtctccggataccgtcaggagagacgaaagcgctatctctgatctcgccggacacggattcgagaaggaaggctaccctgttgtcgactacgagtcagaccttcagaccgacatgtcgacaacagttagataggctacccacatattgtactggtgtgattatggtgaataaaagcaactccggctccggccaacaggatgtagggttattacctgacaactcaggggcacgaacctgtataaaaattctcgtctccatctcttttacctcagtctcgcgtatatcctagcaccgacgatccccatactatgcaaataccagaattgcgacatcaaacgtcgacaactatatatatccggatgttgcatgttagttgtaaataaattaaatagttgtgtgtatggatacatgtaccatgttcatttattttaatgcacggataatgaacatacatagagagtacaatcatatcaattaggaatatactatcctaataaaaatatttgccgatcatttggaacggtgggagtacgatcgatcaatggcgttcttatgtgacgtgtcacgtgagtgtgagtgcattcatgctaaaaacttggaaattaatcaagtgcatgtctctctcatgcgtatgaacacttgtgtacttggtctttttctcttttgtttcggtggccaatgtcttcaaatcttaatatatgattatatattttttattttcttagccgcctaatattatcgtatatatacctgcatatattatattttctaacagagattatcgctattaaaaatatgtcgaactcttctgtcgttctttgagtcaatacgaaatgatcaagagacaaattaagtcatgattatacatattaagcgccagtgacgaatccaggatgaaaatagaggtggtgctaatactcagcactgaaaatcatatttcctgaaaaatatgatcttaaaatccatgtttcattctgtaaaatcatgtttgtccagttgtattagaccctccaatgggtcataatatctgcctaattgtcttcaccggttaggcttggtataccatttagcaattaataaaccatttagcagatggagcactaatcacaccacagacctatacgcgagttgccttcttctctaaagctgcgggcccaaaatataccttctctaattgccttggtgtcctctgctagctttgagcttaccgggagaatacttgggggcggaaaatggagctggggcttgagccccaacaagccccaacggtgaatccacccctgttaagcgcacacatgtctaattaattttcgagtaagtacaatctgtaagttggcaaggccctgtgcatgctagctagtttcatttcaggcctcaatgctaggaatttttttaattaaaacgtggtaattaatatatatatattgagataagttacaaaacttgataaaaggatcaattgcgtctatatataacaattttggagaattacggacccattgcggaataagaaaaaaatatatttgtaaacgaaaagtaatttgtgaataaaacttttatgtacatgtccttagcgatttaaaagcaaatgctgaaaaataaactttgatgaaaaaacctcaaaatcaattccaaatttaaaattgaaaatttaaattttggctgataagcttaagaaaaaaaaagatgaggcccttaggctaccatgccacctaaatatacatgacgatgacgacctgcctacttggatatgttatcccttttgaaggtcaaaaaataatgtatattgacttgaacagatctccagattaaaacagagtcatttgattggtctctgtcccacgaggttggagtaaaagaatcgttttacgcaagaagtctgatcagcattactttctgaagaattacagtataatatactcctcctataccacattatattcatatgggaacaatccgtattctcaagtcttttgactttatttttattatagaaaaaattagctacgtttacaatactaaattagttttattaaatactatattaatttcatgctgggtcaggccaggcctgtctatgggctgcactaacgacccaaacacgacccaataagactcggccgtgctgggtcggctagaaggaacaaagtctatcgtgctcgttgttgcaataagtctatttgctccctcatctctttcgaccttgtcttatatggctagaataaatccatttcgcatccctcgtctcttttggccatgtcttatatgactaaagtaagtctatttttcgtccctcatttattttgcctccctaattattgaactgtactgggtcaggccagcccaccgtgccaagatagaggtccagacacgaccaaacatatgggtcggaccggcatgggctcgacatcagtcgggtcatgccgtatctgggccgagccaaaacctcgcgtcatgcatgggccgggccatcgggcccgagccttcatatatatattggtaactccaacaaaagagctcggccgaaagagacacctgtcgtcaccaggacataacttttctttaagtcgaaatcaaaatatgataaacgaacttagctaggagaatctcaattagttttccaaaaaaaaaaaagacaagttaattaggtccaatatagcactcactcagggataacgagtaatacatggacttaacatatagcattttacatatttgtttaattttttagagtagacatcttagtgagtgcacatttgccaagtgagaacgtgggcgtttggttcatggttacactttgctacactaattctgtggctgtcacagtttgttaggcatgtgtttggttcactgccacaatcatggcttgccatattttttcaatagcatctcccacatgttatagacttaattttcgtgccaattttgccacactttgtggctagcaacacttttatagctgccacaacttggctaatgttagttgtggcaaagtgtgaccgacaaccaaacacaccctaattcctttatgtctactctaagaacagctttttcacgtgtttgaaatatcaagaactatgaaaccggtgggattacaacttttacagcagaaagggaacacacgcagagcaatatcgatagagattgggatcaggacgagatgagtcgtcgataacgtcaataataaatgaatgggccagaaatcttcccgtgttttttggctggttacacaaagcaacggccatggagctcacacaccagtcagctatagtggcttctaacgcaaacaagcgaagcgtccgaagagacgcgacgcgtggcacagtactctagctagctaccgcctcccaaggaagaggagaaatcgaaggcatccaaccattcgtcatgcatctagcttccacaaactttcgatcgatttcactacaagaagaaccctagttagttagcaagtataattagctcactagctagtactagcagccatggttgttcaattgatgctcttcttccatgacaaattcatggctccaatggcagaggagccactgcccttcgtcctcatcatgatcatcatcttgctgctgctggtgcttcttcactactacctgtctgcatcaaccagaagatcatcggcggcgagcaagagcaacgatgatgtcctgccaccgtcgccttcgaggctgccggtgataggccacatgcacctcgtcggctccaaccctcacgtctccctccgcgacctcgccgagaagcacgccgccgacggcttcatgctcctccagctcggccaggtgcgcaacctcgtcgtctcgtccccgcgcgccgccgaggccgtcctccgggctcacgaccacgtgttcgcgtcgcggccgcgctccgccatcgccgacatcctcgcctatggctcctccaacatctccttctccccctacggcgactactggcgcaaggcgaggaagctcgtcgccgcccacttgctcagccccaagaaggtccagtcgctccgccgtggccgcgaggaggaggtgggnnnnnnnnnnnnnnnnnnnnnnnnnnnnnnnnnnnnnnn

SEQ ID NO: 10008 - DNA, 11506 bp, Oryza sativa
  unsure (1)..(11506): unsure at all n locations
cgtgggnnnattgatgactgaccatcagtaggacagnannnatcaagatggatgatgaccgtgatgatgatcaggaggagcaagagtcagatttcgttgatattctgctcgatcgtcaacaggagtacaatctaaccaggcacaatatccatgccatattgatggtaattaatcacttatacatatgttcttctgaatttttctttcttttttactattaattctatcatctagattaatcgaaaattaggtaattgagttttgtacatgtgtttcttccaaacaacgttaatataatatatatattttgagttgacgaatctagctaatctttaatttctgtataggacatgtttgcagcggggacggacacttcatatatagcccttgaatttgctatgtccgagctcataagaaaaccacatctcatgaccaaactacaagatgaagttaggaagaacacaactacccaaatggtaagtgaagatgacttgaacaatatgccctacctaaaagccgtcgtaaaggagacacttcggttgcatccaccagttccgctcctcctcccgcgcctctccatggctcagtgcaatgccaatggttatacaatcccagccaacacacgtgtcatcatcaatgtttgggctcttggcagagatgctaaatgttgggagaattcagaagagttcatgccagagaggtttatggatagtggagacactatagataatgttgatttcaagggaaccgactttcagtttctcccatttggagctggacgaaggatttgtcctgggatgaattttgggatggcctctgttgagctcatgctatcaaaccttatgtattgctttgactgggagctcccggttggaatggacaaagatgatgtcgatatgacagatcagttcgcacttacaatggcgcgaaaagagaaactctacctcatcccgagatcacacgttatcaagatcacataacacaacatatggccaacatttcaatagccatgagttctgtatggtagccatagataccaagcaatagcgtagttatctgctataagatatatataatagtaccaaataaaatagagagtccattcgtctcttgagggggacaaatagaagtaaataacaagaagaaagtcaatatgttttaaataaagatgttgaatatatgctataatatagcagatgtcaatatgtacgtttgttaagaaatttatgttgaattaagtacaggtacatactctgtttaaatgcgcatggaagattcttttcggtcattatataaaaaaagattatttttggtaccttatatactgtaatctctcttcacctctatatcgttgcaacctgatggtgacagccgaaagaaagtggctctaaggtgtgaaaagaatagaaattaataagtaacagcaacaaattcataagaatttgatgaggttggtagccaatttcagtcacaaaacagtagtgtacataacgctgatattctggagcaagagtcagattttgttgatattctgctcgatcatcaacaagagtacaatctcaccagacacaatatccatgccatcttgatgttaatcacatatacacttctaaatttttctttctttttactattaattcactcatttagtttaatccaaaatcaggtaattgagttttctgttcatgctcaatgttgccaaggaaaaaaaaatagaaacatacaaagtattaaaatccatctcttatatggttttatagactgtaagagagaaataaattttgtaaacaacgttactattactttatcggatgaagaaataaccaaagtaaaagttatagatattgatgagctatacaactttgttgtttatgactttttcagttgaaatcacttagtatttgaaaatgttgtttgaagttgttataatttgaaattcaaattcaaatttcaaagtcatatagcaaaaagaccaaaacaaaagttgtagatgagttatacaactttgttgtggatgactttttcagttgaaatcatttagtatttaaaaatattgtttgaagttttcataattttaaattcaaattcaaattattgaaacaaagtcatatagcaaaatgaccaaaacaaaagttgtagatcttgataagttatataactttcttgttgacaattttttcatttaaaattatttactacccaaaaaattatttaaattgagaggaggaaggcctaatagactttgcgtcgaggaggagcgaaagagctgggccggcggcccgaagaggaaggagggaaaggggaagccagcccaaggaggaagagagaggctgagagctgagggagggagagagtaacacttgggccgaaaaaggcccaattacagagataaggattttaattagttttctatttattttaataggttaaatgaatattatggtattaaaattatttattgagcttcgacaattcacagaaaatttcaaagaataatttagaccatgtataatattaaataatatttccggccatgatttttaaaggaaaaaattgtttccttattaattcacttgattaaattgcttctagaaatacatatataaatctatgacgtttgctttttcccctcatgacaaattaatattcgtcacaatctctcattgaaatactttatgacgatttgtagttggtattaatgacgaacatatttttttcgtcactaagccacccatctcatactaatcgtcataaaatggaatgtgctaatgacgaatagctccgatgtcacgagaaattcgtcacagaatgtcatatttcttgtagtgccaaaacagagttcctttcccatttccaattcttcttttacaatatcttaaaaaatatatgcttaatacaagaagaatttgatgaggttggtagccaatttcagtcacgtagcagtagtgtacaatgaccttatacatactcctttttgtttgcactggttttcctcgatccgccgtgcaaaatgaatcgaatcaaatcgcaggatgattgcggaggaaaatggaggaggtgacaaggacagacagagagaaagtgacatgacaagaggtggaacaagggaccaacgtgggcaaatgtattttttccatgtggcaaacttaaattttatcagcaaactaaactaacgcgtatcgcagtcacgaaatggctagtgacacttaagagacagtattatataatatgcatttgacaattctcattctatgcaggtgagtagttttcatctatatagatattcaaggaattgatggccacggcccacgggatgctcgatcttctgtcaggtgaagataactatcgatttggcagaaacttgactcatgatccggtttctgatcaacacgatccaaatcctgcaatcgcagtaccatgtctcttttggttatcaaccatgccgaaacccgatttacctcgccgagaaggctaatcgctacgagtgaatcgtagagcacaaccaagaataagagagacaacaactcaattgcactcttgtagatgaatgattaactaagaactcaaagttggggttacacaaaccgaactagcagcgatactgcgatggcagaaataatctaagcaaaattcaaccttaactcaatgacgactacagaatatataggttatagggtatatcttggacccttggacacgtccctattatactacatcataatacacggcccaacaatcccaaagacggtgacgcggaacccgaacatattctgagccgcttccgcccgctcctggccgccgcctcggcggcagcagtgagcagagcgcctccagcgccccgtgcacttggtggggagtggaagagaggagagagagaggagtggtggggaagggannnnannnnantatatgaaaggcttanagagaggagttgtcgaaggagaacaaaaggggaaaggaaaagagaaggtgaaaaatttgaagtgaaggagagggaaaaaaaggaagagatattttcgcgtgcggtccactggagaggtccgcacgtaaaaatcgatttttccgtacgggtctcttaaggatccgcgtgaaaatagaaggctaattttttatagacgaacatgaaagaggtccgtataggaaaatgggagctccttgtgtaggaaaatttttttgtgtactagtgacaatgaatttaacgggaaagctgacaaaaagaatatatgtataataagggtatagaaatctgttttaaaattatttaacctggactatggtgtaaaagcaagttttttttttgacaattcaaaagagttaagagttccattgattcagaacaagtatatggtacggcacgggctttttttttaaaaaaaaagtatggtacgacacgtattgttaagtttcgcaacaaagcaagcctattgcactgcagggcacgacaagcaagctactagctagctagaatgctctactagatcgttagctagcagccggctgcgacgtcgactcgacaatattctagacaaattaatgagcatatatatatcaggaggatcatatctgtgccaagataatatattgaacacaactcatcaagtgacaggtctcacacaccaacctcttggagaagacactagagagattaggcagccatggctgtgatgctagtgccaattccactactactcttgcaccagcaccacaaccatgagcatgagcatccatcgccggtagctccacagccaacaatggcatcctactacactctcctgctggcgctcctgtgccctcttctcctcctactcatcaaactttgccgggcgaaaaccagggacgacgagctgtttgacaagctcccctcgccgccaggaaggctccctgtgattggccaccttcacctcattggctccctcccgtatgtctccttccgtgaacttgccatcaagcacggccctgacctaatgcttctccgcctcggcaccgtcccgactctcgtggtgtcatccgctcgtgcggcgcaggccatcttgcggacgaatgaccacgtgttcgcgtcacggacctactctgccgtcaccgacatcctcttctatggctcgtcagatgtagcattctctccctatggcgagtattggcggcaagtcaagaagattgccaccacacacctcctcaccaacaagaaggttcgctcctacagcagggcaagacaacaggaggtgcgcctggtaatggccaggatcaacgaggcagcggtggcacgcactactgtcgatctgagtgagttgctcaattggtttaccaatgacatagtgtgtcacgccgtgtctggtaagttcttccgtgaagagggtcaaaaccaaatgttttgggaactaattcaggccaactcattgctactcggtggtttcaatcttgaggattacttccccaatttggcgagggtaactactgttaggaggttgctttgcgccaaggcccataatgtcaacaagagatgggaccaactgctcgacaagctcatcgatgatcatgccaccaaacggtcctcctcggtgctagacctagacaatgaagagagtgatttcatcgatgtccttctctccattcagcatgaatacggtctcactagagacaacgtcaaggcaatcttggtgatcatgttcgagggcggcacggacacggcgtacatagagcttgaatacgccatggccgagttgattcggaagccccaactaatggccaagctacaggccgaggttaggagtgtggtaccaagagggcaggagatagttactgaagagcaactgggaagaatgccctactaaaggcagtgataaaggagatgcttcggctacacctcgcagggccacttctcgtaccctacctctctattgctgaatgtgatatcgagggctacacaataccctctggcacacgtgtcttcgtcaatgcatgggctctgtccagagaccctagcttttgggaaaatgctgaagagttcataccagagaggtttctcaatagcatagcacctgactacaatgggaacaattttcatttcttgccattcggtagtgggcggaggatatgcccgggcataaattttgctattgccaccatcgagatcatgctagcaaaccttgtttaccgttttgattgggagataccggcagatcaggcggcaaagggaggcatcgatatgaccgaggcgtttggactgaccgtgcaccgaaggagaagctcctccttgttcctcggctcacacaagattaaatagtcaatctatatatcttatctaagtagttgtggtgatctcatttttcatcgtgtaagtggtgtgcttgttcactggtatctatttatctataataagagaaaaaaaatggaaattcccctatatgtggagcgtgtggtcctggactggaggcatgcagattcgacgagtcagcggttcacatctatatagatagtatcctctagtgcgttgcacggatcttaaagcacttggatggtggatgagcccggacactatggtgtccctaacaaatttaatatatataatgcacatagtaccaatttaatacgtacgctaatttaattagcactaatctttcatgataaattaggaagctacatatatacatatatataggacttatgcaaaatccgtttttttttcatttaataggttgttacattacaccatctttatcgtacatagtactccctccgtcccataataagtacaattgtgagtttcagcgttcaattttgaccatccgtcttatttgaaatatttttatgattactatttattagatgataaaatataaataatactttatgcgtgacttaacttttaatttattttcataaattctttaaataagatggacggtcaaacgttgggtacgaaaacttatggctgcacttacagtgagacggagggagtatatcattaagtggaactgtcctggcccagttcgaaccagattaattatggattatcgattgccatgagcacactccttgatgaagcttcgaattagacttttttaaataaaattttaaactttataatacttattaatttatttatttgtaccctcgattaattaccacaaaatcagaataatccatcaagagcaccatagatcgggctaagcagctagacacaaaataacagttacgacatcaacatactacatcaacctcctatatatcatagaagttggcgccgtgaaaaaagtttatttagtataagcttttcaggtttctatttttctaaaataaatttttcgcaaggaacaaaaattgaaaaatccagccatcggtgctacgaacgggccaagagataaaagagcagatggcatgtcaatgtcagtatttcaatgcaaagcaagtttcatgttccttttatttttaaaacagaataagtttcagtacacccataacaaaatatatatatatatagtacattgtatcttccaaacaaaaccatactttaacagaggaggacgtcggtcattatttctttaacagagcatgtggggtaatcaactgcatgcaagaattattagtttattagcaccatccgtttaatggtaattgattggtggatcgcgcaatgtcaaatatcaatatgctatgttagtgtcgtcgtatcttccaaacaaaattactaatttatgtggtaatcgaccgcgtgcaagaattattagtttagcacaccatccgttgaatggtaaatgattggtcgatcgcgcaatgtcgaagatcaatatgccatgcatgccagtgtaatcgtatataggagtatcgatcttccaaacaaaagtatctcgatgcagtaatgatcgatgcacggcgcgcgttataaaagaagcaaggaccttccctactcaactcactcattcattcatcaaagttgaaggtagcttaattagctctagcgagctagctagcttgctctgtcttggaagctagctaggccactgatacgtagtagaacgtagcagcaatggcccaaatgctaggagcattattattgttccaagacagcctgatgagcaccatgacaaggatgtcatactctctcctgctccccatcttgtgccctcttatcctcctactcctcttccgttgctatgcctatgcaacaaggtccggcgggatgctcgacaagctcccctcgccgccgggtaggcttccacttatcgggcacatgcacctcatcggttttttcccacacatgtcactccgcgaccttgcgactgacctgatgctcctccaccttggcacggtgccgaccctagtggtatcatcctctcgtatggcgcaggtcatcttgcgcacgcacgatcgtgtgttcgcgtcacggtagcaatctgctataaccgacatccttttttagggtgcaacagatgtcgcattctcaccgtatggtgactattggcggcaaataaagaagattgtcacaacgaatctcttgaccatcaagaagatccgctcctatagccagacacggcaacaggaggtgcgtctggtaatggccaagatcgtcgaggaggcggcgacacatatggcaatagacttgactgagctgctcagctgctactccaacaacatggtgtgccatgctgtgtctggcatgtttttttgcgaagaaggccggaaccaactattcaaggagctgatctagatcaactcgtcgctccttggtggcttcaacattgaggattacttccctagcttggcaaggctacctgtcaggagactgctctatgccaaggcctatgatgtcaagaagagatgggaccagttgcttgacaaactcattgatgaccactctagcaagcatagatcctccttgcttgacaataatgatgtggagagtgatttcatcgatgttctactctctattcaacaagagtatggcctcactaaggataacatcaaagcaaacttggctatcatgttcgaggctggaacagatacatcattcatagagctagagtattccatggcagagctaatgtagaagccccagatgatagccaagctacaggctgaggtgaggggtgtggtatcaaaagggcaggacatcgttaccgaggagcatctaggtaggatgccctacctaaaggcggtgatcaaggagacactccgactacaccctgcagcgccacttcttgcgccccatgtctccgtggttgactgtaatgtcgagggctatactataccctcaggcactcgtgtcatcgtcaatgcatgggctattgccagggaccctagctattgggaaaatgccgaggagttcatgccagagaggttccttagcaacacaatggctgactacaatggaaataatttcaatttcttgccattcaggactggtcgaaggatatgcccaggtataaacttcgcgatcaccaccatcgagatcatgctagcaagccttgtgtatcgcttcgattggaagctattcacctcaaggatcgatatgacagagactttcggggcaactattcacctcaaggaaaagctcttccttgtcccacatctccctcaagataattagtcaacttatctcgatcttaagtctagtatatatattatcttacaatttgatatcttgatattgtatcgtaaccgcctctgtcaacaacttgtgtaagtagtgggcttgtacgatgtaactatttttatcttttccttctaaggagggctttgttgtaacttgtatgtataatgtatctataccactccacctactcataattttgcaaataacctcttgaacttctcaatattaaaaatcaatcagatctaaatggatagccacatataatgtcaaattaaggtgaaatattccctatagcaaaatgataggtacacatttctaaacaataaaaaagggtagattaatattgcctttctagctaataacttaatattgtatggtgcttaccttttgtcaacgtacatacttgtgtgagtgttgtaacatgtaaagcataaacatatactatatatatgaaaggtggaaccaatatttcaaatactcaaatttattggaatacttgcactgagcgctacagcccctccccttcaccgctgctgccaagcaccgccgtggatttgaggtgaggggaggagaatctgaggtgagggagagggaagggagagttgatgggtaaagagatagctctaagggagagggagaggtgaaggagaaagagagaacgagggagaaaccggtcacccttgactgattcgattgatttattttatatgattttcgcaggcggtcctattaggaggaacgcttgtaaaaatagacatgttttcatagccattttctcttaatgaaacacgtgtgaaaatatcgaaatattaattttcacaagtggtctgtaaccttaggaccacatgctgcatttttatataggtaggatttttttactgcctataaaataaagtggtgatgggttgatggtgtcgaaaatgattttttaaaatagttctacttacccaacatactcatgctgttgaaaaggaactccatatatttggttagattctagaaaacgttggccattccatcatcctattaccaccacacttcattatcgtgaagaaaatgaatgaagtcactagtaggtggtagcgatactaccttaagtgagttttcctagtggacctaattaaattcctgcccatattccgcgattatcaaatggaaaaagtacaccaaaggtccctcaacttttcatcgggatacaaaatcgtcctccaaccacaaaaccagatatgcggggtcccttaattatgcaaaactagtcacaataggtccctcgacggatttgatcccggttttatcctacgtgactgctgagtcaacgtaagacctacatgggccccacatgtcagcctcctctttctttcccctcttctctaccttcctcttatcactctctctctcactcttctctctaggctcttggcacgctgcggggagggcggaggcgctgcagaagtctacgacagggaaaccggtggcggcatccttgacgcccacagttgtagacggcgatgcagttgtaagtatatctatctgattcaggaagcaatataaatttaagggggctgtatatatatatcatgtgacagaaaatcacacctcctattattcgaattttggaccattggatatgctttaagattcgtgcaaacacttaaccctatcttcttatttcgtccccccccctttactcgagcattccgtccgatccaccgtcaccatcgctacccgccgatccactggcgnncaccgcccaccaacgccgcggcccgcttggcggnttgccggaaagagtcaacgacgcccgcgaggcccccccccccaacccccctcttttttttttaaagacgggacagcagaattccnccgttccgccgctttcccgtcttccgcaggtccccgtggtggatcggcaccacg

SEQ ID NO: 10009 - DNA, 1580 bp, Oryza sativa
  unsure (1)..(1580): unsure at all n locations
gatgaggtgagtatcgcntcttctgcaagcacntcatcactttaagatttcatccccaaatttcattcaaatgacatatagcaattccataattaatgcttaattgttcatgagccgatagattaatatattaattgttggcgaatcgcaacaattaaccggcgcatcacatttggcaacgtacgtacttgagtgcgtgtcacttgtcagaagcggagtctcgccaaattctttcatttcattgcactattatataagcatacgaatgcagaagtataatattaaattctgcattattaagcactaatgctagagccttgagcataaaatcattttaccggacgtacgtatatatagtgcatgtggtaatcaactgcatgcaagaattattagtttagcaccatccgttgaatggtaattgattggtcgatcgcgcaatgccaatatcaatatatatgccatgtcagtgtcaccagtacgagaataagaacgatagatacatcatatcttccaaattaaacagaactaaaatttaatggaggatgatgtgtcgatgcctgccttctccctctaaacataggagtaaataatgcatggcattataaaagataaacacagtaatgatgcatgcatggcgagcttgctcaactcattataaaagaagcaattaaggaatgccttcctcaactcattccattcatcaaatttgaaggtagctagctctagcgagcttgctctgccttggaagctaggccactaatacgtagaacgtagcaatggcacaaatgctagacggcctaaggcatgatgagcaagcatcgctgcatgctccacaggaggccagcaccatgccgacgatgtcgtgctctgatctcctgctcgccatgatgtgccctcttatcctcctgctcatcatcttccgttgctatgcctacgcaacaaggtccggcgggatgctcagcagggtcccctcgccgccgggaaggcttccggtgattggccacatgcacctcatcagctctctcccgcacaaatcactccgcgaccttgcaactaagcatggtcctgatctgatgctcctccacctcggcgcggtgccaaccctagtggtttcgtcggctcgtacagcacaggccatcctacgcactcatgaccgtgtgtttgcgtcacggccctacaatactatagccgacatcctcttgtatggcgcaacagatgtggcattctcaccatatggtgactattggcggcaaataaagaagatcgtcaccatgaatctcctgaccatcaagaaggtccactcctatggccagacacggcaacaggaggtgcggctggtaatggccaagatcgtcgaggaggcggcgacacatatggcaatagacttgactgagctgctcagctgctactccaacaacatggtgtgccatgctgtgtctggcaagttttttcgcgaagaaggtcggaaccagctattcaaggagctgatcgagatcaactcgtcgctccttggtggcttcaaccttgaggattacttcactagcttggctggtgngcanctagcatgcgatctagtgaca

SEQ ID NO: 10010 - DNA, 1841 bp, Oryza sativa
  unsure (1)..(1841): unsure at all n locations
gcatgtctttgagtcgagctncacagtagcncatcaaaacttggttgtcatgttcgaggctggaacagatacatcatacatagagctagagtatgccatggccgagctaatacagaagccccagctgatggccaagctacaggctgaggtgaggggtgtggtaccaaaagggcaggaaatcgttactgaggagcagctaggtaggatgccctacctaaaggcggtgatcaaggagacactccgactacaccccgcagcgccacttcttgtgcctcatgtctccatggttgactgtaatgttgagggctatactataccctcaggcactcgtgtcatcgtcaatgcatgggctattgccagggaccctagctattgggaaaatgccgaggagttcatgccagagaggttccttagcaacacaatggctgggtacaatggaaataatttcaatttcttgccattcggaactggtcggaggatatgcccaggtatgaacttcgcgatcgccgccatcgaggtcatgctagcaagccttgtgtatcgcttcaattggaagctaccaatagatcaagcagcaaatggaggcatcgatatgacagagactttcgggataactattcacctcaaggagaagctcctccttgtcccacatctcccttgagataattagtcaacttatctcaactttaagctgttggtatatattatcttacaatttgatagcttgatattgtatagtaatcacctccgtcaacaacttatgtaagtagtgggcttgtacgttgtaactatttttgtcttttccttctgaggagggctttgttgtaacttgtatgtataatgtatctatgccactccacctactcctaattttacaaataaccccttgaacttctcagtattaaaaatctatcgaatctctaaatggatagccacatataatatcaaattaaggtgaatattccctatagcaaaatgataggtacacatttctacacaataaaaaaggtatattaatatttcctttctagttaataacttaatattgatggcgattaccttttgtcaacatatttgtgtgagtgttgtaacatgtaaaggataaacatatactatatgaaaggtggaaccaatatttcaaatactcaaatttattggaacacttgctccgagcactacagcccctcccattcacagctgctgccaagcacctgccgtggatttgaggtgagggagggaggatctgaggtgagggaaagagtgagttgatggacaaagagatagctctaatggagagggtgaggtgatggagaaagagagaacgagggagaaagaggccacccttgactgactcaattgatttatcttatacatctaaatgaattttgcatgccgccccgcttgtaaaaatgaacatgttttcataggcgttttcttttaatgaaacacttgcaaaaatctctataatattaatttacacaggtggtttgtgaccttaggaccacatgctgcatttttatagaggtaggattttttttatcgcttataaaaataaggaaaaagtacgaattatctccccgaactaatgcgggctnnctgaactaccacttgcgcttacacaatccccagatccttcattctctcatttatgcagacctggcgcatttatcctagctttaccctctatgcattgtaagtttgggtctacatcgtctattccaaactgggccttaatagcatcacaccttcattaaaaactgggcgactccgctttataatcgtaacctatactgttttagtttcaacccggataaggaatctatataatctccgcttgccct

SEQ ID NO: 10011 - DNA, 21523 bp, Oryza sativa
  unsure (1)..(21523): unsure at all n locations
gcggattgagatcaacatagagtcnctcggcaanagcncatcacggattgggtcgaggcagggtaattcgtccggtttgtatagttgggggtgaagaatgtccggttttcgggttcagggggtaattcggacgaccgcgatagttcgagggggggggtaattcgtattttttcttaaaaataaaatggtgatgggttgatggcgtcgaaaatggtttttgaaaatagttctacttacccaacatactcatgcagttgaaagggaactccatatatttggttatattatagaaaacgttggccattccatcatccttttaccaccacacttcattatcgtgaatacgctaccaagggattttgctgctacagtaagagaagaaaatgaatgaagtcactggtagcgatactattttgaagtgggttttcctggtgggcctaattaaattccagcccattattccgcgattatcaaattaacgaggccttgggtgggtcgatcaaacactgttgacaaacatgggctggatttaagtcccatcgatccggcttgcttaacggttggcgtcctgctttttaattttcgttttcctttatacgaaagaggagagttttaggttttaatttcatatatatgtagaccctatatcccttcaaaaaaatatatatctagaccctatattgatatattcgttcagtatagtcctcctcatatacatatctagagtgtactgatttatataaaatcatgtatgtcgttgcctagcactaatgcttatgaagagcgaaccacacagtatattatagccggaaacaatcatttatttaccggtgcaaatttttatagtatccccatgtaaaaacggatttatcctcctccccacataaaaacaagtttaatagtagatctaactattagctataagctcaagttagagttaacttgtacaagaggttaattataaggttagccctattttttctctcctttctctttctctcgctataaatttattgtaaatatcttggagcatgtgtaaaactagctcttgtataggagccaacaccctcacttttctttgtctctcttttccacgtaagtttatagtataacccactattatccttgcttaagaaaccacactgcctaaaagaccaccaaattaaaacgcattgtacccatataaaattgatcaccagaaaaaaaagatagaaaaaaactaaaatctatgaaatcaacaatccgtattttacacagggcatgacattagtactactctctaaaggtgtggtggtccatccccgctgcccctactctcattggctgtgtgcagcacaagataagaaaaacgtacaaaaataaatattttccaaaaaccatccgcccctccgaaaacttgactaattattgacccttttagaaaacttatgccaaaaatagattagtaaaagaaaacttaattatttcaaaaaatggaggggaagctaattaagcagcgccctgatggcaagctgagattgcccaaaaatattatacatggtagaacttttctaagtattatattttactctcatttgttttaattagagtgttgattttaaacctatataagctcaaagaaaatctatcacattacattgtatggaaatagatcctctaacgtaaattcaacataatgtgggtcacaaacacgtgaggtccaccctagtgggcctagatattaaaagcacatgtcctacgacgtatgtgaaagaatcttcatcgacactactccctccttttttaaaaaaaaatacaacatagaatggaatgtgatacagtatagtatagcgaatctggacaatcatcctaggttgtctttttttttacggaaggagtatgcattaagcaatttatactcaaacctccttgttttaatcttcacatttggagatctgtaattctccatttggtatggagcagctagactgttgatagttgtccttttttcaaatcatttttaattaacttaccttttcatttagtctggatatatgtgagctgtgttagcaatttagtaatagtcaaagtacaatatgatgagtaatgtaatttgtcggaagaaagaggagcatccagcatcatcagcagattctctagtactagtaatttgaagagaatggatgctagtatatttgacgtggtctcactttttttgtgcacagaacagtagagtggctggcataagcagagctgtcgatacgtcactttgcagtgggcccggccgccctgaccggtaaaaaggaagaatatccccgttgactccgacgacgacagccagtcaaagtcagtggctcctaatctctctcttcttccttttttttgttacttatagctgtaataatggcggtaatagtttaagcacgtgttgtttcaacttggaatcaaattgcggctcagatccgatcacctttaacctatggtttggtgtgtaacgtccaaacttgtccaacttgtgaaccaaattgaataaagtccttacacatcgatgtgaaagtgcactgttttggcggatcattttcaactttgtactgtatttagccggcccaccattggcttctggcagatcgtcgcggatggacgaatctccatccccaagctctccccccaccggatcgatccacctaccttgcctatatctgtcccagacctagccggcaacaggcttgcggcccctcaccccgccgcataccggctggaaagacgacggcgacgaggtgcacgccggacctgagaccgcccccgccgctcagtgcgatgagccgaatctaccgtgtacggaaaccctaaccctcaatggggaaagctaaaatgttcaggcttggcttctgctataatagagggactgaaagcattttggcatataacatagggacatttttgcataaacaaccaacaatgtggggagtgcttcgatctgtgttgtacacttttcatccgacggtccacattgatgattgcattctcccaccgaatagtagtattgcaccggatacttttccattcctatatccatgacatacatatagcatcatagtcatccaaacatatttacatagtcactcatctagcaaagagacattaaaagtaccacttctacagttcatagttatgcatccattgctggatctggtcaggttcttcagattcctacttcataatcatcaaatgtttacacaactattaggaagcataaaacttcctttcctgttctacgctgcataaattcagccctcaccacctgcaaaacaatagaatggcaaaatgagctcagcatttttcttcctaaaaggatcaagaaattgtaagcataactaagtcaatttcctgctatttcattctacaacaatatggtacattcagtagatgcactatcagcgcaaagtccatggcatcttgtagtcctattgagctatcctatcaatacatgaactctggttggtacatccagtagatgaactatcactatatcaatgcaaagtttatggtattctttcgctattacatttagctgcacttgttatatagggttaatatatgatttagttcaactgcacctgcaaattgctcaatgacatctcaaatagagattttgacctcacaaactgcacttgttcagacaactgtatgcatccatatattatcataagaatggctgcatccattgcaacttgcttgggaatatagaactttagagtttagacaactagatgtcagggaggtggacattgaacatgttcagtcaaacaaaatgctcatggtcactagttctgaaatatgaaatttcacatccctaaattctcacggccagatctgaaattttccccctttttcattgcataatagcaaccaatcaaacaaagtagacagccatccccacatgaacgaactagatttgaagttaaaatctgggagaaactttagggtttggggaacaaattacctcagtgtcggccgtggttagccgtcttgcacccgacgccttgctcatcctcaaccttcttcgctgccatgcgctgcccctagccgccggtgcctccaccgcccccgtgctccccttagccgccatgcgccgccgcccgccgtgtgccgggatgggaaggagagaagaggggatacactggaaggagaagtccgtgcgctgccgcatttttcccgctggtccatcgttgccgccggctgctcccccctcctccccacgtcgtctgctgcttcgcctcctcgctctctcgagatggaggtcgggggagatggggtgaagcggtacgggggagggagggatgggggttagggcggtggcatttgctggtaatttcatcgaaaatgtgtgggcaatcttgtaatgtgattggagttggagttgaggagcgacaaaaatgccgctctagtccggtagttcattttcccggagcgattcggtgcgctccgctcctgtttcgaacgaatctggactgtttggatggactacagctataggtaagatgaatatgggagctagagtcccgccaaacaggccctgagtactagtagagtagagtatagtaaaaccagatctagatcggtcgtctgctgatctgtgcgatgcgagcaaaagtcttgcttcttcagtcaatcagtcaatctctaaaaaaaacaatcgtattttatataaaaacctctattctcctctttagaaaaaaaaaatcatatttttggattaaaaaaccctctattttcagtgattattttctttttcaggtattatacaaaaggtttatattttctttttctcgagagaagcatttgttcacttagttttaggacccaaagtgtcactcctaaggcccctttaatttgaagaaaaaacatagaaattttagagaatttcaaaactgtagaaaatctcttatgaagtcctttgaagcaaaggattgaatcctatgcttttctttgaaattcctatggaatggataatcttatatagtttttagaggaaatttagcaagagctttaacctttttgaaatttccctttgagactatctctctcatccgatttctacgtttttcccgcggtcaaatcaaacgaccattttcctgtattttgcaatcctctattttacacatacattcctattagaatcctgcattttttctattcctccaattttgcattgttgcgattcaaagaggccctgattgtttagttaattgattagtgaagtagtaaaaaccagatccagatcggttgtcttatagagcatgttcacttagataacattttcaatcttaccaaattttggcaaagttgccaaaaaaaagtggttacatttagtttgctgccaaactttaataaatatataagaaatcctgccaagatttttacaatattgccaacataccaaaattttgcaatgccaaaattggtaaggtttattttggctacaatttgaacaagcccctaatatgtgccaagcgagcaagtcttgcttcttcagtcaatcccccctctctctctccaaaaacgatcgtattttatagagagagactagaggacgggataccgttagaatgagatacttagagtgactcatccccttttttttatagctgagcttccacgtcttttctccttgtcttgctagccatatcaacggaaggaaagggaggaagcacgttgaggagggaaaggaatgagaggacatatggcagcaagaggttcattgccgggcacgacgacgatggcatgcgctccctcttcacacctggtacatatggatgttctggctggtatctggtacctcggataccagctggtatctaggtatcagaccttggtacctggcactatatattatcagaaacctctattctcctctttaaagaaaatatcatatttttagataaaaaatatctattttcagtgatatttctagaagaaagaagtgaaaaatcctcactttgttttgagtttggagggagagagagtagaggaaggaaacctccctccggatccaggaaatcctcatccatcctcatgacttccgacgagctcgccggtgagggtgaggtcgacggcgcggagctgatcctgtcgctgccggaggacgtgctcgggctcatctccgcccacctccgcccgcgcgacctcctcgccctttccgccgcctcccgcagcctccgcaacgccgtctccaccgccgacaaggcgtggctcgcccagtgccgccgcctcctccccaccgcctcccacctcctcgcctggcgcaccgccctcgcccactcctccctcgccgtctgccgcttcctccactccgccgccccgctcctcggcctctgggcccaccagaaccccgagctcggcaacctcgtcctcgccctccctggcttcctctccctcgtcgccgtccgctccatcccccaggagctctccccgcgcctcctctgggcccccgtcttcgagctcctcgccgaccaccgcggccaccccgccttcctcttcctccacggcgccgcccacgactccctcttccccggcctcctctcctcctccctccaccccctcgccaacaccctcttcctcgaggcccacacctccacctccacctcccacttctcccgcctcgccttcgccgaccgccgccgcctcctcaacgccctcgtcgccgcctcccgcctcaccctcccccccgatgtcgccactgccccgctcttcgcgcgctccgacgccgacctcccgctgctcgccgcgcgccgggaggccatgctgcgcctgcacagccagtctggcgggggcatggtgcgcagggccgagatcgaggcgctgctgatcggggccaggaagacggcggcgctgccggccgacaccgccggcgacaagatgcggctgcggaggaccttctcggtggtcgccggttttgtcaggaacagcctgcggcagatggtgacacggtcggcgtccgccaattccagggctgagtacgcccaccccaagcatctgccattggacgagttcctgcgagccggagagagcgtcggcctgagcctccgtggcgcgcggatgaggctgtctatctaccggaattggccaagcatgcatgacaaccggtttgtgctctacaagctgacgacgcaggcgcccatgcctggccgggagtatgccggtttgtggggaggcacattcgggtggccgccagggcggccggaggatgagcgcaaacctggcaaggctctcttcttcctactcctctcctatgaggaggacagcgaagggaagcttcagctgattgcaaccaaggtgttggagggtacacactatgtcgtgcatccgaatgggtcctctatgtttatcgtgcgggtcggtgagccatccactgagacttttccgtggcaaaccgatgaggagtcgcgtgctgtggagatcaatagaagctttgctggtgagggcattgccaccgggtatgggttcaggtatcctggctcaaagcccggatcgctctttgtcctcctggatggccggcttgcatttgtttggagagagaacaaagctgttctcaccttgcaaaggctggacctggaggatatgataaggagaggggagcgtgtgccttcattgccgccgatacccaacttcgcctacctcacaaagtcttactccaatgtctttgctgtggcacctggcagcacgagcttcccagcttctccaaggtatgcgtatcactagtgttactgcacctgcacatgatacctgttatgaattccagtccctggtgtattatcatgttgtataggtttatctattttggtaattcagttgtgagcaaaatcagacgctttatgctaaactttagatagtgagctcttgttgccaatgctaaactttagactgagctcttgctggttgataggtcattggaggattcagccagttttctttgactgcagccacttcttatcgacaggattaaagtgtcaagcctaaatgtagtgatcttagttctgttccatgcacgatttagttcttctttgaatgtaaattttaaggtgtcagtattcatggtgatggatagaaatacatgccccatcattctatactgctgtacagctgaaggctgtgccctcagtacacggcaaaatacatcagtgccttttctctgtacatggaaaaaatacacgagtaactggtaatttgcatttgttctgaaacagtagtcagcagtactaaatgactataaaacaagtgatcactggtaataaaaacttaatgtactagtttttatgtggttcttgttacactactgctttattgtagatttataattatatactagctagcctgtgctgtactgctgttaatcacgtataaactgagtaaggtccataggatgatccatgaatctctgaggattctgcttaccccatgcaaaataagactgtctgcatgaagttctattatcatattatacagttacctctttgtgaccagcctggagtgtaatctggacgaccatgtagagctcttccatttttctacgacttatgtgtgtgatttacagattctcagatatttgacctgtacccctgtaaaaacatggcagcttccttctaagttgtaacaaacagttttgtgaatatttgatcaaaatttctttatttttgcttccaaatgctttgtcttgtatagtctagcatcctatctatttagtgattatacttccattgatcaactcatttgacaagatgaaaccccttctgttaggtaaaagatggcttgggaaccgttatgatggtatcacctgatacagaggcaacagcgacagatctttgcgggatcatgttctactgtgcttccttgccatacgtcttgtactgaagatctgaatcccacatttttcaccctgaacctgaaggttggccatcaccgtacgttgatctgagttgatgtaccgctgctgctgctgttaatggaagcagcatggcagcagtgttaatatggtatatattggtaccctgaaggaaatgcagccaactccatctgtatttcccttgttactgaactggcatcttcatgcctgcagtaaactaaaatgtcaaaatttagcaaatgagctacagtcgcagatccagcctcctgatgataacatcatgaggtgttaaactgacatgagttgaaagttacattaatgtcaaattgtaaaattttggaggcatacagatacagctaggtgaccagcgcaaattgtaagctggcacagtaattattttggcatgatgtcgctgggtgaatcgttgcagtattgattacctgcgtgctattgctacgtctacagctgttatggtagaatataaatggaggagtaaaagaaacgctactagttgtatttgggcctttgggggcgtatggagcgttgattttggtccagcccgggtaagaaactataaagttgacattgttcatcattgacaattgtcatggaaagtggtagtgttcttcgatgcttttcccactgaaacatttggggtgtcttgctgggctgcaaaacccattaaaacatgagtttagtgaaatataaaaatagagcatagaaatcgacacgtggtattgcattatagcgaaaaccttccgtcactatattatttatattttaattatagttatatttctcaatacgtcataggtttttcccgcgcatactgcatgaatccacccgcacacgtaatggaacacataaccaactcgaattgtcttgtatattaacctatgttccgttatctttttttcgccatcctgcatggcaataatatgttaatacttgtttactcaatacatcaccgattaagaacaatctagatgtacgactagctataatctctttgactctataagttatctctgtcaccacctctattatctccttttactcacttaagctatataccagcctaactctaagatttacatgtaacatgaaaaagaagaatctcaagggctatgtaggctctatttggggagcttctagctgctacaacttctcccagaatcagaagctcccccaaatagcccagcttttggtccagattctgataagctgtagttatagaatccagaaaatgaactagaagccaaaagctagcttttccagattctcagaagttggctatcaactagctgcttgtaagaatcttaagctcctcaaatagacccataattttactcgtagatgtgtatggtggaaacattggagtattggaggtttggtggagcgagcaaacacaagggcccacaggatgaggatgggttgtcttgtgtccagcccaaccccgtttcagtttccattcccgttccgttataataagaggagagagagagagattttgggtttgtctccggctccgctcgccgcctccaaatcccgctcctccgctgctgctcctctctgccgcggcgaggcgagagatccgaatccaccgccacccgcgcccaccccgcccgcacaaaccctagtttttccggggttttgcttcccctccgcagctccgctccgctccgtccgtcgtctcctcccggcggctcggcttgctgtccatgctgtagccgccccccgcaggtggctgatgggctcccagaaccgccccccaccaccgcgcaagaggcagccgccgccgccggaggaccacctcgtcacctacaagcgccgccgctccaaagaaacacaggtaaccaaccaaccaactccctgcctcttcttcttcttctttctccagatttcctttcgatttctacaagattcgtactctcgcttcttgcctcctcttacaatctctcattacatctacttgttgtgctttcttttcttgcagcctttgccactcatggccaacggcgccaattctaagaaagacgccaaggcccaacattggattagctggagggacactctccacggcttcctccaatcccctgctattagccagggtggaggaattcagacctgcatccgtcatgctctccaacacaatccttgcttgctcaccaatggtgttgttgttcacactgaattcaaagtaacacacaccacctttgtttgcatctaccctatatatatttatgcaatgataattttcctaacacatgacttctttctcattaccagggtaacccaactcattcccaaggagaggaaggcaaagtgcagcaaccttatggtgctgctggaggcaaggtgggttctgcagatgcttgtatacaagatgcggttggcgaacttctttcggagctaacaaggcaatgtgtaataatgccctcttcgacattttggtctcccagaaatttgccttgttgtgccatttgctacttgggaccttcaatgtcaataaacctggtgatgtcatcgacttggaaaaaatcgacgccaagatgagaaatggagactatgcccacaaccctgcactatttgacgatgatatccagcaggtaattgtttctctattgctcccatgaaagtaatttagctactgttgttggagggaaataatactagctagtgtttattcttatcttttatctaataaagatgatgcatattacctgtacttataagcgccctctgtatgctaaagcttaatgtgttctccatctattattgttcacaactccgtaaatcataagagcaaaatgttctacgtacggccagttgatagaatgatgctgatgctcaactgcttatctgagcttcttttgcgtttgctagttaagatcttcccaaattgtttgaaccatccaagcaacagactcctagggagtttatcacaactgaccttctagaactctggttgttagggttggaacgctagtcaacttaaatggtatactagccctgtttctacactatcatgtcttcgcaactttatatgctctatttctatctgtctgcttcatctgctgtccgcaacatgccaactcccttgcgcttcatggttgatgaagtggaccatggataatgtggttgagctggggtatgacacacacaaaattctggaacatctcatgcatgctgcatgtgtaaccactcaatgctgaggtttctgtctaagtcaactagggttttatcacttgttttcttaaatgggcacaacacaaaaaagaaaacttttataatatttagtgctagcacatctcaaagaccgaacaattactcttctatattgatttccttatcagttatcattgatatacttttttcatctgtgagtttttttgtttacattatattgttcatgctctaaacatagaagttgtgtagtaacatctaggaaaaattatacgatactgttgcctgctgagccttcctcttaatacaactctctatttgtttattttgtagatgtgggagaagtttgagcaagttggccaagagatgacaggtctagcgagcaacctttcaaccatttcacgagtttcataccaaaagcaggtaatctgttgctttatctttcaattaatgtctctagcgtcgagatggttatattttgacaatttgagttaagataaatctattactgcacacttggcaaccatgctgcaatttgcaggatgctttagtatattgaaatctttccttttatgctgggcattactaatggataaattattttataggcttctggattttctgaagctgaggtggctgagcacagaatagaggtaagttgtctgtttgaggatgtttgctaatcattgttccacatgcacacttaattaataatggttttactaattgcattcttcattaggaaataagtttgccgggtgctgtccacgttgtcacaaaggagtcgactaccaccgtgcagttggccccatgtgattctagtcattctacaataccgaaacgaactgtgccacctggacgtgatctgtgcccttgcgatggttgtggcaccaaggtagatgttgaagaaggcctaatctgtgatgaatgtgacaccatgtaccactttgcatgtgtcaagctactcaatcctgatattaagcaagttccagcaatctggcattgttcaacctgcagcttcaagaaaaaagaattggctgcagataccacgaataatgttgcccatgactgcttgcatggtggtaactgtgttttgtgtgaccagctcgagctggtgaagacagaagaagaagatcccaagcttcccataaaaattgaattagctgaagaaagagaggggagctccgtctcaagcatgggggaagacaatgaaccagacctgtcaacaactgccctgtcaaacttgtgcaaacactgtggcacatgcgaagacgatgacaagagattcatggtatgcggacatccttactgcgtttacaagttctatcatatccgatgcctgaaaacaagccagcttgcaattgagcaacaaaagaagcttggttgctggtactgcccctcttgcctctgcagagggtgcttccaagacaaggatgatgaccagatagtcatgtgtgatggctgtgatgaaggttatcacatatattgcatgagaccagcacgcaacactatccccaaaggtaagtggtactgtacattttgcaagatccgcagggcagcggaaggaatgcataagtatgaggattctgtgctgaaaatacatgggaatagtaagcatgcttgtaatgtgaatcagtcgaaggattctgaaggtgatggtactgaaaagtgatcatcacaatagctttgtggattagcttctgagctcgcttggacaagctcaggaaaagagattctttggccccttaggagggctatacaccgactttgatactgaatcagttgtgtagtttatttaattaactgccgttgacatctacaggaagaactcttacctggtgaagatggtgtatgtagtcttttagctgggcggaatgatgtgttgtttacttgttcaccttccttctttaccccctttcagtgaccattgtgaatgttgtcctgtacttgccctgtgatggtattcttaaacgtttttttgggggaaatatgattttgtttttttaatctcctttttattgcttgattcgtcattgtttatagcctgtgatcgatgattgtgaaggtttatagtctgtatgttgtgtatgtaatggtttggttgatcctgaagctttttggaggtcttatttcagtcgaggacaagcatgagagtcaaggaagaaagtggatcttcattttgtcagacaattgtgacagtcatggagcatgtaagtagtactagtatatagtttgagtgtatgactaaccctgaatattcattcctatagtaaatagtactcctatatcatattagagattctgtggttggattaataagtagtgtagctatatctccagatgatgaatttatatgtgtccttgatatgaattaatgatatttgtggtgagtgttgacctctatattaacaaatgcatgaacatgagaggatttgcacggcaggatacggaggcctgcctgcctaactgtagaggatttgcattatgtactgcttactccgtcccaaaataagtgcagccatggtttttcgcgtccaactttgatcactcgtcttatttgaaaattttttgaaaaaaattaaaaacataattcacgagtaaagtagtattcatgttttattatcttataacaacaaaattactaattataaaaaaaatttaaataagacggacgatcaaagttgggtgctgaaacttatggctgcacttattttgggagtgaggtactagccgctactgtcaggagtaggcatgtggttggcttctggaaccgtacgtgttgcgtttttcactcagaacaatagtgtattttttttatttagataaagctgaacaatagagtagtatgcttttattttgctgaaaatcaattggactcgtttgaccgtttgatttatgactccatattttactgaaatggaagcatggattcctaaaacagttggctggtgcgtcgatttatattaattaagaagtaagtcatggcagaaaaattctcaaactagttatttgcataaaatttgagaggtgtgagcacatggaaccagtcgtacgacgagtagactcacggcaaaggtaagagagttgcagacttgatggatggtgccacgtttttcaaagaaagggaaagaaagaagccgggaaatcaaatcacacgcgagagagagagagagagacacgtactatgctagactagacaacacccaaaggcaaagagagggagggaatcatctgctcacaccaaccgaactcgcaacctaaacacctccctcttcgattcacttcatcttcctcttctcttctcgtctcttgtagtagtatatatttataaagcccccaaacaaaagagaagacaactgaattagttcgatcgatgcaggcaggcaggccttctagttctacaaagatgcctctaatggatcgttttcctttcctatcgatggcttgattgatacaaagccggttttttcactcctcgggcgtgcgtttcttgacaccggccggattgatctatcatccatccatcgagtcgagtcgagatcgatcttgatctcgatctcgatcgatggaggaagccaagatgggagacgttgccaccatccgagccgttctggcgatcctccaatggtggggcttaaacgtcaccgtcatcatcatgaacaaatggatcttccaggttccaattcttccataatcttcctctccttttcttcccccccccccccccctattcttcttccgttacttcctttttcttttctgtccttgagatgatcccctcgtatgattattaacagcaaagggtcacgcacgcctttcctgcaaattatctgcttcacatgggtgtagttgatttcctagggatgcagcataatataggaacatgaaacaagatactccatcaaaggaacaatctttttgtgcgtatagtttgcttcatctggtagtttatgggtggctatgactgggaaaagggaatcatcttttgagaattgagatttacaaaactccaaggactctgttcctttcagacactgaaaggaattgtcaatttgtcatgtcctcttaagaatgagttaaatgttcagaaaagataacgagaaatacaacggagagatcgaggatatgactcaaaacactaccttttctagctggcaatcattctaactgaaaatgtttcctcaaaagattataaagtttgacaattctcttttggtggatcacccacgcagccacacccaagtgtaagtcaactctatggttctaccttaaatttgaagtacaacgtcgcatccaaaaagaaaaaaaaaagcttaaagtttgcatcttgatgcccttgatggatgtccaatgtaaagttaactagaacagtgctgattctggaaggaactttggtggagtagctttcatgaatattgaacccttggaagggatctctccacctgtttttgggttcaaaaaggaaaaaaaaatcacctccttgcaaccatctatatttttgaaggttgtggtacaattctttttatcggaacacacaaagagcttgcgtatcattgcattaagaaaacttggttttaaagatactaacagcctgcataccacaggatattagactcagtgcaaaaacaaaactgctgctattctgaagcaacttcgtggtctttgtaacctttgtcacttaaagtggcctgggtgatgtattactgaagaaaccctgtagcgtgtgatgttttctcgctgcacaaatcgatccttgatgatgaagtgtacagttcctcttttttcttcgaattgacttgggagtccaaaattgtgttctttttcagaatattactgcataatcattcacacaagtcatcaatttgatggttttcatttttttttccttggatgcagaaattggagttcaagttccctcttactgtctcgtgtgtccactttatatgctcttcgattggagcttacatcgcaatcaaaattctcaagatgaaaccactgattgaagttgccccagaggatcggtggagaagaatattcccaatgtcatttgtgttctgcataaacattgtactgggaaatgtcagcctgagatatattccagtctccttcatgcagaccataaaatctttcacccctgcaacgacaggttctctgattcctggcctttctaagctctttttttttttgagctctttattgtcaattcagtcgttctcagttattccgcttttctgcaattaatgtaagcatattctgatggattcttccattgtaacacagttattctgcagtggttggtctggaggaagtatttcgagtggcgcatatgggcttctctggtaccaatagtgggaggaatcatgttaacatcaataactgagcttagtttcaacatgtttggtttttgtgctgctattgttggttgcctggcaacatctaccaagaccatccttgcagagtctctactccatggatacaaatttgataggtaaaaatggattctttttaccttgggccagtaaaaattgattcagtctgaattttactttaccatacttagccttgcatgttttcctcttttggtgtgtttattgattctgcatctgtcattttgttcttcttctgtgcagcattaacactgtgtactacatggcgccatttgcaaccatgatactgtcagtaccagcgattgtgctggaagggagtggcgtcatcaattggctctacacgtatgattccatcgtccctgcactgatcatcatcaccacctccggagtactcgcattttgcctcaacttctccatcttctacgtcatccattccacaacggctgtcacctttaacgtagccggcaacctgaaagtgagactcgactgcaactctactgctgttcatttgtgctctgcattcacaaattgggttgatggatactgtgatttatacaggttgctgtggctgtgttggtgtcgtggatgatcttccggaacccgatctccgcgatgaacgctgtcgggtgcgcaatcacgctcgtcggctgcaccttctatggctatgtgaggcatctcatctcgcagcagagcgttaattcgagcccacgcacgccgaggagccggatggagatgcttcccctcgtaggagacaagcaagagaagatttaattggccaccaaattaaaacaagttgatactcaaaagaggagggaattgttggtgcatgatcaataggaataaaggagcatcatctaacagctttcaggattaatcctgaggcacttttgtcatagaaaattattcagagttttcagttgagttgttcgtatagagctaatagaacttccttcttgtcatctgaacatgctggggtgctcctcagctgtatctctctctctctctctctttctattcttttcttcctttttctcacaggattaaaagatttttgtttgctcgtaactatgctactattgctacacatttgatcacacagcattgttcagttgactatagatattattattatgttattgctccatccaaactatactattgtttttatcattctggcgcctctgttttgttcttttgtttgtgtttctcaataacaaagtgtcctactgtaaaggagtaaggaattgcgcaacatgttcaatacagaaaggaactgcataaaaaaaacttaagtattatagtctgtacatttgctattgtttttaagaacaattaaaatctatacaatggaatggaagtaagaacaacaaggacaaaagagatgcatcaaagcctgtgcccagaccacttacggccgttccggcccaaggagcccagtacgggaacatttgcaattcagctcctggttacttttcatattgatcggtctctgtttggaccataacattgataatggctcgacatcttttttaatattttaatcctgtcttgaccaggtatttttcatttcggtccctgtttcggaccactaccactggtaattgtcctatatttttaaaatcattttactcatacttaggattgctacaaatggtagcaatctgactagtgacctacatgagaaagacataatacccttactgctagccatggtagctactttttttttaacgactcgcataaggcggtgcgaagttctattgatagagcagaagaaaaattacaagattataactctataaggttgtaaccttggaagctactttttttacaattgaagaaaatgttgtctgtctgtttatagtgggacaaaaatgaaattgctacccgtgcaattgatcacctcttctcagaacgcacaacgacacatattaccagtcactgatcgagtatatgcatatgctttgttagtttctgcaccagcagagaagaagcattatatcgattcataggcaaacatcttttggaagccaagctggaatgtctgaagaaagaaaggtgcccctgaaatcaagcagccctgcagcaggcagaaatcaaaatgcatccaaagattgggagctggaatatatgagtttgcagacagcatatgcccccaaagaagttgctcatccattttctgtctccagaaagcagcccatgcaatataattagaggtagggtacgtacgtatatatagctaggcagcagcaaacatgcatgatggagaagcaaatataagatcctgctgcaaaagatgagttgtgaaagtgagccaactttgcagtcgtagtacctccatgcacatcatctttacaactcactccgacgaccgtggaaagaagtgcatctgcaggatcctcaccgtacgtacctacatatgtgttccttcatacctacctacgggagcatacatacaagggttaagtctaatttacctcatcaactatagtaaagaaaaggtaagatttaccctcttaactatagaaattgataaattatcctcctaaactatttaatcaaactaactaatatactcttagcctaatatgggtggttttggttctacgtggtaatccagtcaacacatattttataaaaagttagctagccccacaagtcccatgcgcctccatttctctcctctctatctctctgagcatgtcgatggagatgatcatgtggatgcccagaaagttgccagagaatggcgactgtaccgctcttctcctcttggagctccgtgttggtctcacgccaccaccttatcttccctatcaaggcggacatgcgcaagctcacctattgtagtctcctcccagacttccattttcactctgccatggatccgtcgaccagccgctatgaggaagcgtcgcaccggtctggcctccaacatggcatatgctcctcccctctcacctccaccctcacgtgtcaacgggtgcactgtggaggaaaggtggagtcaaggatatatgctgatacgctgaaattaattatttaattagctggtcaaaaaatagtagaggaaacttgtactttttgctacatacttttaggactacgaatctggataggggagctatccagattcgtagtatttgaaagtgtcatgtctctccaaaatctcttatattatacgacggatgaagtactatataagacgtgacgctacccatccacatatgtagagaaggatactatgctactctatcgatataaatgtgcttggtagcagctgcttgttgtgttccaaaaagaaggggaaatacaatcaatccatgggcgccatcaacataagacacttttcagccttacctcagagattcgatcgagtgcttatatgttgttcctccatgtgcatcattctcatatataccatctctctcatttcgatcatcataaaggcgttgttacggctgtgcctgctgctcattggaacaagacgctagtagcaatcatcttttgactagcttgcatatgcttgcctttttgattttttttccttaattatgtatgcagccaattaaagatcctatcatgtcaaaagcaaattgggatgaaggaaaaatgtactgctggccttgggaacagattgctgaagtgtgttgcatataatactcatactcactccgcaagcagctggtagtacaagtctcagcagcttgaagactctgccgggctttggcgttcttttctccaacaagagttgatgaagattaaaattttcgtagcacgttttttaaattactaaacggtacgtttcgtgcaaaaactttctatataaaagttactttaaaaataccatattaatctattttttaaatttgtaataattaaaactcaatcaatgatacgttaatactatctcgttttgcataaaagcattaatctttatcttcatcttcaagagaaaagaacaccactttaatttgcttagtatttggcgtacatataggattatataaaagcagatcgtgatganctctgtnccatcgagnaggccatccattcaanggtaccatgg

SEQ ID NO: 10012 - DNA, 718 bp, Oryza sativa
  unsure (1)..(718): unsure at all n locations
tgctgtanagtgatcgactgttatgcagtagttcatcagtatggaaattgatgctggttccagcaaagctaagataaaagccagttctgcagccgttgaagtgacaccatcaccaccagtgctggcccagaacaatatattgagtaagcttaagattagttactccactagtttcctacctcatgaatttcgacatctgcagtgatccgcaaatagtggaaagtgcttttagtttactcagtaaataaatttagtttgtggctgtatctgcttcttggatgtgctcgctatctttgtttacttttttttccctcaagacactttccttacacgatttattaattggaaactcacagtgacaaaggacgttgctgaaggaaatgcgacaagtgaaaatgacaggccttcagcggtggacaatatggaagttgatgttggtgaaaacaaagctaaggttaaaaagaaccaggcttacctgtcggagcgatttgatcacgatgacctcgtcaattacaggatatatcggcagcgttgttttaaaggtgctcgtaggattaggatatgtgtgtttgtatttataaagatgagtatatgtgtctgtaccgcgtgtgttttttttttttttttttaaaaaaaaaacaggttcaagttagggtcaatggggtccgaccgaaccgtgccagattatatggacattggtcaatcaaggccctattcg

SEQ ID NO: 10013 - DNA, 6252 bp, Oryza sativa
  unsure (1)..(6252): unsure at all n locations
cgggttggaggaagtggataatgtagagagcgtattgaaaggagaatgtggccagagttgttacggtgaggtatagatagacggagtgagtgtaccaactgtagaaaaagagaaaaatacgtccgaagtcaagaaagaagaagtaaaggaaatcgaagaggtgaagaggctagagatggggacagacatgcgctcgaaagtagaaaaggggaaataaggaaggcgggtggaaaagaagaacaggagagaagcacagagaaaccgccgcccttttaattttccccccatcttgccgttttaaagacgataaagaatttttgccaatttaattgcaccgattttttaaaaaccctgtgccgacttaaaaacttaattattttttggggcagagttaaggactattgtttccataggaagtgtggaagcccctatataatgttccgtaaaaaaaaaggtgaagatgttttagaattgctgcggaatgagttgaggtttttgggattatccagagggggtttaaatgtttataaaaagcgaagggngccaaacatttcgaaacggagggagtatattgttttactgtaatcattatgaattactccctccatccataatatgagggattatgccattttttttgtaaaaattaagaaagtagtggtagatgaaataataaaatagtataaaagttggtaggtggagaataaaatactatcttggaaacctaaaatctcttttcagaacaatttacagatgaaaataccttatattatgggacggagggagtaagttgttacagtaccactatctatatatagcaagagatgcatttatgatgggtgagacatgaaaaaaaatgtcaattcaaaaatatgcaatagtgatatttgactacaatctaagtttgcctttttaatatgcaatcatgtaaacatataatatatgtatataattcgattcttaatcgatactatgataaagcctaagtagtaaaattggcattttccttgtaattaattagtcctatatatgcttgtgcgttacaatgggatatgaagaaatacagaaggatggttttatgaggttcaattttctttgactggtttttctagtggatcatgaaaacactagtttttttagtaggtctttttttaggtagggtggttttcctttttatggggtgtatgatggtggaagaagagaagaaagacgacttccctttatagtagtagagacaattaagcaaaggataaaagctttcaatatcacatgatagtaatttttcattaattaattcaaaaataaaactattatgctacataaaaaaatgtgatgttttaagattgtgaaagtccaatattttaaaaattcttctaacatctctcctatatggatagctgtattagattcaatgaaacatcgatcatgcgtgcaagtttttctctaaaaaaatacgtctcaatgtcacttttgcacaatatatagctttatagaaactaagggtgaaagttgaattttggggaacatgcatgtcaatgtccaagaaaaaaatgtcatgtttgcgagggaacagagagcacgaggggcggatataagagaggtaggtgaggggtgacaaacggaacaaaaactcctatacagaagaataacaaataatagcttaagcgtaaaatttggtacctctatcggtatcttaaggaccataaaaattctcataaaaaatggagtagttaacagattcatcatccaaccttttgcttaatcatagtaagcaagacatccagccatttgcttacctcacacttactgtacacaccaaacataatacatgaatgaataaaaatgcatctagacacacactagtacacattagtacacctcaagctaaggtaagcagctatcctcccccttcttctccccctccattcccctataaagccatcttttatgtgaccactcatgggctctccttcctccatctccatctccctgctgtgactgagctacatactaccagagctaaagcatatgtactcaaatctgtactacctccttaccttgtgatccatgctaagctgcatgctagctaggttgctgccatcacttactgcatgcacttgtgagtggtgatctcatctgctgctactacagcaattagctagcagagctgcagctcatcgatccatggacaacatgacccacaactccagcagcagcagctcatgggatttggacatgagcctcggcagccaccaccatcccctcctcttcgaccagccgccgccgccgncgcccccgccgccgccgncgccattacccttccacctccaccaccaccctctagatccctctccttcttcttctttgtttcctcctcctccccatcatcaccaccatgcccatcacctccatcatcctctcgacctggaccagcggcgtggtcaccatgactatggcggcggtgaccaggggggcgacgaggagctgaggcttcagcaggaggcggcggcaggtggtggtggtggtggccaggacggcggcggcggtggggatcaggacgccgacgaggagctcggcgccatgaaggagatgatgtaccggatcgccgcgatgcagccggtggacatcgacccggcgaccatcaagaagccccgccgccgcaacgtccgcatcagcgacgacccgcagagcgtcgccgcccgccaccgccgggagcggatcagcgagcgcatccgcatcctgcagcgcctcgtcccgggggggaccaagatggacaccgcctccatgctcgacgaggccatccgctacatcaagttcctcaagcgccaggtccaggagctccagcaccagccgggaccgccgccgccgccgtatcccgccggagctgcaccggccgccgggcccagcacctcggccgtgggcccaccgggccggccattcttgccgctgggtggaggagggcccatgatcgactgggtcggcctgaccaggccggtggacatccatgggccgacctcgtcgtcgtcctcgtcgtcgatgggcggcgccttgggtttcgggttcggctgcggcggcggcgggcagagcagccatgggatgcactgatggatgatgaaattgggatggagcaatatagctgagagagaggagattaactaagctagggatgcatggattggtggactagagaggtaattttggtaatttggttttggtcttggtttttattaattaatttgctcttgttgttggctcaggctactagctactctctctactccccactgagtagctaagctgctgccttgatgtttctcaaagtacaattaattaataagattagctagggtttgcattctatttgccaattttttttccctgcatgtgataattacccttcaggggtttggttaattttctcttgtcgaattttcttttgtgggaaatttcaattaagggaccaaatcattcaacaaattaaaatctggacacaacacatatgtagtgtagtagaaatttaatttaacaaattaaatcttggatgcatgcaatagaataattgtcaatgatgttctggtaggttgcgtgttgtgtcgtggtggcagcatagcatagcatgcatgcatatatgttgactgctaggctagctactggttgagctgagagcatgggatcacaagagaggatcagaccggatacatttatttatttattgtttgcagcttgtcacacacaagatcagagctcttgctatctacctttgatcacttaacaaaccgcttaattaattttactctttctttttgtttgtttgtttggacccccaaaggggatcatatcggatcagaaagaaaaaaaaaaccactttaattttgtcctgatgagatactagctactccagcgcgcagacgtagctagaaaaggagggaattattggtgcaaggtattcagtgccatgatcagtgatgagtggtgaggtgctgaattccatgcatcgtcagtaaattaagaaaggtgagggttttcatttcatttcagttggagagttcccagggaggacgacaatgcggccaaacccaaccattggaaaaagcttagctgtaaccatcaactcctatcgatctaggagtagtagtattctctaccttacctattgcttacgtattctacctagctagtagtagcatttctagcttagcactggtgtacggctcctggattttcttatgttttgtttccttctttgtgaacattgggccagaggtttctcaaattgtcattcctggcaaaatttcttgtttatctaagctaattaagccatatgtgatatactacctccgttctaaaatatttgtccagtacatagctacaatttcttatattttagggtgaattggaggtggtaattaagaacttaaatttttgttgtgcatgacctcctcgaaaaattccattagccgcaacaaatggtattttatgtaaattaatggtgatgcatcactgttgatggaattactgctttgtacttttttaaaagagttttcattagatttagatgcatgttttgttgtcgaaacagaaacaatgtaagtgatttgttcactttttgttgctgttactctattctgaagttcagtattcttgccatattctcccccaattttgattaatttctgctatatagtttaaaccaatgcttaagtatacgcataaatgaagcattttagttttcttcaacatgctggtaaataaattattttaatcaaactaattcagctttggttttttttatagtgctcattgggaattttgtaattctttgtttcagattaatgcatgtttggctgccaattttgcctttttaggtatgctaatttatattgatttattgtagtatttgaaccttgctgactcaaaatgtttagtttttttttacttaaaccttttggcaaagcaaggacgaaatcccaagtgatgtgcaaccctgccttaatttggggctatagacattatattttgagtgaatcttgggccatatatataatgttacttgaattttaacttaagatcatctagataaaaaaatgctgccttatgccgtagttgtatgccaatcccatttttatgaatgaaaatagctaagaggtcaccaaaattaagtacatcacataataaatttgatcttcaaacttaattaatgcaacatgcatgtcatcgtatcagtattaatcatggctaaaggagcaagctttctcctttatcttcggaattgaagaaaaaaatgttacaatattatatgtttgcatggtcattttttaatgttgcagacatatggttcaaagaacattactgttcgttgtaggattgttagaactccagagaggattaattatattgattccaccattgtgaaatgttaacatacacatacgtgaatgtgtggaaattggccacattaatctactgtacctttgcattcgtgatgaacagctttcattccatacagtcctttgtcatgccttaaagcacactaggttatgggcaatcctcagcagtgataatcgactagctagagatcgaaattggtagtatatatgtaaaatctcgatctctaccaaagatttttttttctccctaaaactcccgtgatttagaattaatcaaaatcgttgtgcgtgctacatctgccctcatcaagtaaaagaaatttagtaatatatgcagatcgaatagatcaactagtagtatatgttagagcatgcatattcctttcccttgtccatatatatgaaaagttcaattcaaattaaagatatctctacagtactataaccaatgaatcttaatttgtttaatttgattacttccattcattagattgaacttcaggaaatcatcaaatactacactaacaaggagaaataaattcgataaggcgcgccatttggagtagtgcaggaatttttcccatgttaattcttccagaaattgttttaaaaattatgtcatttccatgttccaaacggggcgcgcagcatttagttctctcttttcatttaaatctttttttaccaagcgaaattagaactatatttgtcgtcagaagaaattaagtatatacatgcatgccaactttgtagctagagaggtttgatcaattatattatgtgctttacgatgataaattaactcacatgaatttaatataaattaagggcacactttgctatataaataagggcatatgtaccn

SEQ ID NO: 10014 - DNA, 27857 bp, Oryza sativa
  unsure (1)..(27857): unsure at all n locations
ggggccgactggaggactgacacatgcaggttagcnnacccacannagtctttcagatctagcaaaactccatatatatcacggcaattttcaccgtcatcatacatatctactccgcccacctaaagtgactttaaaatttgtctcaaaatataagaacttctaaagtagtaatttatctcaccttatctagtgcgtactctcccaagccactcgcccatcaccacccgaatatggattagaccaaaaccaaccggcaattaatgaatcgggactagccacctatttaattatgagtattgtgaacttttgtcttgctactcatttaatttgttctaaaattactagaagtccttttaggacggagagataaaatattaaatgtgtaaatactttggtcatatactctctccatcataaaaagaatgcaaacttgcatctaaattttgttagaaaaatataattatatagagagtagtacaactttttcttgcaacccctagtttgaattaatttcttattatcttacccctaaaatcacccttcatttatattaaggccggcaattcatgttatttaatttctctttcctattaatttttctttcgaagttagaattgttctttttctttggattattgtatcattccagcagtcaagaggaaaaaaaatgatgttgcattgtgtacatgtacagtgcccctggttgcacaacagctggccataaagcgcaaaatgcatctatataatcgatcgagtgaggaacagtaactcacgtctgacattttgatacaataatcctcaaagattcggtgaaattttctttctgatccctcgagcactacgcgcactgtgtttcagtctcctcacatatcatgtacatactacatatacgcatgcatactgcatgcagtatacacacaacaataaaatatatgaataatgtgttttcgtattgatctgcaggtgtgtactgcatattgtgttacatgtgtgcgcatcacaaagcaatatatatactacaaaattaatgctttgacgatatcatcagatcttcaatttcttatcgcatgcatttcataagtgtatttccaaaggaatccaaacaataatttcacttcatatatacttatgcatttcataagtatatatagagagagagagcatttaatcatataaaccaaacatgtgcatatgcgcgcgatttcagcaaaatagttaatcgatcatatattagatactttatggtgcaaaattgcataaagcaaagtggtaaaatacatggttagtcgtgtgcctcacaacagaggcaagagatgtaaaccattatcgctattaaatataaagaaatggtaatatgtatgtgctagctaatttggcctgattaattgcacatgtgtttaattcgaaaccttggtaatatatagctaacatgattatattgggcacatgcaaagtgtgcacatgatcatgtgatcgatcaggacaagatttgtataggtccttgtctattagatttgttaggttagcagcagatgcacgccaaaagcaaaaggctctgccctatatttgtacatgctcaatcattaaaatttaatttgttgagcaaaactagctagccaccaggacagtgtcatgatcgatcgatatatgtactatatatgcttgtacattgtgattaattatttagtagaagaagactgtgcatctacagtagatgaccaagaaaaaaatgtgaatatattggatccatgcgcgcaggtgtgccgtacatgcatgcatgtgttcaaatgagagagagagagagagattaaaggagcaaatcgatcgatctagcttttgcttttgcctcttttaatttttgggtacttgaaaagggtggccagtctatgtaactattctagctagtagaacgaatctgaatagaggtatgtctatattcatagtactaggatgtgtcacatccatttctagattggttttttagggacggagagagtatgtgcgatggccatatatgtacacaccgtaaagtaaattaattaagatgtactatgatccattgtacctgcatatatatgcaaattaagctagctagctaaatatatatatcatatggattttcgaagagaagaaattaaattaattaagagaaatgaggaataattgattggcgatcatggaaatttcgaattctggtggaaggaaaggcatctctattgtaggcagctgaatccgaatagaaaaggttatctcgatgagctcgatcgacaggatctctatggccggtggccgggctggggggcactgacacgaatgcatgcatgcaccatcatataatcatgcccttcagctggacactactgcatttcgtatccgatccatcgatgatgctacttcaatccctgcatcttttactcccggtttgcaagtctttaattctatttttgggagaatacatatatatatggccttatgcgtgtggttggaacagactaaatgcactttaacagtcaggtggccactcgagctctatcgtcgtcgacatttccactatcttgttctcagtaacacatgtaaaatttatcaatctcttcgtcaactgggctcaacgacgccgctatatcttcgccactgcaccttacaatctgcaggccatgtagttaaatgcaagttatttaataatcttcactaatatattagcgtgtaatccttttgtaatcttcattaatcaatttgaagcatatgtgcataatggcatattattatagaaactagcatggtggtccgcacagattgcgcagctagcatcattatattttctttcatataatagcatactagaaaaaatgcccgtgcgttgcaacgggtaaaaccatttttggattgatatacattgtaccttttggttttggataaaaacttattttcttccttcctattcagtcttggcccaacccgctacttctctctacttggcttacttcttttaaacctagaccacaagtagagctataggcctagctcgtatagtcgactgccgtcttcaacctcgaagacagtaccgtgtagtatgatgccagaaccaatactccccatcaaatacgatccaatctttctcaatctcctaaaattggttgagtgctcttattcactcgatcttttctttccgtttttatcaaaaccacaacgaatccataaaactctaggatataaatggtgacttctaaatatagagattgaatctggtaaattaaagcagaactaaaagaaaaaattatggggaaaatgatgatggagtagtggagaactgatttttcaatcaattggaggagggaaagcatgagaaagccaatcgatgtggcggtggtgctagagttcggcctgacgacgaaaaaatcgggtagataaaaaaaagaatcctcacaatgtgcacagaccctttctcatgacaaaaattgcgaataaaatataaggacaaaaaaagcggatgggaaaaaaagaaaagcggaaaaaaaaagaaaaaaaggcggataaaagagagggactttttttgctgttttataatgttttttttctctggtaatttttacggtcttttttctacaccgttttttagacgacagtttttttttcgcgtggctttctttattttttttacgatcgacgacttttatatttttgtacagtcggttttttccgtttttttcagcttttttcagtagtagagattaaaactgaaaaaaatattaaaacctactcaaatacagatgacgtaccaaaatattggcaaaaacatcttaaacttttataataggtaaagatatgttttctcattatattattcaaatatattaaaatgacatcataattttaaattttgcaataactttacgaaactacaaatgtgtaatactcatattgcattttatatacgtgttagttattaattatttttaatatcaaattttagttatttgtaaattatatatattcctatatggactctagactcgtcttttaatatttctttttttaattccgaattttctgtaaattgtatttctatatagactctaggctcttcttccaatattatttatttttatttttgaatttttattatttctaattgtatttctatgtggactctaaactcatctctcaatattctttaatttttaatttcgaattacagttacttcattgtattcctatattgacctttaactcttcttcccatatttttcttaatttcgaattttagttatttgtaaattgtatttttatacgaactcaaaactctactttaaattttaattttagttagttttaaattcctatatggactctatactctacttctaatattccttattttttaattccgaatttctattttttttcttaattgtacttctatatggactctatactctacttctaatatttcttatttttaattccgaatttcagttatttcatgattgtatttgtatatggactctatactctacttctaatattccttatttttaattccgaatttcagttattccctaattgtatctctatatggactctagtctcctcttctaatattcctttttttttaattctgagtttcaactatttctaaattgtatttctatatggactctagtctcctcttctaatatttcttattttttaattcgagtttcaactatttctaaattatatttctatatggactctagtctcctcttctaatattccttattttttaattccgaatttcagctatttctaaattgtatttctatatggactctgctttttctttttctccgattaatatgagaatttctatgccatgagagcgaacgtggagactcctttttctatccatttaataatataatagatgttttttttgtcgatggtatattgtagaatgtggcttcactgatgcatatatatttgtagattatgttgctaaccttcatttgacagatgtttgttatatatttctgttgaatcctccactgttggatcagtgtgacgattcatgcttcaatcctttagctccagcaagatggcggccactctggtgagatagcgacgacccaaccagttagggtcctaggttgagataggagtaggaggtggccaggtggatggggtgagggagggtgaggggaagggggaggagggaggagttcactgaccttagagggatggctatggtaggcggcgtcctggcattggtcagtggaattggtgattagcgagacaaccacaacactgcaaagctgcagggtcgccagtggggcggtgggccaatgttatcggcaggggcaaagcggagggagtggttaggaggcgatggatggtggtggcggatccaacgatggggagccaccagtgatgggaaagacggtgggggcgttggcacctcgctaccaatgacttaaggatgaggtgagggagaggcagggggatggtacgatgggccttaccgatgccattgagccctgtcgaacagcaacgtgatgggatggtggcagcaaaggagtacgaggaatcggtggatcagagacggtgttgaattgacaggtggcggcacatgaaagcaggagtaaggaagaaggacgaggagttagggttaagtggtggcgccgaatctcaaagaagatccaacagttaaaaattcatataattagggattggattttcggtcaactaccattcccctatatttaaccctcactcatagttttggaacatggatctctaaagctaacgctggtgatcagctgtcaattaattggcgttgtcagctagctagagtttgatccggcactgtcaaatagcaataccgatggcgattgatcgatctaagaacagtgtaatgtacggcatgcaatagctatctaataatgcccaagctttgtatgtatatgttccccgaatacaagtaagcagtagcaatgcaatgcaagtatagtccacatcattaattccattattgacgaagcatgtcgcttttcatgtaatatacttatataatatacatacaccactacagaaaccaaattaaatagatactggcataaggatatcggttcagattaaaccggcacctattatcagttacaagtaccggttacgagataaaaccagcaccaatattttaggtctccgttattaaaaaaactgacacctatatatagttcatccaatcactatggagcacgcttatatgtaccggtataattttattaaaccggtacctatcatattaggtattggttctcctaaattagttccagctcggaaaccgacacctatagcctgtttctaactggcaccaataaaggtttttcagtagtgatgcatatacacacaagtaactacaccctcggtaaaaaaagaaaccatcttctaagaacgaacctgaatgaatgtttatccagattaattaatccttagaaattgtcttctttttttttacggagcgagctgtgtatatacgagcggtgccgtgcaccgttgagcagtcaccatcagtgccaatgccggacatgtttatttgcatctgtacacaacgcacaggccggaacgatagatcgagaaatatataaattaagattattttcataggtacgaattgacggtacagatcttgctcaactgcatccgcatggattattcatatatatactctcccttttccaaaataagttaacctcctatactatgtgtttgaacttattttaagactaagaaagtacaccgttttatcgtctctgcgaagtattatatatactaaataaaaaataattagaaacatatatacctatactttaaagttaatcatgatatatattcaattggtaaagaaaattagcacttgtggttaattacccctgtacatctggtcaattaatgtaataaatgtaatagtctaaatgcacgtcaattatctagttaattttattagtatagaggaatattttagaagaggtggataagaaaagaaggcacgataaggtatcgagacaagctacatgtgtcgtgcatgcaagagaagcctaacggtactgtgtttgtgcttgttcaaacaagatggtgctgagacccctgtcacgaacgtcggtggggatcggctcggccgccacgatggtaggggtcagcaccaaccgcttgactgctatggtattgtgctcattttatttttggataaaatttttttttgcacggtctagtttcaaaataaatttttaaaaaaggctaatttgtcaaaaaaaaaagagaaaaaggtatttttaggtagggtgaacttagctgcatgcctgcatatataaattagtatatggagttgcaaacatggacgatcgagacgatggagctagcccagcatctggcaaaaagtgccataaactagtatatggagtatgtgttacagtgtgatcaagatgggcccacattggcacggtggggccctatggaactaggatgtttgtatctttcccttagctagtcagatctgatatgatcctcgtttattgttaatattgtcgagcctacatgttcgctgtcatatatacatgtctctgtctcgatctctctttttatatatttgtatatatatgtatacatgaatatacaaattattgatcgacttcgagccgagagtgtcaacccagccatatatatcactgtactggagaaatcatctttgtccggtcgacaaaaactacaatattcctgattgcaataaaaaccgggactaaagatgatttttagtcccggtttataagcagaacggactatgtgatctttagtcccggttcacatgctgtcaggggctgtcagggcccttcgggatctttagtcccgattggtaactctaaccgggattaaagttcggatcgttagttccagtttgtattataactttagtctcagttggtgttactaaccgggactaaagatcaaaacacactatataatctctagtacttatcctcttctcccgtccacacaaactcctctatcttaattttctctctaacttatctctttccttccttcacacggttcacagccttatctctttcttccttcacagttcacggctaagcgagcgcatgaggagggtgggccggctgggcagcggcctgcgaggcggcgcggaggcccgtgcggcggcggccggcgcagatgggatggcggtggcaggcggatgggagggcggcggcggggatatttgtcccttttttttgaagaatttgtgattcattgtatggattgtgatgtataatttctttttttgagaatccgtgattcattgcatggatctgagatgtataatctgtgatgtatttgatttgtggtgtttgggatgttactttgatttggcgtttgatttggggatatgcatcccactcgatttgggagaaaatcagttagggattaagtagtaagtagcaataaaaacaatgaaagaaaaaaaaagaaactaatcgggactgccgctgccctctttagtcccggttggtattatatcaatttttagtcctgggtatttgaaccgggactaaagatagcgatcttatttagtcccaaattcgtagtcccgattggaaaactgggactacagaggattacaaaccgggagtaaaaacgatttctctaccagtgtatacaattacaagtatacaacccagcgcaaatcacacaagaaaaatcgaacaacaaaaacactaaactagctcactcttgtagtcttgagtgtattaggtatattctgcacgattctacactgaaggtttttttaattaaacacattatggacatccgtacataacaaacaaaaacctagcacgaaatgtgacatatcgatcctagtactacaaataatctaaacattcattctatccagattcgtagtatactaggatgtgttatatatcgtactaggtttattttttatgagagggaggagtagatggtaatatatatgagtgcacacccacctctgcaaacatacacatgtgcacttacctatataaacactttttaagattggtcgctacatattaagattgacaaaatcatcacacacacacactcgatatcgataaaatatcgcctactcttaaagaaaacttattgtaaatgcaattaccattaccaaatctagaatttgaatcccttgcaagcgtagaagttgtttagtttggcgaagtctttcataaatgtaaattgtttcagaactccatgcattttctttccatttcgtgccatcaaataaatgttactactaccttttttttaataacaaaaggtgtaattaacatttacattttaaatcatagagtactttactataggaaaaagtccaaataccacccccccccccaaaaaaaataaactttggacaaaagtctgtctagcaccctaaactttaaaacgggacatcaaaccccctaaactttgcaactgttcatattacccctaaggtggtttttatctaatttgtatataacttgaatgagtttgatcacgtgacatacacattagatatatatatatatatatatatatatatataaatctccacttaaatctttttctttttaatcacttgttagctctcacttcaaacaaatattgtatgctattactgtataagtataaattgatgacttagaactgatgatacacagatatgttataatagttattcaaagttgttcgtttaagcttccaaaatatgcaaaaccaccattcaaaaccactttagggggtaatataaacggttttacaaaatttaggggattagatgtcaggttttaaagttaattcagggtactaaatagatttccatccaaagtttaagggagtatttggactttttcctttactataacttcgtaacaagtaagtaagaaattaattcacttgttgtaaaaaaaggaaagaaattaattcactttgaatgttacgcgcatgggcgtcgaccgtccacatgtgttgattgtttgtacgtaacgtaagtagttattatgtggtcctgtctctctctgggtcacgcgcagcgtatgtatacatatataataccacgtacatatactacgtattttctccactgtggtgcgtgtacgtatgtacaccctttattctacaagattatttaatttatgatgggttttaagatggtacccagagatatttagagaaaaatgtgactggaagggtttatgtgattttgtatgatgcttatgctgcgatgagcgtggcagcgatgacgatgtttggataaccgtatatatgtaatatcatacgagcaaaaactggataaccatatagataataacgtacgagcatgttaagaattaaacacgagaccttaggatagaaattgcatacctcttaccactgcacatactccttaccattgtactatcaagtgcatctcgtaatgtactattcttgaatcattactagtgatctatctcatataaaagactaaaattccactgatatgtcgagaaccagataatgttacgtttttatccagttagtaaaaaaaattataaatattagaaaagacctaatatcaaataattagaatgggtgaggcttcgaacccagatcttctagtccatcaccttgtgaagctaccaggtttttacccggttagtgagttgaggtggcatgtcacgcatgcatgcattattgtaccacacaatatatatatatattatcgatgtatatatatatatatacggcaacggtcatgtacgtaagatgtatgggggcgatcaagcagacatatatacggctgcatgctcagcttgatcgatcatatggattgccggaggtctcagcaaccacttggattctagctactagctctctctctaactcataaatttcggcatgccatgcctgcctcctccattttcggctgcagtgtgtgtttacacgccaagcatatactcatgtacatacatacattctcaaaatgctgctctgactttttcatcaatatatatattttttaaaaaagtatatgtagtaatataatagtagtattaattgaagtacactagctttgcattggtgatcataaaccgtgttgttatattaattcattggcactggccacttattcagtattatcgataatatggaatttaatccagtctctgcatgatctatatggtaaatatatgataatctaaatgctgttgttagtataaattcatagtgaaaaaaaaaatcctgcaagaagctactagctagctagcttatcagctatatagctaaaatttaaatcttagaatttaattttagagttatttcatcatcgcttatttttcagtataagcttttaaaccggtaattataacatactttcttcgtttcacaatataagtcattttagcattttccacattcatattagtgttaatgaattaatatagatatttatgtctagattaattaacatcaatatgaatatggaaaatgttagaatgacttacattgtgaaacggagggagtagatatgtatgttttagttgtaaactattttatcactttttcatggtttatcgtcctcaaacgatcagaatgaagacttgaagagtatattaagtatagctaggaggaaaaaaggatcattggctgctggtgtgcaaactgcaaattaagcaaagggccgggtgctcccaaaagagaaggccggtgttgctagctagcgtggcatgcatggtttgggcaaaaagggcggcaaacgactaactggagtagctaaatgttgtgtctcaacggaagtcatcactcacctgaaactgcatgccagcagcgctagcagccgagcattccatttcaatgtatttcgttgtgctcgcaacacctctcctagctagctacatttactaggctctgattgggggagatggaacataattttgagaagtaggacatgtttgacagggctctaatttataaatataacataatttgtggaacgacttgaacctgttccaccctctaatttattttttcatatcactttagcttgcctcgctccctttttaggtggacctgaaattgtatgatcgatcatttggcaagcctttagctccagaagaggtggagatggagtttaattcaagccaaacagatcgtagtagagttaggttcccttacttccaaaagcggatctaggaaggattagcaggagaggcttaatggagactcccatggttacaaaattggtagtgggggctcgagaccccgccgcccccatggtagatccaccactgtttacttcttgttactagttactctatccgccccaatatatagtaacctagtattagatgggacatcaccaaatctagacatagatttgttcaaattcatagcagtaggtgatttatattttaagacagtaaaataattttctaggttatatagctacaaaatctgagagtctagaatgtttacaagagctagaatcagctgtcaaaagctctccaaacggtcggcataatttgctgcaccagcccatgcatgctactgctcatacatactccaaattcagagagaagtgtagtacatgtactttttgtggccttaactttgggagagtccaaaaatgcatgcctggctttgcattgataaaaagaaggtacgacataccgttgatatatcaatcagtcgactgtagatagtgagcttggaaagtactactatagtgctgccgcaggaagctgaagaagaatatatgtgctgcactttatttgtacctatcgatccaattgttttttatatatacttacttagataccatggtacacatgcatgccattcaattaattatcctttcgaagcactgtactgcacccacacaaactggaaatatacatgtacaacatattcttttcttgctatatatatcactcattgatgaacttgttgtgttcctgttggttaattatgcggtaccgtaccttttcggctttccttttcatatttggctgatcgatgttaatgtatgctgtcatcgtttgctatgacttattattaatcattgttaaatttgaattttaaaatttaattctacagttgatttttggtttttcatcataatttattttccagcattagcttttaaaccatgaataatacacatataaaaggtttttacctattatactttttttgcatcatccatttttctactgcttattagccatatatataaagctcaaaccttgccagtgtgacaagaatacactcatacgtatacacatgacagaatcattaatttagcccgcatgttttctatctagtgagggtttttttcataacaattaaaatttttaactaaaggggaatatactaggatttgtcactcaatactcggtactttctttctgttataatccatttccattatctaaaaaaataatgattagtatttctcatttgtgtagcggtgaccactcgacttgaaacttaatggtagctagagaacgggatctcttgaaaatcagaaagatgcatggtatcgaaaatattcgggcatggcaaatagcaaaatattcagagatgaggtgtgcaggctagcggctggatctgtctcatttccgggccggccttttgcattatgggcttgtttgcctacttgcttgaccgcaaattgggtcgggccggacaattgttaattgggccatgtatgcaaccgcatctttctttctgtagatcgaaagatccatcgctttgtcactgttcacgtcgtaatagcatgtagtatgagtagtagatgacagacaccccgtaaaaaaaaagtagatgacagacacaaacatactccctcctttcctaaatacttgacgcagttgaattttttaaacatatttgaccgttcgtcttattcaaaaacttttgtgaaatgtgtaaaattatatgtatacatcaaagtatatttaacaataaatcaaatgataggaaaagaattaataattacttaaattttttaaataagacgaacggtcaaatattttttaaaaagtcaacggcgtcaaatattttgggatggagggaatacatagagaaaaaggtccagcatctatgtattcgctagttagcgtgtgtgcacttgcttatcttacgagctacgttggagatccatcaattgatctgcttgtttatgtgtctagtgtaacatcagattagtgcaacgatgattgagcaaggatcgaaaagtatatctttctatagatccgatcgatcgatcgatcgatctttttacctaaattagtggcacgagctaattaactaagatggccttgcaacacactcaaaaaacaattgtggaatgcaactcaaaactcactcgatcgatcgcttacaagctactagctagcaatctcctgttgcaacatgtgtcgttcaattggcatccatctgcaacagaagaagagctgcccattgtgctacgccatgcatgcatccatcccaattcccaagcagcagtagtgagaaagaaatgggaattagctagggctttgatgccaaggaaggcattgatttgaagcaacgtagtccggctgctcaaaccgtagcatatgagccaactccatcccatcacttgcttcccttgcaaacgcaaccaacaacccattcccatgcaatatatatacaccacactgctgcatgctcaccaccacacctcactcccctctctacagcaaccagcattccatttccatagcaatgactttcaaccctggctctcctggcttcggcttcccctttcccttctaccctcccaatcccaacccttatgctcccctaaaccccaatgctccgaagccaccggtgatgccaccgcgccctcaagccccgccacccccgcagcgtttcccgccaccacctgccccgcccatccgacccccgtcaccttcaggccgcgctccaccaccacccggtcgtgcaccgccaccgccttctcaagccccaccgcccccacgccgtgctcccctccacccgccctgccaccgccacccccacgacgtgccccaccgccaccatcaatgcccccaccaccaccacctcgtcgtgctccacccccaccagcaacacctccgcccccgccacgccgtgctccacccccaccgtcaccgcccattcgaccaccgcctccaccaactcctcgcccttatgcaccaccaccgccgtctcacccactagcaccgcccccgccccacatcagcccaccagcacccgtgccgcctccgcctagcccaccaccccacatcgtcatcatcgtcgtcttcgtctcattcggcggcctcctgttgctagcatgcctcgccgccctcttctgctggcacaagaagaggagggagacggagaggaaggcggaggtgcacaacctgagtggccatgtccatgtccacaaggcgactgagtcaggccccagcggcgccaaggccaccgtgctgtccatcgacgaggacctcaaattccaggaggtcgccggcgagtcgtcgagcgccgccggagcagggagccatcataccccttggtcatggcacaggaggcagcaggaaggcaaagcagagaacaaggcagagctcatcaatgtcacggagcacatccatgtcgatgagaagattgtatcagggcctcaggggcaaaagatcgagatcctttcagaagatgaggacatcaggtttgaagaggaaggcaggaaggaaaagggagatcaaagatcaaagactcgcatcaccaagacctgacaagatgagtctgcatgcccaagtgttactacagctctaaagaaagctacttcagctgagacggtaaagttatccctacacttgtgtgatttgattattttgataagattgtatgttctttggtgtgaatgaaataagggagtctcagaccccatttggttgaatggaaagtgtaactattgctatcagcatttgaaatgaatgaaattctttaatgaaattggtaaaaaaaaaggctgtcaaatataaatagagacatctggtatctgcaagttgatttataaccaaatgtgctcactgacacaagctgtgtccatataactgcttccactatgtgccattagcagaaccggagtttctggggttaggccacaagttgaacacgcgttgcaaaataaatttctttacagggtgacctaaatgtaaattcttgtacttgctatcactacagaagatatcataatcctaggtcctaattactttgcattacttagttgattgcaataggagtaattcgcttcttggtaggcttacttgatgcgctgttcttggtcgacactggcggcgctgtcacttgtacagcgacaggagtgacttccatcttagctttgttttcaccaacatcaacttccatattgtccaccgctgaaggcctgtcattttcacttgtcgcatttccttcagcaacgtcctttgtcactgtgagtttccaattaataaatcgtgtaaggaaagtgtcttgagggaaaaaaaagtaaacaaagatagcgagcacatccaagaagcagatacagccacaaactaaatttatttactgagtaaactaaaagcactttccactatttgcggatcactgcagatgtcgaaattcatgaggtaggaaactagtggagtaactaatcttaagcttactcaatatattgttctgggccagcactggtggtgatggtgtcacttcaacggctgcagaactggcttttatcttagctttgctggaaccagcatcaatttccatactgtccacctttaatggcttcatgttctcacagttggtattcccttcatcaagttcctttgttcctaggattttgaagaattgtcatgtaataaaacagtaaactagaaacaatgatcgtggcaaacaaccaagccttcacagatccaatccttgtactttagctcagcatgaactacaattaataaattcatagcaggccttatgctattcatcgaaaacaagcagattgaagatttgctatgcatacttcaatggtagctttgaattagtactaggaacacaaaacaatcatatcctgatgcaatcaaagagatcatcctacttagcaacacattatttgctttgagttacatcagaaaacaaggaaccccatgaggttgcatcacaggcaaatgaaagtgccactacaagttaacagcagaatgggtaaaatagttatcagtcacctaaagaagtctgctctgatgagtctggctggaccaaatattaataatctttcaagaggtgaacatactaccaaatatccattttctattaacaagtgagtccatttaagatatatgattaaaactatttatatcctgactggcgtaacacatcttgacagaagatggtaagcagaacaaattggaaaattgatacatatacataatccacccattagctctagaaaaggcaggcaccaatattacttgataatacatggtaataacttcaaccaagtaatattatgatccaattttggatactaacataaattttccattcaacaaagtttaaataaacacacccaacaaaataaaaaaagggaagacaaagagataccagagagattatagggcagccccaactcttcattctcaaactcaataatggtgcagaagcaatctcgtgatgacactgccaggtacttggcatcagaagacctatcaaaaaagcgaaaaggtttaaacagaaaacgtgaactgttagttccagtaagacaagtttctctgctcactgaaggctaggagtaaaactattgtaaaactcaccatgcaatatccgtaattgcagcatagtgcagaccagcatgtattagaataggagcaacactttcagtgtcataaacatacagggagttcaaagtagcaacagcaaaaataactctgtaaggaagcttgaagaaacaatctgcaacagttccatagtacagcgtcattttaagagatcagtaaaacaattagaaccttcaagcaaggtaaagctgaaaagaaaatgagctacctgattgggaaccacgcagcttgaagagaaccgggcaaaagcgcactgccactattgctttacttgcgccagggagttgtatcgcaggcctgtagcaccaaaacaaggttggtatcctaaaataaatacagaactaaatatatggtatacaggttatatgctaaagtatatgttttttctgacatataattaatgaaacgttgaaaattaagtgggacaaatgaaataccataagttcctgtggaaccattttatcagctaagaacatctgtagggaatagcatgtttttatcatagtaaaagaatgttggactggccattgaatgctcaatctccaggtttaccttctggtggaataaccaatctatgttcagcaaaggaaggtttcattcacccccgccaaaaccaaggattgatccccaccccacactttcttcacgtataattgaagttagtgggccttaaaatacaaggtcaaccattgggccttcaattcaatgacccatgtcttttgttcctgtgcaagaaccccccaacttaggatgtcctggttcaccagtttcacaaggaaaccatccgattcagccagttgccacggtctaattttgtgatttgtactcggagcaaatcgaaccactgaggttgctagttccagcttttagtaccatggtactgtatcctgttgtaaaaataaaactacctataaagaattctatgtttgtgtgtgcaagcttagagcttaggttagctgatttaaccattcagggaacacctgaacaaacgagtttctaaattgtgaaacatctgaaaaactttatattttgccagtaatgatggttgaaatgtaaaggagcaaattaaacgttataaggcaaggtcatcgttatttcaagcattaaatgtgcttctaccttgacaagtctctccttgacattacataagctgtattgatcacttcagatgaatatttgcataaacctgatcaagataaaaggtgaattagggaaatgaacttgttgatggaataaaaggtatgatgacagggactgactgcagatgaactatattacatgcagcaagaccgtataactaatgcactttagaatgacctgttttgcgttatagaaattagcagagcaactaggtattgccgactagaagtctagcactaacgggaaatttctatacctgctggcagtaccagaaaagatccatcaggcgaccatgccaatctccgaaagaaagatggtaacgtttcgtcatgaaacaaatgagctctaactggtggctgcaagataaaggtagctaatttagagcaacgaataaccaaagaatgccacagagtacattaaacaaaccttggactcatcatgattttgatgttcggccttcaccagtgtatgctggcaaacaaagttcatcctatctgtgttctttgacttgccttggggcttatttgcatatattctacaagttctgtcagagctcagtgaagcaatgtattgacccagaggatcccatgccacgccttgaacataatgcaaatgaccctccaacttttgttgccccgaacctgagaagtaaattgcatacaaatcagtataacagaggaaacatggtgctacagtcataggatcacttgttttagggtttacctttaatagcatcccatacaatgcaactgttatcaactgaagcagaaacaaggaatgcgccatcttgggaccattgcaggtcaagaacatccttgtgatggaacctatgtgataagttaggagaatacagctaagcaagtgtcaacaataaaatgggctaattcaaataattctctattttttttcagaggtttgctctcacaataatgtcttttgtactttccaagcctcgccgtcatcagtggaatgcaacttccagatgataataccaccacctgtcaattacataatagcctaaatgcatagcaaggacacaacaaatctacttgattgtctagctaaaatggagacggttttaattacaacagtttattcccattgtaataaattcatggccatgaatttttccgcgcaggtggggcaaaaaataatgtggcagtttaacataattagcctttatttatcagtttgtttagtggaattcaaacactccagcaggactagtaaatcctttccttgcttgattgaattgatagagcccctgcgtccgttagggggaaaaactaaagtaaacgtaccatcagcaccagacgcaagattttcgcctgcgaacaaccgaacggaaaaggtttgcttagttaggtatgtagaaatttctcaacatatagagagcatttcattcagaaaattgccagtgctaaactcaattcatagcagcgcttaccggaaggcgagaagcggagaacgttcaccgcggagctgtgggaggagaggctgctgtggtaggtggcagtggggagcttcttgtcggaatcatccgacgcaatcacccagatctgcaagccaatatattataatccatgacgaaatgggccagaaagccatccaaaccgcaacgagaaatcgagagcagcaaatcgggcaggggggtggagcaagggaggtgggtgaagagagaccttgatgtcgtggtcgctgccgccggtggcgaggcggcgggagacggggtggaagtcgagggtgaggaccggctgctgctcgtgccagttgatctgcaccgtgccgccccgcatcgccgcctcctcctcctcgccgcgtcaaggagtctaggttggggaaaggctagctagggtttgggagaaattggggaaggcgggaaatgggagggggatttggcgcgcctctcctccgccgctctccccgctttactagacgatcgacgacgatgagggtctctgtatgtgggctttctagtgggcccaaatgaggcccaataaccattagccaatattacatgggccttctcggctcggcccagcctacttctacttggggatatatcatatatgcgagtattttgacattgttatatatttcctctcataataaatatggtacagatagtttcaagttgtaaaaagaaaaatgtgctgacaagtagttcgaaggtagtagtatttttaccctaggttacctttttaacaaaattatgtgtatgcccctgaaattttagatgattctttcaatgtgtcttagttttgttccctaattaagaattttgattttaatccctttcatactctttattgcaattgaccgtcagttgaaagttcaataggtgtaatatatcagttttacccttagtaatcatgaaaggagtgtataattttttgaaatctatcgtgggaaacacaataatttgttgtgtaactacagtatttattcattcatgagattgttgcgtgaggaatcattttacatagaaattttaataagattacatatccatagaacgtattcgtggcatttttttaagacggtaaacataatatttagtcttgcatagcatttctttagataaaatatgctacataaaatatttgttataataataaatttaaatttaaattgcattttttttaatcatgatctaaaaaatatttacatatataatacctcacacagtaaacatataaatataatagtcacgtaaaaaaacttctccactttgaacaataaacttttttacacttcgaacaatatactccacagttttttttaagcgatatactccacaaatttagtgtgcttctttcatactcctacatgaaggcaaaatgaaccgttcgataggtattaaacggtcaactacgaaataggttacatgggatagaatagaaatttggggataataagaattggctggaattccaagggaatacacagggaactacctctagaaattttgtgtgttcgtgttttaagaaaacactatattatgagcggattagatcaaatgtgcagtgacattcctccacaatttaaaatgggagacagatatttagactaggttagatttttgtgtttttaaaaaacactttttgtgagaagattggatgaaatgtgcaggcactagtagagtagatgagttttgcattggatagtggcttctgatcgactagaggatagtgctgcctgcaagtggactgattattggataaggtgtgatgttattcatatactggtctaattctgtgtagtgaaatagcagaatgcatgatgatgatcagtagcactagtaaacacactaacactgtaatatcaagctaatccaacatgcattatacattaagaccaccaaatctttgcatacggtagctacaagatgactatctgctaatgtatatatttggtctacaacagtaggatcaagaaaaagcgtaataaaataggcagaaagtgaaacaaaggggaaattaagtggagcaataaggggtaacacacttccaaaatgcacccactaataactaggagtagcatctatctcacattatttgcaaatataggccacctggaaaatagacagaatgagttaaaaattttgcaaaatcttcagtgccaaatacagattgatgcattcgtcagtacatacccacacattcactcactaattaattaacatcaatcaatacacgtgcaaatcatctggcatatagctagagggaatggaacactgtcaaattaaaactttaattccaggaacccggattgagtggtaattaaattaatactcacactgatcgatatgttaataattcagccccctcatcaataatgaaactatacgtactgatcacctgcagcctggaggcaatatattcagagaaaacaagcagcttacagttacattctttctccatcattgctgaattactttaagtttaattaatcgatcggttcagacaaaataattaggcaggtagaattagtatatgatcgaacgtgcgattgatcattgatcaggccatcaatcgatcgattccagctgctgcatgcagcagttgcaagaactacttttctgctgccgttggttggagttggacgaatcgacggctgcaatgcaaaacagatagctatctaattaaggtagcatacatatccacgcatgcaactcgatcgatctgcagactgcaggtggaaagcaagatactagagtgcaggtacagctatgcatctacctatttaatcgatcaaaatggagtcaaaagtgtgtacttgcgcgtgtttagtataggagtagtaatgatcgatcgatcgatcgagaagttgttgttaagggggcgcctaacccaatagtttaagcatcaggctaattaatcagtcaattagctttaatttaattattagcatatgcatgagcgtgtaatataatgtacctagctacgtgcatcagttctagagaattcaattcaattcgattcaactcagtttcgttttcttgcggccgtcttgttttgatcaaggagatatacccaacaagtgatcatgcgtatatagctttaagactttggttttctttctttatttctgcaaaaagccacaagtcagagtcgttctaggacaatatgatgacgatgctactgtttgcagaggacaagagagacgacgatggcgatggagcgatgaaggggtagccacacaagatggaaacacgcatagaatttggtggtccatgttgcagcatattttcagctgctggttgacagaaattcacaagtcgttgtttcattaatttgttgttggaggagtgctacgtaccggaatctgccagacaaacatagactaatatctctgcagccaattccatcagaaattcagagttagcagcaggcagcaacaggacgcgttttgtccgatcggatgccactagagagtagagagagagaccaacaccactagcaaattgcaacagagaagcattaacaattaagcaagcaagcaatagtcaaaggcttgtttagataggtcgatcgctagtggtagtggtagtggcccattcagtgaagcaggtaggaagcaacccatatacgtacgtattgcattgctacctagctctgaattaccattcagctctagctaattagtgtactagtagatgatacttagttcattccacacgtcgtatagacgcggtctcgccatgccatggaggcgtcaacacgctggtcaatcgagaggagaagagaaacggattaaattaattaaggagatcaaactattgcagttcagactggatcgatgtatataattaattagatagttcctttaattggagctgtaaagctactggttcttgtcaaattgatgcaagattaattatagtacatatatagtttcccagctcgtcgcagacgctgactgaaaatgtcagtcgtctaacgtactgtatatgtatatagctaataagctagcggaccacgtaattaattaattaggtgataattactttgcatcattgcatcagtcgttcagcagattatattttgctgaacacaatttgttccgtgattaaaacaacaacagcgcacatacgatacataaaatttatcatatgtagtaattatctaattaatatcaataaagctttttatataaaaaagcagacatttatagtatacgctctccttctaattaacttgctggagtagtatatatcaagcttgctaggagagacatatatacgtatccacatgaggaacacgagcgatctatgaatgttaacaaaagaacagaaaagctagctaagaaaggtgcgtgcacttacattttcttactgtaataaacaatcaaaaatgaatactaaagtttactcactgcattgcaaatatgcagcttgcatatttgtaagaaatctaagtgttacaacatacgtgcattaattaattattaatttacttttgacaattactaattagccattacaatccagcaaaactaagtcggcaggcagcagataaattaaaccacgcgcgcgcggtatacacttgtgaacacgtacgtaggcgggaaagaagaaggaaaacgcaacaaaattaatggagcatccaactaagttgatttcgcctaaactaaagctgcatctactattactagctgctaattaacaacgcactaactataataaacatgctaagtggactagctagctaagctaagctactacagtactcctctcccacttgaccacctcagcttcctcctcctttctcatactaagaaagaattcagagtcaaatttctcagccacctcgcctatatatacatcccatgcctagcttaattccatcatccatcatcacacagctcactgaccagcagctcagcctcatcactcacgagcaatcagctagctagcttagcttgatcactacacctccatagatcttagcttaattagcttagattatacaagtggtcaagtcaagaactgtaccaatggcatcatcaatggcgcttgcagcagcaatggcgatcctcctcctggcgcttctcatgcccgccacgctgtgctcccgctcagggccgccctcgtccaagcacggccacggcggccacgccaagcgcgcgccgccgccggcgtcgcccgtggtgccggtggcgcctcaggccgcggcgctggtgcgcgccacctgcaactccaccgcctactacgacgtgtgcgtgtcagcgctcgccgccgacccgtcgagcaccacggccgacgtgcgcgggctctccgccatcgccgtgtcagtgcccgcggcgaacgcgtccggcgcggcgcaggcgccgacggcgctggccaacggcacggcgcccttcgccgccgctgccgccgggaacggcaccgtgcaggcgctgctccgcgcgtgcgccggcaagtacggcaacgcgcgcgacgcgctggcggcggcgaagaagtcgatggggcagcaggactacgacctggcgacggtgcacgtgagcgccggcgccgaatacccgcaggtgtgcaaggcgctgttccggcgacacaggcccggggcgtacccggcgaagctgccggcgagggagaaggcgctcaacaagctctgctccgtcgcgctcgacatcatcgccctcctcacctcctctcttgcatccaacaacaacaacagctagagctagatacgtataaatacggtataatactactagtactgcatgcgtacgtgctaaatacgtgtaatgacatgtatttggtagtaactagttaatcctgtgtggtgctgagtgagcatatatatgttcttcttgtattactaagtatagatgagttaattactgccgtgctgaagcttagcatgctgcatcttgtacttcactttggctccagtataattagtcactattcatttttgttgaattaaaatgatctgaatatgtgccccccctttttttttgtttgatatatgatcatatagtttatgtcggaattcaaacggttaaaccccccataacaaatgtattttaaaattcccatgaagttaaaagtgctcaagtggtggcatgatatattcccctgcttttgccccaactttacttgtttagataattaccttcctataatgcaatcacacatgaattactagtttgttctcctttttaatttcatttgagaaagtttggaggacaaatttagtggtccaaaatgctagtagtactagttaaggttgttacaaagctactaaagatcatgcagcatgtatagcacatgaaagaaagccctacctcggcatctagcttccttttgagataattggcatcttgtgttctttcatccacatttgcttggctgcatgaatccatggctggaccatctgtcctatgtgagattgtaattgaagaaaaagaagatcaaaaagcttaggtgatgaatagcccaggtaacatggccatgtcctcctgaccagttcatgtggggttaagctaaaaaaaagcaggcatgcttgcatgtttgcctgacctttgtttccccttgattatcttcctgggtgcacctgagtcccagatttcatcatctttgttcttgcctttgtccctccatgcatgtttaatgttttggccttaaatctgatgacttttgctcatacagtgtcatcttcttctatcctttttcaagttcctatgattttgcctctcacttttaactgctgctgtctctatgaccattgattgcagcttggttactgtttgtctcaagagcagatggatactagcaaacagtagcatgctccataagaaataatggaggagagaataatcatgttcatgcgtttacagttacagatgatcctaacctttttctctttgcatcaaagtcactaggttcctatagaattgtcatggagtaaagctctcatcctgtgtaagctagggtacaggaatctacaaaagccaaaagagagaagaaataaggctgcctacccaacattactcctcaagaggctaagatgccattaagcagacagtgggtatcagattaaagattaaatcttgataggcccaggctgagcctttaatcacactgttctgctttccacaaataaaaaaaaaaaagttcttcaaactgtagggtctcctcttctttaggaagagatgagttttactagtggatcaagtgcagggagatcagatattattccaagtgcacattacaaattgtaaaaatgaaactgcactttctatcttgaaagaacccactttgtgggctggccaacagaccttccattctcagcagtgccagttggcccaattaaaacaccaccc

SEQ ID NO: 10015 - DNA, 736 bp, Oryza sativa
  unsure (1)..(736): unsure at all n locations
ctgcgacaactagttgaggggactggcgctcccgcaanacnncatcacggcgcgacgagggagagggtgtgataacactctgaattcttgtccctgtctacataaatcttggatccaaacacctttgacacctccatgagtgtgggggtgttggccaagcatgtctgacacaagataaaccaccggtgcattggggtgcttccagatgcaattgatgacctgaaatcatgagagagcaaaaatgtagagttacagttgaagagaacagttgtcagcgattcagcaccagcagcaatgttgacctcacctggcggatggagtcgtgcttggaggggaagtggagagagcaggcggcgattgtgcagtcgaggaagacctagtctgcggcgacgaagcagaagtccggggtgaggcggcagtcttcggtgtgaaggacactgccgaaggaggcgcccctcaagaggaacatgactgcgccggggcagtggttggcgtcgaatgcggtgacggtgaattagcctgtggggtccgggacgagcaacggtgctcccagtttcacctacacgaaggcgttggcgcgatcgaactttgaattggagtggtaataaatcgattctgttggtgatttgagatacttatccatttgtgaatgaacgctacactgtgggaagatgtggcanaccgattaacgatgttgaggccaaaaagcactacacagcgggcgacgtttggtggg

SEQ ID NO: 10016 - DNA, 726 bp, Oryza sativa
  unsure (1)..(726): unsure at all n locations
gtgggtnnnntttggtgattgtccgactcacgaagggcgaatcaaaccatcggacctgaaagccctctatagggcctctgccggcatccatctatgtgcttgtacgtggtacgatctgtgcgcgaactacctcatagatgatagcggcgttttttattcttgatgatgaagattattattatgcgctcgtatggggaacgcgatagcatgtaacgtatcagtgatcgagcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaataagctgatctactatcagactaattgctgaacaaaagaacctctaagctattacgactattgaagatggtgagacttgctctaccagctactagctgagtgagtgtcaggattatatgcaacacactttagcaaactactgccaaggccagcagtacatttttccttcatcccaatttgcttttgacatgataggatctttaattggctgcatacataattaaggaaaaaaaatcaaaaaggcaagcatatgcaagctagtcaaaagatgattgctactagcgtcttgtttcaatgagcagcaggcacagccgtaacaacgcctttatgatgatcgaaatgagagagatggtatatatgagaatgatgcacatggagggacaa

SEQ ID NO: 10017 - DNA, 728 bp, Oryza sativa
  unsure (1)..(728): unsure at all n locations
cgtgtgctnnnngttgattcgactgtcntgcaagtagcncatcacccatctaaaccctagagattgaatgattgattgacgtggggagaagagaagagaagagaagagaagagaagaggacctcggattcgtggatgatcctggtggcctcgcggaggacggagggggagacgaacacctccttgcggatcatggtgtccttcttgtagttggagttgttggcgtaccggagcttcccgtcgggccggaactcgaactccaggaactcgtgcccgaacttccccttgtgccccacgtagtaccgcaggtagaactcaccgccgccgtcgtcatcgtcgacggccaccgtcgccattgcaatgctcacctccgcctccgccgncgccgcagccttcctcttgcttgtgctgagatgtgtctccccttacttgggccgcctttaattgggccggaaatggtgatctgtgcggcccaacactaggcccacatttgggtcatctcctcgggaactgacgtgcgggccccacattccagtttctcagcccaccagctcaaaactcttctctctctctggacgacgccgcggcggcggccgagcggcgtcgccggagttggagaggctggccatgggagtccgcggcggtggaagcgcgctgggaccggcttgggccttcagcttcaaacgcacgaagcaggaagaccgggtgggggcaaacgcacgaagcagg

SEQ ID NO: 10018 - DNA, 1188 bp, Oryza sativa
ccggtggcggcaagggaacggaaggacatgcgaatgaggaggccatggttgggaatggaatggaagagaatcgaaggaaggggataagaggcgacgattttggggggaggagaaggttggttgggttgggttcatgaatcatgatatttccttcttctcctttcgctttccttatcccaagtccatgggcccaaatcacggcccatataggagtacgtgcatagccatctgggccgtacatattttaaaataaatcgacaaaagtgaaattaagctttgtttatataataatgttgtgacttgcctgtaattagaatagggattaaattttatactcttaccactggatcactgattagcatgacagttcaaccatgccattgctccaaaaaaaaaaagaaaaagaaaataagagtctcacaagctattggcagtgaagtgatataatgaagtaaattatatttaaattaaaatagtattctgctaagtcatcagactaggcttgcattgcctacacaaccactttgtaaaataaaaaggtttacagtggcctgcccttcccctaagaggttaatagtatctcccggctctgaaactaatccaagggctagctttgcggtactgtacattcatctgtcatttcccctgcgggcaacacaattgtacaaagtttcctcagtcgagttcaattcccagaagttgagttgaatgaaaatcatcttggttcagaaagatacctgtcctgaaaattattaggtagaaataacaggccttggaggagggggaggaagaggcatccttgaaggcgcatctgcagccagatcactgaacaccacaacacaataggaaaatgaatcagaattcagaaccaaaagaacattcctagcaggtagcaacaggtgaaaccagctatttgtatcttcagttcctgtcagatatgctacaaacctgatcctcttgctgattatggctgcgtactggctcggtatcttcttcagcgcttctaaagcaaattgttcctccttctcggtttcaggcatttctcttgacattattattttggtgaaatcaacaaactgcgaagacaaaactagcttaattatgagcaaatcctcccatataaatcaatgttgtgatgcccaacaaacacctgaaatggtaccgagtaggtcacaaattcattttcac

SEQ ID NO: 10019 - DNA, 1443 bp, Oryza sativa
  unsure (1)..(1443): unsure at all n locations
gtacggcgtgcaagtccgcttcctcaccggggcgcggatacgtgccttggaagttcatggtgaactgctggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccacgtccatgtcgaggtgacactctggacgaggaagcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacaacgcggagccggtggtagcagcaccagaggccttggtggcggaggaccgcccaccagcatctaggcgctgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggaggggccggtggagtacgagctcgacggcgtgggttcggctccccgtcgtcgccactcacactgggagagaggtcggacgcctttgcttgctcagccatgaggctgatcaagaaaaacttgacgcacacggaaaagtgcgagagctcagaaaacacacgctgagccccctacctggcgcgccagatgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaagggnnnnnnnnnnnnnnnnnnnnnnnnnnnnnnnnnnnnnnnnnnngngatcacaatnncacccac

SEQ ID NO: 10020 - DNA, 2550 bp, Oryza sativa
cctatgaataaatattccataattattgttcctaatggttaataagataacactgttaaaatcaaatatgaatgccccctttcacaggtaataaatccgaccgtagtcgccgaggctttatttctccgctgcgatatatttatcgagcgatatttgacaccaagttgatccattttatcatgtgaaattatttaaaaaattatcatggcattatgacattaattattatatgtgggctaaattatttaaaaataattatgacattaagtattatatgacggcaccatgtatttagcactacaatataactattatatgtgatcaatattttatttaattgaaggaatataatagattataagttacatatatatatatatatatatatatatatatatatatatatatatatatatatatatatatatatataaataatttaaaagatgaacatttaaagacagttgatttgatactttatattaatcttgtttaaactgtgcatatacatggatatatgcggagtaataaattttattttataatatagaaaattctactttaaaaccgctgttctattagcatacagcatagtatgttttttttctggctttatagctgtagatacgtatgtttgtttggttttttgaagtgaacaatacatatgggtaatatccaattatagtgtacgttaacttttctcgtgaaaatttctcttctatatatcggacattaagaagcagctgtgattagataatgggcctacccggacattaagatgaaccagggattttaaaatagatccaatctaacggtctaaaataatgggcctaccagtttaactgaaaataatgtggcgatttaggagcgtttgtaggaacgccacgtgacagcttaggagcgtttctagggagtttaatggacttttagtagataatagatagatagatgctaaaggatttatcatattggctatgctagacatagaaattattatattaattagttggaatatcatacgatatacttttgatcaagtttaaccctaattcaaaatcataattttcctttcagaaccaagcgtgaaagtatatatgctattatctgataaaattttgtaacaatgctagcggcacaatctgtagagatcaccgtgctagttaactaaccaatctttaattcgttatatcatgcatcatagacgtatgtataggacgtgccagccgacaaaaaactaaattaaataggagttacattaagggaaatgaacaaagcacaaatcattgatcataattaacgggtagcagcatgtgcgggcgcataatggaaaagaaaaaccggcaacgatctacccggccccctcccctttgaaattttcttaccatcttaattttatgcttgactagagagatattccttgtcaccggtgcacacctcagatctctgataaatacgctgtagataagtacatgcatgcatgatgatcatgttcctcatgtttcacccgaaatctaatggccgatcgagttccgggaattaataattaaaattaattttccacgtaagcaagcattccagagatggatatatagatgcgtttctccgcattcgtacgtgtgaatccatgcctatttatacatagtcatctactactagcatggatgatggaatcatgcacggaattgacgatcagttttggcagttcactaccagcatcatgcatgaaataaaaactcttggccgggaacagcctaaaacgtgcacacgtaactgcaggttaatttaactgggtaattaaggatcagatctatcgatttgtgttagttgcagatatatatatactgtaggtttcaaaatcgatggacgtattacgatcgatatggtcatgtagatctctaaactattgttacatgtacttgtttgtacttgcatttaatatattgcagttcgcattatttggtcgtcagctaatttgcagtgaaagagatcgatggcaataatgcgtgaatcaacatttcaatattagctttgataggatgatcgggacgcgtgcttctacgtgctatccgtgacaaaaacacacattgttttggaaagtcaaattttaaagctctgaattactaataccttataatatattgacgcgcaattcttttgcgtattcgtgaaaaaaataccaatacttttttaaggatatttagattggattcatgtatgcatgaagcttgtatatcaatttgtatacatcttatcatatattgattagttctttcatagatatatcactataatttgttgagactatcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgtaccaacccggaactaaagagcgaacctgcccccgcgtttgtttgccccgggactgtggggttgccggctttagtgcccggattggtcctct

SEQ ID NO: 10021 - DNA, 2722 bp, Oryza sativa
  unsure (1)..(2722): unsure at all n locations
gtggccgnnntttgttgactgtcgttncnnnnnnnnnnnnnnnnnnnnnnnnnnnnnnnnnnnnntcaggggccttaggccaccgttcggctcgggggcctctcctccctgctcgctcccgggccaagtcagcacagggtgggggtgcacggaatgaggatcgtcctcatcgcgctccacaaccaacgctgcactaactacttggggggtcgccgctaagtagagtagcaggggctcatttggctccggggcgactagaaccggaggagagctgagatatgctttcaactgagtgagggcgcgttcagcttcctccgtccaagtaaacggcccaaagcgcttgaggagcttaaataagggtagcgccttctctcccagcctcgatatgaaccgacttagggcggccatgcaaccggtgacacattgcacatccctaagtttactgggggggcgcatccgctctatagctcgtatcttctcggggttggcctcgatgcctcgggcagagaccaagaacccgagaagcttgcccgcaggtacaccaaacacacacttatcggggttcagttttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggagtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatagatgacctcacggataaatccggcctccagaagtctcgcgacctcctcgcggatgaaggcttgacgttccggggcctggcgccgcactttctgccggaccggccttgcgcccgaccgcacggcgagacggtgctcaatcacctccctggggaccccgagcatatccgccggtctccatgcgaagacgtcagcgtttgcccgcaggaaggagacgagcgcgtcttcctatttgccgtccagaagaccaccgatccgtgtggtcttggacgggccgtcgcccagtgcaacctccttgaccgggacctcatcggacgtgactatccgctgcctcggggcggcgggggcggatgtgccaagcctctcgtcgccaccctcgggcttggacacgacggcgaggcggtccgcacgctgctccatacaagcgagcgcgactttgaggtcgccatggacagagatggggccgtcggggcccggcatcttcatctggaggtaggcgtagtggaccgccgccatgaacttcaccaacgcgggcctccccaggaccgcgttgtagggcagactgaggtccgccacatcgaagttcacccgctctgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctcccctggcaacgcacggcgggtggtcggtctggtcaaaagtgagggcaacttccgaccaccgcgcccggcgcgtcgcctcatgagtaggggccgcggccagaagctctcgcttcatagccttgaggctccggcgagaaacgtgagcacacgctcctccatcgacggtggcaatggtggccccaggctcttggaaacccaggtcatcatcgccatcatcgatgtcctcggcgggggccttctgcctggcctcacttcgccgacggccggaaggaaccgccggggacttgccttcccggcgctcctgcctcctctcctcctcccacttccttgtccgctctgccaagcttttgactgcgcgacagtccacaaggtcatggagggaggtgttgtggacggtgcaccacttgccggtagggcgctccctgctgggaacgctggcctccttctttttgtcgctcgcaggcctcccctttcgggtggcccgcgaagcgccctcgacggcgaggacatgaccctcgtcgtcggaacggactgacctcttcttcctcctcctgtcacgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagatcaccgcgtgtgcagggatgcatggtatggtattgcggacttgacagaaccgctgaatgtannnnnnnnnnnnnnnnnnnnnnnnnnnnnnnnnnnnnnnnnnnnnnnnnntngacacc

SEQ ID NO: 10022 - DNA, 3267 bp, Oryza sativa
  unsure (1)..(3267): unsure at all n locations
ataaatatttggacctcttttatagggggggggcccaaatttaaaaatccacgaaaacgtccacttaagggggaaaaggccaanggcgtcatacattaaaatacggagggagtaattcttttcctatcatttgatttattgttaaatatacttatacgtatacatgtagttttacatatttcacaaaaaaaattaaataagacgaacggtcaaacatgtgctaaaaagtcaacggtgtcaaatatttagaaacggagggagttctatgaatctaaacagaatcattgattgcccaacacataacaaatgatgattgcagtctgccgattttagattcttcatttcacattgacagaaaaccaaattgcagcagaaaaataatcggacttaagacgcccaacgctactagggggcacacatgcataaattgtgagcaatttgacaccaccaaggactatacggtttacaacctcgctacattgataagaaacgaacaggggcataaacaagactattcatctgctctacaaaataccagcagtacccctcataaatagacctgataaaacagtagataatctagtcataagttaactgaagatgcaccacacttaacttaaccatgcccctcatccaaaaaacatgtccaagtccaagtccatgttatcctctccatcatccatacttgttccagaattctgttgatctccacctttccaagagggagtagacagatgaaccatacgggtctgcttcttgtgagagggtacggtgaacacaaccccttgtcgttttaggttaccctttatacctgcagccagcaaaatatttagtgaaaaccggctcaattacaactaaatagtagctctcatatctaccctttccctctaaaattccaaagcaaaacaatcaacctaggtgacatgccctttctgtgaaagcacatggtcatgatgcagtttccgtttccaccatctatttgtcatgtaacattttgtgattattgaagaaggcatccattttacagtcgtatatgtactgccattttactgggcattgctcataaatcccattcccttcaatgatttatttgcatgtatctcaggttgtatgtatgtaatatgttttatcagctgagaaaaggtgttcccaagtcaggtgtgtcaagtaaattgttaacaccagagaaatattagcatcctgaactggagtatcatgtacacccaatgccatagaaacaggggcatcatgccctacagcaatgtcccttgttcttgttaggaaagataaaaacatgtgttttccaattgattagggcacatacatatatacatatgcgtcgatctaataggtttaatattcttatcgattacaacatgcaggtttgctatttgtgaaagcaggcaaggttatgatggttagcattggaacggatcacagggttagggatgaatcagcagaacaaatagttacctggagctgtacgaagataccctgatatgttactgctcatgtaggcatagccaatgccaagggttctttctgcaccaaactcagccacaacttttagcctcttgttcttcatatcaacagcaagcacccaagcatcgtcgtcccattggtcggccttggccatgaagcaaacaatgtcatcagagtgcaagctgagcgttggatgacccacatgaagtctctccaaggttggctgaggtgtgccttggtcatcgaaaagcttaggcagcaactcaaaattcatcttgctgtcatcaacagagatatcggaagcagtgagtttgcagtcctggcgccaaccttggttccagggattggtgtccggtgcagtccaggtggcagcagtccaaccttgagagatgaaggtgccgttgatgatggaacctggcttgacatgaagccgcgtctcgatgaacttgatccgaccttggacaagggcaatgtcacgatgaggccttggagagcctgttaacgagttgttgggactgagcggcggcggcagggggaagtagcggagcttagtggtgtcgcggagaaggtcacagaagagaataccacggtagaggtcgacccagcccatggtgcccgccttccctccaatggtgattgccttggtattgatatgggtaaatgatgtgtcgaccaggccatggagggagattggatggcaggtccaagcatcagcgccggagcagtagatgtggaggtcatactcaaagtatcctgattcgaaggtgttacagagtgcagcaacaatgtaatcaggagaggcgcaacagcgcaggaggccaagctcgtggtcgatgaacctgtcgatgggagggggcgggagcaaggtgagtttcggggttggggtggtggcctggtagacgaagtagtcatggaagctgctcttgaagcggatgttccggcgccccatggcgacgcggatgaggaggaggtcggcctccgcggcgatgatggtgggctcggtggcgaacttcttggagtccaatccagggcagtggacgcatatgtaggagacgcgcggctcgagacgacggctagatacggcggcgtcggcgcggggatttgccctaggcagtggcggcgaaagagagaggccgagagagatcgatcggccgaaaacgtctaagtgttggtgaagaagacgagggcgcatcgggaatatatatacccccggatctttactcccggtctttagtcccggttgttgagaacaaccgggagtaaagaaaagatctttactcccggttgttgagaacaaccgggactaaatctttagtcccggttgtttagaacaaccgggagtaaagaaaagatatttactcccggttgttgagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10023 - DNA, 1885 bp, Oryza sativa
  unsure (1)..(1885): unsure at all n locations
tgcgggtttntttgattttcgatctcggtacccagcactcagcttggacaaaacaaattttatatgtgcactgaagagttagaacacattataattggaatattggatggatcagctaattagacagcagacaccgtttgatacatattaactcatccgtttgttttcaatgtgtctatacagattggggaatacgataaaattgagactgaaggatatgacgagataacaaagactgtccagttcaatggttgcgaacgatacaatttatcactaatcagcaagtctgcattcaattgaaaccaaaaccttatttaagctcaattcgctgatgtggtaccaatccaaggtcttggttatatatttacattgaaggtaaactctgcaagtagcaacataccttgaaaccatggacaggagttgccaggtacgttttgttttgcttgaaaaatgtaaatcaagactccattttcttagcaccaaataatgtggtcagaattatccaagtataagcaagtcagatattgaaaaacttctccatgttgatcttatcaaggcaaatcatgatatgactcttcaatatacaaatggctatgagtctgaacgaatcaactgcggcagtggaaccttaattaaagatctcaaactatccataatattagcaaatgaaggtctccgccatggctcactgtaacagacaaaattgccgttagtctcgcatgtcattgcgaattgattcatatacaaaaatagatgggtcaatgcatactttgcccagcacgactcaattaatgcagccacttgaggatttaaatcttttgggatatcaagtctcctgcctttaaagcctacagcagcgactacctgcagaaaaacatagcatcatgtaaaatggtaaaagtttttttttaaaaaaaatgatctgcataacttcaggagtatacttgcttctagataagaaaaatatgttatgcatgcattgaatgataccaaggactaattgcatcacttcatcagcatggacacaaaaaattagatagaagggaataattacctgggcaggattcagattacaccatggttgttgcattgtcataagttcccataggattacaccaaaactgtagacatcagatttctcattggatggttcatctcggagcacttcaggtgccatccattcgggctaatatttaaatggaaaaagaacaagataagccaaagatgaataatattttcaatgaaaaagggattgaagggtgaacttctgaagaatggaaatggtacttacagttcctgccaaagacttggaggacaaaaaggtgttggcttttagtcgtgaaaggccaaagtcacatacctacaaaagttaaaagggtgaaaggtaagtgaaaaatactgggatttattcaataacatgtagtgtggataagaataagaaatggggattagatctgctacaaacaaatccatataatgattaataatctttaaaacgatcaccttagcgatccacaaaatagttgcactaacacaatcatctcagatacaacctctgaggaggagaaaaaaaagaaacatgcctgaacatcacatactatgtcaagtcaacggctatgttagcattttttagcacacttagcagtccttgtaagtacttccttaaatatgtttacagaaaatcatgacctataaatatatatttatccatattattgagtttgcagaagcatcctgcattaaatgactacaagctccaaataccccccacctcaataatagaagtgctgtccgttatcagttagctgcctatcaaatactcannnnnnnnnnnnnnnnnnnnnnnnnnnnnnnnnnnnnagagtgtattaannnnnnnnctcca

SEQ ID NO: 10024 - DNA, 777 bp, Oryza sativa
  unsure (1)..(777): unsure at all n locations
tggtgcttgatacactttattnnnnnnnnnnnnnnnnnnnnnnnnnnnnnnnnnnnacaagtatttgatagatgcctgtgccaaatatgatgtcaaatgcccacctccccagactacaacacggttgcttgataaggttgtttctttacccactacacattctttttacactgtattttgatatgattttcgttaggtgattttgctatcttataatatcttatttacatatatgataagctagccactttgatatgaagaagaatgtccggtgtaatcctttttgttgcttccataatgtacagtacatttctgaacattttcacattagctcacaaacaaataaaagatctggggtatattgcaaaatccaacctgaagctatttgcttaaattttaatataccttttgcttttgtttcccttttggtattccttagccaaattaataaggtatatgctctgctctaacagctagttggccatttcttggaggagacatgtgtgaatcccacgtttattatcaaccatccagagataatgagtccattggcaaagtggcataggtctcgacctggattgactgagaggtttgagctctttgttaacaagcatgaggtatatactaagtcttcattgatactttcatacttggccccctttctgtttccttacagtgttatgaaatccattttttaggtgtgcaatgcatatacagagttaaatgatcctgttttcangncnncaannntgnatgtcgtagtttcatagtaccagc

SEQ ID NO: 10025 - DNA, 512 bp, Oryza sativa
  unsure (1)..(512): unsure at all n locations
tggtcttttgatcctctcttgannnnnnnnnnnnnnnnnnnnnnnnnnnnnnnnnnnatgaggatggcgaagtttttggtcgtgatgacacaacggactacaggaccatcattgtgcagcgggtgctcagcgcgcaggtacagcagcatgacaggttgcaatgccataatttgtttgagattttcttcgtcatcaacaaccgtcgtgcacgtgtgatcattgatggaggaagctgcaacaacttggtgagttctgatttggtcaagaagcttggcttgactacacgtacgcatccacacccttaccatattcagtggttaaacgattccggaagagcaaaggtaacacaggtttgtagggtttcgttttccattggctcatatgcagattctcttgattgcgatgtggtttctatgcaagacttgttcacttttactgggccgtctttgggaacatnnnnnnnnnnnnnnnnnnnnnnnnnnnnnnnnnnnnnnagtgtattaangcacaca

SEQ ID NO: 10026 - DNA, 818 bp, Oryza sativa
  unsure (1)..(818): unsure at all n locations
gactgatccnttagatcgctttnnnnnnnnnnnnnnnnnnnnnnnnnnnnnnnnnnnnnnnntgactgcgaggagtggggaaccgttgcttttttagaagtagcatctctttggaaggtttgcaatgggaatcatgaagctttggagtacctggcacagttctacaatgtacctcttgctgaaagaaattactgcatatcaccacagttgaagcagcaggcaacttcataggccacaagttgacgattcaggtttttctcaagaaatcttggagcaaacttattccgtttagttgatcattgtagtaccccctaccattttaaattgaattagcaaacgtcaaatacaaaaaacagagggagtacaaccttttcaccccagttcttgaaataaacttgtacagttgaatttcagtctgaatatctgatgaacatcaaggatgatgcaatcaaagtttcagttactcagtgaattcaaatctcatattggttctcaagaagttttatttcttctcttgctcagcactttctacaatataatccttaacctgctacacaagtgtttgttatctcacagggcacaacacacaacgtatgcaaccataagagaatcaacaagtatgcaaactcaatgagatacaaatgacaaaaaaagtacaattctcatacaacagttattggttcaaatattacccaaccagaagggcatttgaataacaatcatatattcgtattggtgtacctgaacaannnnnnnnnnnnnnnnnnnnnnnnnnnnnnnnnnnnnnagatggntatcaanagggatcaaaatcacac

SEQ ID NO: 10027 - DNA, 596 bp, Oryza sativa
  unsure (1)..(596): unsure at all n locations
cgagtgtgttagacnctctttgatagcgatcaaacnnnnnnnnnnnnnnnnnnnnnnnnnnnnnnnnnccaaatacatcccaatgtctcacctgaagggaggtgtgaaatcaattctctattggtggtttctcaactccgttagcatgatatttaatcttgtagccacctgtcaactccttaaccatacctgtcaaccataaaatcagatcattagataaaatgaacaggctgcttcatgttgatttcagtaaaaacaagataggacggcaaaaaaatgatatgacagaacaatagcaaatcatgaattgcctacggaacaaggaaaatgcatttaggtcattttgcagttgcatacaaaattgacatgaagatactattacttcctaaaataaaaagaaaaaaaagatgtttcagagacatcaagagataatccccagataacatggtttcagtaagctctatcaaatcattgggatctgcatatgccatataaaatttacatggtgggaaattaaggaatggcgttagggcaaattcctcatttctgaactggtttccaaatttataaacacgaatcaagcccccaacaaccat

SEQ ID NO: 10028 - DNA, 535 bp, Oryza sativa
  unsure (1)..(535): unsure at all n locations
ctgtcncattgtaaacttgttaaccnctnnnnnnnnnnnnnnnnnnnnnnnnnnnnnnnnnnnnatctactcattacaaggattttggcaaagatagaatagcataccggtggctggaagaattatagtgatcttgtcatagaatgattgccttttaagtgcttcaacctgcaaaagcatgtgagtcagtacatgtttaccaccgttaagcatcaatttctaaaaatacttccttgtcagttgcaatttacctgataactaatttgacttggaacacctcttccatttgtatcaacacgannnnnnnnnnnnnnnnnnnnnnnnnnnnnnnnnnnnnnnnnnnnnnttttcaaccctttgggggccccccccccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnncttttaactaggtcctttnnnnnnnnntgggnncnnccctganctgcgaa

SEQ ID NO: 10029 - DNA, 768 bp, Oryza sativa
  unsure (1)..(768): unsure at all n locations
atgggcnnatttganaccttgatanaacnnnnnnnnnnnnnnnnnnnnnnnnnnnnnnnnnnnnnnnnnctaaggcgaggcggaggaggacgaggtcagcctcggtggcgatgatggtgggctcggctggggatccaaaagattatagcactgcatatgattttcgcttacatatgtatagttagcatatatatgaatgatattattatattggtaaaaactctaattaagatatgtatgtacatactgcatgatttaaaattaataaaaattgtaatcatcatatatacttagcgtaggaattatattaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtn

SEQ ID NO: 10030 - DNA, 2841 bp, Oryza sativa
  unsure (1)..(2841): unsure at all n locations
gtggactnnnnnttagtacactctnnnnnnnnnnnnnnnnnnnnnnnnnnnnnnnnnnnnaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcgcgtcgattgcgtggcgtacgtccaagaattcctaatatggtaactcccaaaatatagagttctttttccacatcgccgcatgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaaaccttgtaccccttgttggactgtccggataggttgctaagtgcaggccaatcgttgatggttacgaacatcagcgctcgtaggttaaactcctcctgtttgtcctcgtcccacatggggacaccttccttcttccacaactgtttaagatcttctaccagtggtcttaggtacacgtcaatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcactttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattataccaaataattcttaaaaactatttgtaaagttttaaactaattttaatgtgttttacttcttttaattttcattttagtttgttttctattatttaagattaactttcactagagtttttcttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttaaagaaattttgaagcttgctcgggcagctggaggaggaagaagacatatatataggggtgggactttagtcccggttggtagcaccaaccggggctaaagatcacctaccaaccgggactaaagatcccgggggggcctgacaggccctgacagcattcgaaccgggactaaagatgatctttagtccngngtggttacacaa

SEQ ID NO: 10031 - DNA, 973 bp, Oryza sativa
  unsure (1)..(973): unsure at all n locations
gcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacttgaccattgcttctggggtgggcaggtgaggcgaagcagagcttgatgcccatgtcttcgcagtagtcgccgaagagttcacaagtgaattgggtgccgttatccgtaataatacggttaggcactccaaaccgggccgtgatgcccttaatgaatttaagtgcggagtgcttatcgatcttgatgaccggataagcctcgggccacttggtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccgaaccaggtcgaccgcgtcattgggggtagtcggccaatagaatccttgacgaaaggccttgccaaccagggtgcgcgaggcagaatgggctccgcactcgccttcatggatatcggcaagaagctcaacgccttgttcccgaggaatgcacttcaggaggattccgttagccgcgcgccgatagaggatcccttctaccagcacgtagcgtttggaaatgcgttggacgcgttcactcccttcgcggtcctcaggtnnnnnnnnnnnnnnnnnnnnnnnnnnnnnnnnnnnnnnnnatagtcatcatcaatagcgcagc

SEQ ID NO: 10032 - DNA, 1127 bp, Oryza sativa
  unsure (1)..(1127): unsure at all n locations
gctgggtnnnttgtttgatgnnnnnnnnnnnnnnnnnnnnnnnnnnnnnnnnnnnnnnnnnnnnnnnnntgtcaagaagaacgccaggtacatccatgactttaacaggaagaaaggcatgtcctacaaactcggcctcaacaagttcgccgacttgacgttggaggagttcaccgccaagtacaccggcgccaatcccggacccatcaccggcctcaagaacggcaccggctcgccgccgctagcggctgttgccggcgacgcacccccggcgtgggactggagagaacatggcgctgtcactcgtgtcaaggaccaagggccatgcggtacgtacctacgtactatacatgattacaattaatcttaatactccctccgttcctaaatgtttgacgccgttgacttttttaaacatatttaaccgttcgtcttatttaaaaaatttaaataattattaattcttttcctaccatttgattcattgctaaatatactaatactaaagtttttgaataatattcataaaaaatcaaatgtgtcaaacatttagggacgggggagtacaattatacaaatacacacatgttatttatgcatatatacatatataggtagctgctgggcgttctccgtggtagaggctgtagaggggatcaacgcgatcatgacagggaacctcctgacgctgtcggagcagcaggttctcgattgctccggcgccggcgactgctccggcggatacacgtcctatgcattcgactacgccgtcagcaacgggataactttggaccagtgcttcagtcccccaacgacgggggagaactacttctactaccccgcctacgaggccgtgcaggagccctgcagatttgatcctgtatgtaattcattaatttaattgtctcaacatattatatatatgatgaatggactgataatacagtttgtgtatatatcgtacgcatgcgcagaacaaggctccaattgtgaagatcgacagctactccttcgtggatcccaacgacgaggaagctctcaagcaggcagtgtactcacaagggcccgtatccgtcctcatcgaagctagctacgaattcatgatctaccaaggggtaggctatact

SEQ ID NO: 10033 - DNA, 1301 bp, Oryza sativa
  unsure (1)..(1301): unsure at all n locations
atatattanctataattatttatttaattagggtgtgtttagtgggccatccggaactgagttgaaccacgcggtgttggtggtgggttacgacgagacggaggacggcacaccctactggatagtcaagaactcgtggggcgcaggatggggcgagagcggctacatccgcatgatccgcaacatcccagctccggagggtatatgcggcatcgccatgtacccgatctaccctatcaagagctgcccctgccccatcaccgccgcttctgctgctgcttaaatcatccatgatctgtcgtcgtacgtcttccaacatatataccgtaaatgttatagcacgcgtgcataaaattatctgtggaaataaataaatatgcacgcgtcgcgtggatatataattactactactacgtacgtgtagacgaaataatatgagtgtgcatgtgtacttgtgtgtacctatgtgattgaataaaatagagctctgctcccgtatatacgcatgcatgtgtatgtagatatgcttgcttgacaagcggcaattaatataagagctctgctagttaaagaattacatatgttcttttatgttctatttaatttcggatcggactacgtacgagctgtatttatattagccagaactgtggcacagtgatgcaaaactacttaaattgtaagtattttaacacctacatccttcgtctaaaaaaatcaacttctaattataaatcatggtcagaaattagtcttgttatatgaaggttcactacgttaggttggatcacctctaactagctcaaaccctcccctctgatgggttcggccctgataaaaaatgagtggttagtgataatcctactcaccttactcacctctaccaactcgaggcccgttagaggagaatgtcgcctctaacggatcgcaacaaagtcgcccgttggaggtgactgtcacctcggacggctagatagggatacgaaagaacccataaaccttactcattgccagaattccagcccaccaatatggacaggccagtatctaggagttactagctaggcctaaatgggtaaggtaacccaaagtactgaagcaacaaatataggctaaattatgcgcacgcatatcagtaccgaaggtccttttgcattattagcttgtaggaaagcttgtacagtatgtacgttcattactactccctccgtcccaaaaagaagcaacctaggaggggatgtgacccctttcccagaatattgtatgtgggatatagggaggggtcacattccctagacctn

SEQ ID NO: 10034 - DNA, 1319 bp, Oryza sativa
  unsure (1)..(1319): unsure at all n locations
gtggantnnnnnttagatacactcnnnnnnnnnnnnnnnnnnnnnnnnnnnnnnnnnnnnncaattttactagtaaaaagttaagaaatatatgtcgatcgaaggaataattaacaacaagagctttatttatttatcaagcacaccaacgtacacacgcatacactgctatatcgttttattcaaactccatacacactcgggtaatgtatacatgtctttatccacatgtgcgcgtgctgaatatgtacctttatttatttacttatgcacatgtgtgtaatgtatatatagttgacgatctattaataagtttcgtagtacgtactatgcatgtgtatagtgtatgtgcgtgtagttgtacgtacatgtatagctcagttatatatgtatattgcatggtaggttggctagtaggatgcgatagcagttggggtttttggggggcagggacacttctttataggatatgtggcgtgcgtggcgatgccacataggccatctggggttcccacgtcacgtttcatgcggatgtagccgctctcggcccagtttgcgccccatgaattcttgacgatccagaattttgtctcgtagtcacaccataccccactaccagcacagcatggttcaacggtggtggcgtttggcaaggcccagtgaacacgccctgcatccatgcatgcacagtgataagttcattttcagcattttaattaaatttcactcgcgaattgaattaggtgaatattattggtgagagagataatcgctgaccccttggtagaactgccacccgctggcgtcgagtgccacagagatgggctgctggtagactttgagcagcagggcggcctcgcttttgttcacccactttacatcgtccaccgtgatgatgggttgtttgcctgccaccgttctgcacggatgcttcgtggcatcgtaggccgggtagtacggttccttcccgcaccgatccagggtgatcccgttcttgacgatgtactgctgcgcctggtcgggccaaccgccggagcagtcgccggcgccgaagcagtcgagcacctgctgttccgacagcgtcagcaggttccctgtcatgatcgcgtttatcccctccaccgcgcccaccgccgagaacgcccagcagctccctttgtaattaattagttaatcccattcattaattttatcaaacaatttattagcatgttttcgtaattaagtgaattattaaacatgttatacgtaccgcaaccgtcttggtccttgacatcagtcacagcgccatgaggagggaagcaggtcccaataacacg

SEQ ID NO: 10035 - DNA, 787 bp, Oryza sativa
  unsure (1)..(787): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaatactacatgaaaatgctctccccttagccatgcccctcctcatccaaaatccatgtaatcaacttcacctcccacagaattctgttgatctccacctttccaagagggaggagacatatgcatcatatgggtctgcttcttgtgtgagggtgcggtcaacaaaccccttgtcgctttaggctaccctctatacctgcagccagcaaaataaaaaatcctggctcaatgacaactaaatagtagctctcatttctatcatttccctctaatagaattccatagcgaaacaatcaacctaggtgatgtgctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10036 - DNA, 3808 bp, Oryza sativa
  unsure (1)..(3808): unsure at all n locations
tggaggccttttatgattgatatcaatnnnnnnnnnnnnnnnnnnnnnnnnnnnnnnnnnnnnnnnncgtttgcttatgattgcaggtcattgctgaccgtggaatcgagctgttgtctacaaccttcatttttagtgttattgtaggtggcatcactcatctgacctccctcctttcatatgtactgtttgttaatgaagttacagacttaaaattaggtgcaaatctgaataatctaagtttaagtaccaactgaacataactaattcagaagaaataaacggccatcgacatgtttgatgttttagccccagttactacctctatcatttggtacagctaaaatttagcaaaggaattagtcacactggatatgtctagaatttgtaagaaataacaaaaaaagatgatacacatagtgaaatcttcctactagttttgctgtcaaccaaattttgtcagcaccattaaactgttggcgtttagtgttcactaacatatggtcaaaaaacatttaagttcttttcatcgactcatttcgtgcttttgtatttcaggttaccttcttactgtattattcaggattaaggtcccatcataaaagttcttccttgaaaccgcatatcactgggaacttcatacaagattggtacttctaagaaactctatatttgtataaaaaccataatgagtgaaaattaacgtctagcatcccttttgcactcgagatatttcatcagttcttgccatttcaacttctaaaatttaccaattagaagcttatgtatctcatttcaattagtcatcttcaaaagttcaggaaactatcctctgtattaatcatataagttaatactgataatttttacattgatcactttgtctactaggtggttgggagtgcagctcaatcctcatttcatgggagttgacctcaagtatgtcagcaacgtctttgttttcttgctccattttggatatgtcgttcaaatatttaaatagcagcatgattattgtgagaattgtgctattggcttgttgcttctggtgcaagtatttattccatttcctattgatttttatgccccaacagattgattagttttgtaatgttctcatcgaattatttgatgcatacagtctatgcacaatgccaatgtggttcaaatggaacacttgtttattgtgcagttgactagttctaaaagaggaagtagtgttgttgagcgcataagctcttcaggaatgttagggtctgctgaaacttgagtttaccctgtcacagctatttgtttcgtcccacctgatttagaatagtaagacatgtaggctttttatttctgggtggacaaaagcaaattataattgtacatgaatttagatgcgctgcataacattttcttttcttttttaattcatcatctactaaagtcacgtaactaatctgtggtgagttttgttagggcgaatttgtggtgagttactatgaatccttgtcagtgtgatgtataaagtagatatccataaccagctattttcccttttctcaagttgttcctattatttgtctttcaaatgataaaataattggaggactcactcttttcgggaaaagagttaatttctccagtgggatcgtgttatgatgattttttttcaaaaaaatattcaccatgtttgcaggttcttttttgtgagagctgggatgatggcatggttatttatcaacctatctttgtttgcaaagagctacctagctggttcagccaatctttcagtcattctctaccaattcttttgtgcggtattggacatggacatttcttcttttgatcatcatatactccatagttcatgatactagttatgtttcttcatgcagtggtatattgtagattacttcgttcatgaagaattcatgacttcaacgtaagtatatcattttgtcctataatataaaaatatgttaatatcaatccagtgtgcttgaatgatcatctgaaatgcatgtgacgatcagcaaggacggagttcatacctcattgtttttctgtacagcttatttttttttattatttccagatgggacattattgcggaaaggctgggtttcatgctggtctttggtgatctagtgttcattccatttaccttcaccattcaggtgtgtatccatatatttttagttctgcaattgctaagtttgacccatgtcactgtttcagtcagaattaccattcatgcatcatatggctatatattcaattaattccaagctttatcacgttttcaagtcaactaaaagtatggatgcctcttttgttagtaagtcaggtggttgacattcaagatattatttttttaacggtgatgaccagggatggtggcttttgagaaacaaagtggagctgtcccttttggctgctgtagttaactgcttcattttcgttattgggtactcttcctatgttaccagaacctgctttcgattatataatatatggcctgtttattgcattctaatctctttaacaatggtttattccattgggcccacagctatcttgtgttcagaggagccaacaaacaaaaacatatcttcaagaagaaccctaaagctcttatttggggtaaacctcccaaacttgtcggggggaagctacttgtatctggctactggtaagatggatatgcatcttatggagcgcgtgcatgttttctcctttattaactgcttggtccataatactgagttctgaagtgtgtgttgttgaatgttccaatagcctaacatactaaccttctgctctagtctgcatacccattgcctaaagatttagctggtgctggtgagttgggacagaaaaggaaaaatactagtaaagaaagtgtgggtgagtaggtaggcagctaacacacaagttagaattcagtgtatctaaatgatgtttatcacagctgcaccaagtttgggtagtgtacggcgtacctatatcgatattaatcaacaattttgtagttctataaaagcttgaataattatgttcggctatttgaacttttcacgtccctttctcgctttagattaatcatgcttcttaagtactctttacaatgtgaaataatgaatccccttttcatccaatacaggggaattgcaaggcactgcaattatcttggggatatactgctagctctttcatttagcttaccctgtggaaccaggtgatgatgatcgttcgacacaactctcttattcaatttgattctcataaaccctaaatcataaacccttttggtgcagttcggtgatcccatacttctacccaacatacctgttcattttgctgatatggagggaacgaagggacgaagcaaggtgctcagagaagtacaaggagatctgggtagaatattgcaagcttgtgccttggaggatctttccttacgtgtattaaatccaaatattttgcctagcagttgcatcgttgtagaaccaagagcgttgttgtgctatttgaacatgtaaaattcaccaagattcctgttgtttatttgtagctgacatccgtgttgaatatcaattaacatagattttgttgaaaaagaaaggaactatgtcttgctagctagtttgatctttctttttccctaccagtctagctggtgaatactgaccgcattgagggcggtgagtgaacctgcaaagagctgaggcaatggcggcgactgtaatattcacgttggtttgnnnnnnnnnnnnnnnnnnnnnnnnnnnnnnnnnnnnnnagcatcatcaagtcgccg

SEQ ID NO: 10037 - DNA, 1978 bp, Oryza sativa
  unsure (1)..(1978): unsure at all n locations
cggatgtgattganattctagctcggtaccctctccggaaccgtacgacggattcagaaatctccggttgatcattctgttattcaaaatatacttatatagttattattaattttactgagatttaatttatcattaaagttttatttaaatatattttttatatttatatatttttttaataaaataaatgatcaaacgtttatgaaaagttaatagcatcatagaattcagagcttttgtgttcttagagagtttttttattgctgggaaaagacagaagcagcagctctgccggttggtttatcctctcttcacttatatttagagacgaagggagtactgcgtatcatatataagaacccttaattgactatagctctagtccaactttggtccgttgattatgaaaccatttattttttccccaactcttaaagtcgttaattttgatccttgatgtcaaactaagatgttttctgagatgatgtggtgccatgtagcatcttagttagcaatttaaaatgattaatttctaggattaaggagaggaagaggaaaaaaattagtttcatgtaggttgtaggattttctttttattattattattatagtttcatgccactcaccaccgctagctgtacctcctcctatcgcgtcggtagctggcccttgataccatgacgccggaggccaatggagatcacaccggctgttctctctaaaggtgtgtgatctaatggaaatttattatacatgatctaagggtgtgtgatctaatggcaagctcgtttggccgttgcgattgttcggttccatttaatgtggaatggacgagccaacgatgccaaaacatctttctgatgtaaattgagatattttaaaggattaggttctaagtgagtagtacttcatccgtaaaaagaaaacacaacctagatttagatagaataaaatgtaggacaccaaatctaaagacaaatctaaagggagaactatccaaatttattgttttatggtacgtctcatttcaatataggttaatttattttttttaagacgaaaagagaaggttgtagttacaagaggtgatttgtgtacatctgtactatattttgtgtgtgttgaaactgtgaaagaggaaagaaaagaaacgtaggattgcacttgcaaaaacaaatttgactttggtcggtgtaccactgaaagtaaactggaaaaacataaaaaatctccgtggcgtgtagcaagactagtaaaagatgcaacgtcatcatcttcatcgttgggaatgggatagttcatagtttagtgcccacctacccaaccaccgggaacacctcattctcttctcacgccggcgccgcggcgtctcgtctcctcccaccgcaacctttcttcttttgcttagctttcacttacactacccctcgccgcgcctcgccgcgcgacgcggccctttcccgccaccaacccctcgccgcgcccgcctcgcctccggagaccgccggaggatggaaacctcgcccgcgctgcgccccgcccacatccccagatccacggccgtccgcccgccgtgcgccacccctttctcccgcgcccactggcacgccacctgcgccgccatccgccgagtcccgcgggtgaacggcgacagcaacagtagcatcaagcccgccctcgccgaccacgccgcgccgccgttcgacctggatctgctccccgtctccaacctccctcgcccgctcaccatcaccgacctctcccccgcgcccatgcacggcagccagctgcgcgtcgcctaccagggtgtcccgggggcatacagcgaggcggcggcggcgaaggcctacccctcctgcgacgccatcccctgcgaccagttcgaggtggccttccaggccgtcgagctctggatcgccgaccgcgccgtcctccccgtngagaactccctcggcggcagcatccaccgcaactt

SEQ ID NO: 10038 - DNA, 2050 bp, Oryza sativa
  unsure (1)..(2050): unsure at all n locations
cggcgactattgatgatgtcnnnnnnnnnnnnnnnnnnnnnnnnnnnnnnnnnnnnnnnnnnnntccattgcacttaactgataatagctatttttggtgttatgcgatatggcaggttcgagttgcaaatgttgactggattaagataaactcagaagagcacatcagccttatggtatggagatatgctttccctctcttgtgatcagttttctcagatgctaaatctctgggttatttttttcattatcttcttgttctgtttataggaaggaagcacagaagattttcatatttctgctggaacgcaagatggacaagtctttagagattctcaggtccctcccatgcctccatgctcttgtatttcagatctttacacattaattgcatgtattagtgttgtctttgtattccttattgtgaaaattttattttctttccatttggtcatcctttatgataatttcctggtaagtttctgtggaaccttagctgttggtagtgttgctatagttcctctttgctcataaaatcctgtattgaatatataccaaatacactatcttaactctgtttcaagctatcttgtcggtgacagatttgttatcactaaacactatatatccatgactccgccaatttatgtcttctttgcagtacaaatacatgggaattgaagtgcatcttggtgatgagactttggaacttattaattcacatgagttgctggacggaccaaaattttcagttaaagctgcgaaaattggcacaacatctctatatgtaagttgacaatttcatggtggatatttgtttacttttagtggcttatttggcctgcatcatttactacgtttactcttcaggtcactgctaagcaatactctggtcaaagagttttgagtcaggttgtcaaggtggaagtgtacaaaccactgcaaatacatccagagtatatctacctcacaccgggtgcctcttttgtggtaaccattaatatcttctgtgttatgtcaactatttgtacttttctctgattttattactgtccttgtttttttgggtcctgagttttttcttccttgtagctttctgtaaaaggtggtccaaaagttggagttgtcattgagtacacaagtcttaatgtggaaactgtagaagttcaaaattctactggcaagctgtctgcaaagactgttggaaactctgtaagtcatacccatccaaggcattttcttgaccatgctctaagtgaacatgcgatttttgttatcattgtttcaatttaatataaagtatgctgcttacctgcacttgctttgaagtactacatttgattcgtgcaattttcaaacttccgagttcagatcagtgtactgaccagttgcaccattagactatgcgtgcagttgctttttcaaatgaaggcaccttcatctgtgaagcttttggaagagttgaagtggatatccctgtggctatgatattgagtactcaaagtgaccgtctttgtgttggttgcagcatgcccatctacccttctctgcccaaggtatgtttaatccaataatccttttattactatcttgtgaagttctgctacgtaacattacacatgctgttcagggagatctattttccttttatgaaacttgccaaagttacacttgggttatagaagatgacaaggttagaatattcctcttgttgccttgtatacttttaaatgctaagttcagagcactatgaactaacaaactgttctacactaggtggctatgtttcaattagctagatcttggcagtatggacttgatcaagggctatattcggaaggaaagaactatccatggttttcgaatggaagtagcaatgcttttattaatcatgtgattggaaggtactacatagaagtattgaatgatatactgaattgccaatttattgcctgtttgtacattttgaaagtagcctagccccttaactttttgaaagtagtggagtgtttctgttgagcccaatattcatattaaagggagctaaacn

SEQ ID NO: 10039 - DNA, 4468 bp, Oryza sativa
  unsure (1)..(4468): unsure at all n locations
natcagttgacccagactcagatgacctggagagtactattggatattctctgctaaggaacattggtaaaagtgatcttgttttgcaaaatgctaacattattgatggaagtaaaattaggactggagaaagcaatgcgattgattgcattcaggcaaaggatcactcaactggtagaacagaaattgcatcgtgcctacgagttgctgaggttggatgctggtactctaattacatatatttctattgcaaatagcatagcactaggcatccctattatctctgagattgtaatattatttatttttccatgtttttctggactacatttcatacacaatgtttcccttggtatgattgaagtcacttatgactaaagggtactcaaacgtatgtgactgggtagttaaagtaggcatatagttcaccaaaaaaaaaggaacagggatatagttgcatgttgagtgtatgtgtcagtttatcatttcaatgcatgcgggaatgcatactctagtaattttttctgtttaatatctaattgaggctgtttattagttttggaaaagaccaccgtggccctgaaggatgcctaaaaataagtcgcagacaagaatctctttcaaaatttttgggccatcattttatacagatgttctataatcgcattgctctctatgtttctatgtattttagaaaataatccttgattctgttgttatcattatttttcaggttgcacaagcacagatagcagctgcagaatcatcaatccatatagcctatctttctgtacatgataaagttgagttggatataaaatacagtgatgaattaggtaattcactaacaattttattagtatcaatgcttcatttattttatttttcatctagaaaactttacttcttcctgtttttatcctttccctccaaccaggttataccttcagtgaagcacttggaatagtccctgtaaagattgagacgaatcatcctgatgtcgtgtcaattcttatgccaaaagaaggcaatggtacacatggtacccatgaacgttttgtgttacaggtatgggcttgcccctctaatcgagcttcaatattgttttggaaaaaaaggtccatttttataaccctgaacttttgcaaaagtctgaaaaaaaaagagtgagtctggtgggaagttcaggctgtaaactgggtttttagtggatcttaacgctttctcaattgtaatgattgctttaaagctgtgacaagaataatcaaggaatattttggtgaaactaattctggaagttgtaacaagaatttgagtcaatcttgagtacggataatttgagtgagacttccatgcaaaatgtgttgtgttttgttgtcctttgcaggcaagaagtcatggaactgctcttgtaaggttgcaaatcagccatattcccaagaaagccgatttcataatggtaaagtgctaaagttcaatgctactatcccagagttctttgtctggtccataatggcataatgggctcgtagctatttaaacttgaatgcagtgtagcttattctggctagcgctcctcaggtggagttttttttgtgtatgtcttgtacacaatgtatcaaactaaactgtaatagcatatgctttcagaatctggcggtgacatcatctagcaaaaccatataccgaactgccatttcttcggttgaatgctcacaatggaatacagtttgtgttttgactaacacattccactatatcaggtatctgttggtgcacagatgtatcccagggatgtggtccttcgttctgggcagcaactgaacttcaccattattggagaccgtacgtccagtgaaaccatttccatactaccggttattcgcatctttttttgttgtattgggagtttcgtctgatgcaccatttcagtgtgcatgattatattttagttagttgttatccttttatattcattgctgtccacacatcacgttttagttagtagtacatgatcttatcttttggaaaaacatgggtcaagggtgatagtatagtactcccttcgttcacaaatgtaagacgccctttctggctggtcatattcagaaatgtagggcctatttcagattccaataaatgaatggtgttccctctacccctatatactactattctaacttccttacaagcatgccttagtgtatgcgcaaaagaagacgcaccctacattagaaaacaaaatggatagttcatagaaaggccacactaccagaataggtagttaactcatacatgttttgtaagagcaaaggacatgcatgctactatatattctatgctttgttttctaaccatggccttccttttgtagggatggatgtgcgtggatccagtcagtggttaagtagcaatgaaaaagttgtgcatattaatagaataaccggtgaagcacaagcacgtggtgaaggtatagcagaaggtatgcaactatgattatcttcaatgagtagaatacattacctagtgtcattccctcccgattcttatttttcagtgtgatttctccatctaaacagtaatattcaaaggtccaaatacaaaactgcacacaactgtcaccgtgctgaaggtgaaccagatagtagttaatgctcctgcggagacgctgacaaatgctgctggaccacctggtggatacaagttctctgtaaaattaaggtttgtaatgctcatatcatttcacaatattccttccatattgttgttgatcaatatagtcaaagccaaagctactctaatatgataatttattagatatgaacttctagtacactaggctattacagttttgcaatccatacatttaggcctattatactagaacttggagcaccagcagagtagtattgctaagatggtctctatgcctcatttttggtactttcagattcaggttcacagctggagattgtgacctgaaactggtggtcctagatgtgtctatatagaaatggtattatataacttgcaacagaatatacttcagcatacatcagttcttagcaacattagagaacaggatggtggagggaggcgtataattgtagcaggaactggacaaatagtcctgtacttcctccgtcccaaaatgaagccatttttgaggttggcacgggtattaagaaagtaggtgagaatgattggaggaagtgcgtgattggttgaaaagagaaagtaggtgaagaagaatggttgtgattggttgagaggaggtaggtgaagaaatagcttcattttgggacaagacactgtgctagaaatagctacattttgggacggagggagtattgaatagacaaagttactataattgtacgtagtatttgatactaagtccaatcagaacatagcgcttctgtagcttttttttttgtcttggtatttggatactcatgaatttacttatgtttgataaaaactaacctttccccccttgttaaagaagtgattcaactggacacagcgcagactcctctatcaatcacattaacgtcccatttgactgcagggttgaacccttttttgttgggtatgtttcccatcatcggctggtcatacaactgctttttcctctagattattatagggatgcattaaagtctcattctccttcttcccttaggtttgttaagccgtggagtgatgatgctgctaaaaaatcttactgcttatttcatccatattcacctgcgcaactgttgcctgttaagttaaacctgaaggaaggatttttacacattgttgttcatgcaaatctaaaagaagatccaaaggtgacaggatctgctcacgccctctttgtcaaagggttctacattaaagaacctaggaaggtagccaccttcccactccccatctcatgtgcatttctttttgttctaactgattattaaaaagctggttatctgatgcagttaaatctgactccaagctgcaaccatagcatcatcactattggtgggaatactggtaggataaaaccctattgtgtccatgaactttagacctttgggctttggctgtgtttgtttctaatgctagagttattattgcccagcaccagatgttgagttattctggaatgctaaagatttactgtcagccagtcgtgttgatacaaatggaagaggtgttccaagtaaaattagttatcaggtaaattgcaactgacaaggaagtatttttagaaattgatgcttaacggtggtaaacatgtactgactcacatgattttgcaggttgaagcacttaaaaggcgatcattctatgacaagatcactataattcttccagccaccggtatgctattatatctttgccaaaatccttgtaatgagtagataactagagtcatgacattacatggtgggtaccaggtaggatagatcaggnatcagttttttat

SEQ ID NO: 10040 - DNA, 697 bp, Oryza sativa
  unsure (1)..(697): unsure at all n locations
ttttcctcccctacaggccagactaaaaatatagaagtaatttataccttgaagaaagaagagagccatcgacatcaggctttgacaacattggctgcaatcgtgacatgcattgttgttccaatcgctacgattgcgctcttcatgaagttgctggagaagaaaccgatcagagaggcaccaccaagacacgcgactcctgcgcctgcgtcagcaccagcagccgcgatggctgacccagcgtccccagctactggtgagttgtcacctcgtacgcctcagccgttcatggagtacgtgaggaggaccatcgacgacacgccctactacaagcgcgacgccaggaggcgattcaacccccagaacacgtactgatcaaagcgcatgcagcctgggtaatctgtggcttttgtgcctgcattttgcccaaatggtagatatggttagacggtagtacgtagctggcagagagactatagtaatgtgcttggacgtgcatgccggaagatctaccgatgagctttatgctgtcatttttctgatgtcgacagcatcatgtatctctctgtatcatcaattggtgatctgccgatcccatttcctgttaaaaaggaatcgtagggaactcgtgttgtacagttctnnnnnnnnnnnnnnnnnnnnnnnnnnnnnnnnnnnnnngtagtagactatcann

SEQ ID NO: 10041 - DNA, 1279 bp, Oryza sativa
  unsure (1)..(1279): unsure at all n locations
gtgcgtcntttgattgcaatcannnnnnnnnnnnnnnnnnnnnnnnnnnnnnnnnnnnnnnnnnntaggacatgcccttcctcttgttgaattcgtggatgtacctggcgttcttcttgagcacctcgaacctgctaaccttttcggcgaggtccccccactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacaggttaaaacttgtcacccgtcacagatgagtcattagtgacgtgtcgtaactacctgaccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttgtatgctacaagtgagattcgaactcaagacctcaacctccatatagagctcccttaccaactcacctactcaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaattttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10042 - DNA, 6951 bp, Oryza sativa
  unsure (1)..(6951): unsure at all n locations
gagcattatataaacacttataaacaggtgcatcagcacaacctagcagctagcacacaagtgttcatacaggtattttactggtctaatagtaataagtacatatatatatagatggtgcttgacatttgtaggacagcacaaactacatgataagcacgtaaggtgcagaactaattagcatagtaatagtgctaggggtggaaagcggtccatgtccattgtgatcaccgtgtttactggtaacaaaaggatgcatctaacataaccatgagtattgttatgttgtttagagaacatcgacattagcttgcaggcaagttgttttatagaagtggaagatgcagactgattcgagatatatgtcattgtttggctgcgaagtctgcccatcctttcatcaagttgcagcgaccgtctggtgacgtggaaaatcatgttggttgaaatacctcctgctacttgaactttaatgttgatgggatagctatacttcagtgttggaggtgtctggtacccctgcatttaatagttgattagtaatatatatatttcattatcacatccacccaaaatcccttatatttatctagttgtattgacaatgataaaaaaaaataataattactaccgcatagtaatcaaatatggaaggtaaaatgaaacagattagtaaagaaaagaaaagttatcaaagctcttactgataattagcaaaacaagagttatatgctagccaaatatttcagttgactgcagacactaacctgaaagcataggtcatttaggtataattaactaaagagattgcagctaggatcagggcatctgcagtcacacagcttgggcatcattatctacatcaagcaaatctccaagcaaattcaggtaaggccgtgtttagttcacccccaactaccccaaactttcaactttccatcacatcacatcacatcaaaaactttcttacacatataaacttccaagtttttttctaaacttataactttctccaaacttttaacttttttcaggaactaaacacaccctaaaggagaacaactttacacaaaatggacatcaaaatcatactaaacaggcaggggccgggtgtctgttcgaagttactgatgtccccctcatgcagaaagctgaaaaataaatctttgcttggtaacaaaccggctaccactggcattctagtaacatctaatctaacatgattaaagtacgaagtcatgataatactataatcagtatttcttattggaaaccaacccacaaacaacgagtaattcatacatgaagcaagaaccaaacataccaggttagtcgagatggaggcggcctgtcaccgggatggtcttgacaaggacgaggtggtggccagagtcagagtaggcagtagaggtccagccgacgagcgtcgtcgtatccaggagttttctcaaagccgacgaaacagagccggtgatgcaatatgtatgttgagctacacagatttagcatgttacagcacaccttgctatttccagtatttcatatgatctaaggtttgttcacataacataaaaatattttccatctttacattcttacatacaaatgaaagcacggttatatcttattttgcgctaaactaaactacagtatcatggttaaatcagcaaaaatctatgtgttgatagctcgttccaaaaagacaccatcctgaatacgaaaaaaagcagcaccatcagaacaatccacatgaaacaattgcatttttttttaattcattagcccttgtgtacgctgtgcatgacaaagaaatatgtggtcatgcactcatgcgttcgtaggttagtcaatgcatttatgtaacattagattctattgttgactttctagatcttttatatttccttctaaaatgaaatgtaaatgcatctttcatataatattgattatttagaaacccaactattacaaagtattagttttgcttgaagaagcttacattagtaagcatgttgaagttctccaaagcttgaacctacaaaacctggcctcgaacattcgtatactcagagttccactttctgtggaaaagatgtcagttaacgaccatataaatcataacggtcctagttataccctcaatacaaaatcaatgcttagtgaggttgaataacgaggttgttactacaagataatacacctgaagtgctgtcagatagttatggattgaaaacatttagatagtgcatgaaccgagttacctgaataattgacaaagcaattaaggacatatcacataagatttgttctacaatgatttctcttaattccaaatagcacatgcacataatgtagagttagcttgatccattcaagaagatctaaataacccaatttcacataaatcatataagcaacagcactgactatttgtgttcatatgaaaaaactataattgatttgaagacatggaccagctgctggtcataggatgatcactctgtatccttgcctaacatgtgctgaaaatgattaggatagcaaaatctgcataataaaaaaattacttaaggggaaattagtatgttgtgtagccagaagcaaagattatctattaaacaacgctaaaattcaagctagctagagtggcgtgccttgagaaaccattgcatcaataacgataacaatggcatgcaagaaatggttagattgcatcagaataggcagatgtaccataattagaccgataaatttgagaaaataattccgtagatgataactatagatgggagaaaccatggtaacgtgcaggctaaaatatattgagtaggaaatctagcatccatatacaaataatattggcatatcggatagaacctattgcaaataccggaattgcgacatcaaacgtcgacagagctgataaagcaccagaaccagatggcttcactggggcattctttaaagtttgttgggaaatcatcaaggaggacatcccactggtgttcaactccatcttcaatcttaggtgtgcgcacctcaacctaatcaactcagcgaacattgtcctaatcccaaaaaaggatggggccgagagtgtttcgaactacagaccgattagcctgatccatagcattgccaagatcttctcaaagttgcttgcgttgcgtcttaggccccacatgcatgccttgatctcggtcaaccaaagtgctttcataaaagggagaagtatccatgacaacttccttttcgtgcggaacatggccagaagatatcatcgcttgagacgggcaatgttgcttttcaagcttgacataacgaaggctttcgactcggtgtgttgggattacctcctggccttgctgcagcaaaggggcttcccgacgaggtgggtggattggctaggggctctgctatccacttccacctcccaagtcctcctcaatggctcgccggggcaacgaatcaagcatggaagaggacttcggcaaggggaccccctctcgccgcttctcttcattttggctctacagcgtattctctccaaggcaatagagctaggctcaatctcaaaacttcggggaagaacgactcgagtgcggatctcgatgtatgcagatgatgctgtcatcttcattaatcccacctgaggcgatgtcacggctttcgcggacatcctacatcgtttcggcacagccactggacttgtcaccaaccttcaaaaatcacaggtcgtggccatcagatgtgacagcatagacctgaccgaggtcctccagggcatcccagtaatgagggcaaattttcccctaaaatacttgcgcctccccctagttctgggaaggatgcggaaaacggacttacaaccggtcttcgacaagatatcaaggagggttgcaagctggaggggcaagaacatgggagctgccgggagtaccacactcgtcaaatctgtgctctcagcgcagccaatttacctcctgactgccttgaaggtgacaaaggagtctttggagcaactagacaagcagcgacgacgattcctctgggcaggcacgggtgatatcaccaggggaaaatgtaaagtcaattggataaagacgtgtttgccgaccagccaggggggcttgggagtcttaaatctggacaagttcacaagggccttgagattgcgatggctttggcatgaatggaaggatcctaccaagccgtgggtgggactggacacgccttgtgacggtttagacaaggacctttttgccgccgcgacaaaggtaacagtcggagatgggaatacggcacgcttctgggacgctgcatggatagatgggcagagaccaaaagacctcatgccacttttctatgctatctccaaaaatagaagaaagtccctgcgccaaggaaaagagggtgacgcctaggtgaatgatctgaccttcaatgcggcctcgcctatcacaatcagccttgtcgagcaactggttcgcttgtgggaagcggttcggaatgtgcacctaaacagtgaagagccggaccagattgcttggaaattcacagctaatgggcactacacagcctcctcggcctatcatgcgcagtgcttaggggcgccaaactcaaatctaaactccctgatttggaaagtctgggcaccggggaaatgcaaattccattcttgccttatcatccaaaatagagtttggacatctgaccgccttgcgacaagaagctggcaaaataatggacattgccctctctgtcgttctgaacttgagacaggaatacaccttgtcggcaggtgcagatacacgaagagaatctggagcctagttgcttcttggacgggttatcagcaattggagcccactgagtgggaggaagcacggtcagtccaacattggtgggggagtttagcaaatacacccggcgtcccaaaaaagggccttcgatccctcattctgctagtcgtttgggaaatctggaaggagaggaacagatagatcttcgaccacaaagagatggcaaaaggcttcctcctatcaagaatcaaggatgaggctagtctttgggctctagcgggagctaaaagattgtgcgatctagtcccacattttgtatagtgtatagctcatagttctctttctttacccttaggggttgtattttctcctgctctattcaatgaaaaggcacacctgtgctgttttctgttaaaaaaaacaaatataataatgcaaagacccatggtatattaatataacttgctcaaaatgcaataaacaacacataaaattcttctagtgtcgtcgatctaactaacgagcttaagaagcatggtatatcagtatatatagttctttgtgcaaatgatccatgaattttaaagactaaacaagagcaaattggtttaagagtataaatatcaaaggtcaaaatcactatacaacatgctttagtggactttggctttggaggagagggaagcaaacagagaaagacagacacaaccttacctcacgtcatagaattttatgtctcatgcgaactacccgatgatctactgcaccctcataagtaatgccttgggtcctccctgtttgcctctttggaggatccatagatatagaaaacatttactcagtggataaaggcaaattgtgagtttcatagtagaagacttacttctataagctgaccgtggatggtaagacagagttagtgcacccaaaggtacatatctgatagcagctgaaatgtagcaccataaccatcctgaggtgtcctgctcagaggatatctgacatgttcatcctggttccgatggatttcaggtggtaacaaatactccaaacaatagaatatatgcctaatacagagaccattcaaagataatatactattggatgcagccgtcagtggcaattgtttttttaggggaaaacggcaggagctctgcctattcattaagaggaggaaaaagagtttgatacagattctgggcacctccaagagatgtcacaacaaaacatgaaaagcaagacagaaaaatacagaatttttaggaagtgcatcgccaccagcatcagacgtcttcgtgttatcatctatccattttgagcatcaacaaaagccttgcacatatttatcacggaagcaattgtattttggagcaaagttacctttggagttgcgcggttaacaactattattgtgccatcaagttcatgtgaatctttcatgttattgtctacagattctgtaataacatcacagtgcattagaataaggtaattacaaaatgcatatcaagcttattgatcaaactggggaaaagcaatcatgcattaaaaatacagacatgaagtaaaaagattgaggacacaatgccatttttatataaataaagattcatttatgttaagattgttcttcgccgacaacaaagtaaaattaaagcctaaagaatgatgcaggatttctgcaaatgtacatccactctgaaaagcgatgaacacaatatcacgggtccagatcccctagagttagactacaactctaccaggtggagttgtcatgatccatgacattccgtatacttcaagggttgggattaagccgccttaatttttactacataaaaatcagtaactaaacattcaataaatagacttgcatcaacattgtcaccagataatttctgtagaattatagaattaatacataaatttcatgcttcatctattgtataaaaatcatacattggtatcgttcacttttgcatgtatgggaaagcactatattggcatacaatgccgcataggattgatcgactgtatgtgttgcttaaaaacaaaaagttgttgtgttaatttgtttagaacttaannnnnnnnnnnnnnnnnnnnnnnnnnnnnnnnnnnnnnnnnngaacntcaaannngggcgcac

SEQ ID NO: 10043 - DNA, 3364 bp, Oryza sativa
  unsure (1)..(3364): unsure at all n locations
tgggggngnnnntttgatgnnnnnnnnnnnnnnnnnnnnnnnnnnnnnnnnnnnnnnnnnnnnatgtatgggaaagcactatattggcatacaatgccgcataggattgatcgactgtatgtgttgcttaaaaacaaaaagttgttgtgttaatttgtttagaacttaatcaaatcactattacaaaggaaaaccttaaaaataaaattctccgaacacttaaccattaatttaaggataatttattaagtgaaattgacgaggcatgatctcaaccgtatagaaataacggatggcatagatttagccaactccactcgatacatttgtacccaactctaggggatccagaccccaatatcacgatgacccctttgaatcatgttctacacattgtagttccatttactgctgattgcgacaaataagcagaatcctatattttaaatacttcttctgtgctaacttagattcaatatgcaccttccatatcaagtctcttataagatgcatatgcctaagttagaaaaggccaaaggagtccagagaatcctagctagcgttaggattagtttagacaactgtccttatcagaaccaaatgtaattaactacacaagaagagtgtctatacttgtattggtacttaattttgatatcacagagaatacataaatactgttttcagctaatcaaacatcatgtacctgtcaataaaataattccaaatttggtcacctttggcatgtaaagatgagtgatttctcctaagacttcaaaatacctgtgaataaattactctagccgttggttttggagaagccgtcgtctacgtacgtctgctcctgctcgtatgccgccaccgacgtggggggcgaggcgagcgccagcggcggtgccgacttgggtgacctgggaggggagttgtgactgctgcggattcacggaggattgcaaggccccatatatcgctggcatgcgggcgccgtacgagaggatcgaggtgggtctgcgggctctgcacggacgccatcgacgacgagcttggctgcacctcttcgcccatttcgccggcggaggcgctcgaccgcgcgccgcgccttcatctgcggcgtcggatgagtctccaccgcgccactgttggcggccaagagcgcggacgggattgatattcgtcgtctttcttctcttgctccgccgtaggctcgctggccccgttaccgggaggcgtcgagaagggatcgattggaaggggaagatatgaggcatgaggtcaaccctttgggatccataccgccaaccatcgctctacgtcgcgccttccccatcacctcgtcaatcggtgacccccgtccccttcgcgctctccccgtcgcccattcagatcccactcgcgcgcttcgccatcgatcgctgaatcctccccggcccgacgacaggaagcatcgccgcgtctagcccgaagaccggccgtcgaccactcaacagccggcccgtgtctgcatgcagccgtgcaccgagcccacgcagttcccaattgccaccaccacatctcaggccacttggacaacaacatcgagcgccacctcctcggttcacggtaaaatcaattttccccatcctcctttctattcctcctatctaatgatatttgagggtttttttttctcctcatctccattatgggtacatctctgtgaagctataaaatacagagagattagcaacactaatatgcatgcctttgtcttttgtaaactgtcaggattaataaatagtatatgtcttagtatagttctgaatttatacctgagactgtcaaaaacagggcacggctatgccctatgtggttaacttatatggatcagtccatgtatgtgcccaattgtataacatatagcttgttatatttgtcagttgataaatatatgaatatatgtatcatatataccatttaatgtcatttttcacttaaatccattgttaactatcaacaccagtattttcttttaatcctctacatgcctatgattttccatctaattccttctccatatgtaacaacagtcattatatagaatatactcatgaatgatttgttgcactctgttgatgtaggaaactgtaataatgatacctggaatcatggttattgacaatataaatctcacttaacttaaatttgaagtcccataaaatacacattaagatttagacaaaatttgcattgtaccgaatgagtctattaaaaatcgcaacataccagaaatgtctacttgaatgttgtgcagaatatgtggttcagattgaaaaatggatgtttctttggtaggccatacagcatccatgatgagcaattgggtggtacctgggtaattcaaatgtcagttctatcctaactttttttcgcacaaagataaattgctatacaagcttgttgacaatcaatattgctacatctcaccattagggcagatattcataatttctgcagcgcagaactggtgacaatttggttattagttatctttatctcgcatttcagttttccatagaattacaaaactggtgatttctcattggtgctttaaaagttgcggcactggtttatcacagagaaggtgtgattgttgctctcaagaggagtaagttcgctgggttgatggttcttttttttgttgttttgagtttccctagtctttatacgagtgtacattccagttttcaatgctgaggtgggctatccctagagtttggtttattagaatatccgtgagctgtctcggtttactctcttgttttgaagcggagattgaaacctttcgttatcaaaactgagatatgtgttgtctatagaacatcagggctatatagtacaagttttctaactatggatgcactaaaatgttggatcaactgattatttttgtttctgttcatccataagtcccatagaaactgacattgtttcactttatattttcaaatgtgctttgtaaaagttttgacccatgtgcagcaaaattcagggacattacctccgcaacgctagacaagcccctgtggttgctcatgaagatggtctcctcgttcggtgtttcccgtcactccatcccccgtctctcctaggctccaacgtgcggtgaagcaccctgtgcccctgtcctacctcacgacatagaaacaacgggtgctccaccccaccgctcatcccttcctccatgaatggcagcggattacaaggatacagtacagaggatggagttgccatggacagcgaccaacacgggagagatggtagtgacaatggctggtggtaagtaattgttgtttcaattagggattttaatttgttattcaggctn

SEQ ID NO: 10044 - DNA, 1646 bp, Oryza sativa
  unsure (1)..(1646): unsure at all n locations
atgcgcnttttgattacttnnnnnnnnnnnnnnnnnnnnnnnnnnnnnnnnnnnnnnnnnactcaatattggaatgaactttgtattaccataggatgttgctgtgaagatacttatggagcaggattttcatccagatcgcttcagggagtttatgagagaggtttgtttaactttttctttgatgcggtaaaggcctttgagcttgctatttccagtattatgtttcttcattcctgaaaaatagtattatgcttcttgaatgaatggctactagccacaatgtgttgtgccctggccgtgtttatgcatttatagagcatccccatccttagtactcaccttatgagtttcttctcattgttataggttgcaataatgaaaagcctgagacatccaaatattgttcttttcatgggtgctgttactgagcctcccaacctatcaatagttacagaatacttgtcaaggtatggttgtgatgtgccttcaagctattccgttaattatctcaatcatttgatagcaagtttaatgtgtccagcaagtgatgccatttttcattgcagaggtagtttgtacaaattattgcacaggagtggtgcgaaggaagttcttgatgaaagacgtcgcttgaacatggcatttgatgtggtattgtattatctcatattctcttttttgtgacttttgtctacctgctttcacatgaacttttaactcccaaaacaagaattcatactatttaagtaatctctggttgcttgacaggcaaagggaatgaactatctacataaacgtagccctcctattgttcatcgtgatttgaagtctccaaatcttctagttgacaagaagtataccgtgaaagtatgtttcataacttatacacctgattgcagctagacagggtatgatagtatgttttatgagtgcatgagtagatgattataaatcacgttgatcttgctgaaattgtggtgtcagtttttgtgatggatatttgtgtgaacttttgggtttttgctgtactactgtactgtacacaatttttaatgcgttttaaatcttgtctttttattattattattatgttttccttgttaccttctgagcagaaggattgagttcttctagtgagtatttgataggcagctaactgataacggacagcacttctattattgaggtggggggtatttggagcttgtagtcatttaatgcaggatgcttctgcaaactcaataatatggataaatatatatttataggtcatgattttctgtaaacatatttaaggaagtacttacaaggactgctaagtgtgctaaaaaatgctaacatagccgttgacttgacatagtatgtgatgttcaggcatgtttcttttttttctcctcctcagaggttgtatctgagatgattgtgttagtgcaactattttgtggatcgctaaagtgatcgttttaaagattattaatcattatatggatttgtttgtagcagatctaatccccatttcttattcttatccacactacatgttattgaataaatcccaatatttttcacttacctttcacccttttaacttttgtaggtatgtgactttggcctttcacgactaaaagccaacacctttttgt

SEQ ID NO: 10045 - DNA, 1320 bp, Oryza sativa
cgaccagatcgcctgcgcatccaaggtgtacgacgagatacgtgaggtggtcaagttagtgcacgcggattccgcgagcgcgctttctgactcggtgttcgtctggaaggagaccgacgtgtaggagagcctcaaggtgtccctggaagggaccaagatggcgtacgatctcgctaccactgccctgcacaaggttggggcatgggttgataaaaaggaaagcaaagtgagggatttggaagcgagggtggatgagctattgcgggagaaagagcacattggggtgttgctccgcagcgcgctgcaatcaaacaccagcgaggtgctcaaggttgctgaggatggactaagggaggccggaattgaggttgggctcaaagagcgcagggagcacaggccagggagcatggagaaagatgaagtctataccctagtaagatctttgtaatgctataatgttgcaggttcatggaccacttaatacggtacaactaaattatctatcatgcactcaatgctgcaggcaggggaattggagaatagcatgaaggagtcccaagttaagattgttgagctgcaacatcttgttgaagcactaaggtagctatctccactgacgaatttttgttctgtttactcccagtgtaccataagtttagtttgaagggtagcaggaaactcactagaactgtgtgtttcctttattgtgttgtcactttcgctgcctgttgaactacatggcaacaaagaattttaaaagaccaagacacacttgctgtcaattagacatgtggtctgaagcatttgtcttttgaagttctgtgtaagaaacaataatatctacgatttacaatgaaacattgggaaatgcaacactcttgacatctcgatatggacaactgagctgcaatgtgctaaatgctatcacttatcacctagtgcatttttcttcttcaaaatatcctgattttgttccagcccgtgcactgattctatataattattttttaaacttatcctaattgtgtgctttgcttgtttcaagggcggagtctggtctacttcggacaagactggaagggcaagaaaaagagattgcccagctacggaagcaaataaagcatcttgaagagaaggaaagggtggcaaatgaaagtgtaattttctactactgatttttttaggtttaatagttatcacacctttcttttccgagttattttacactgatgcttgtatgccaacgactaaacgtgttatgtacactcttaaaggtgagggtctgatgatggatgtaacaacttgttgaaaggagatcaa

SEQ ID NO: 10046 - DNA, 1324 bp, Oryza sativa
  unsure (1)..(1324): unsure at all n locations
atagaaaaggagataatctgcaagtcgtattgcagctgtttaaatgatgtgtctaaaggaagagattggagtctaaatgatgtgtctgttgtacatttagtgaaaacatcattaataccctgacatgagtttggaattaagcaggggctgtgtccttttccaagacgtaacaatgtttgtgaaacctgatcaatactctgattaataatccatgatagaattattatggctgcgctgctccattcagttgtcaatttgtcatcaatgaaaagcttctacacttgttttttgttaggccatggaaattaatgacacctggatttcattatcccaatttttggttaaggtgtggtcttattgcttgattatactaaaaaccaaatgggttttagtttgttcaggttggttatttccattgttgagtctaagaaaacaaattaaagatgcctaaggatgaaatttgctaggtatctgtggtggcgttggcattagatgtagctgttccccattagctatgcagtggctgtatgaactgtgaagggtacagaatcttaaggagcccttgatagagtcattgaatcctttttgctcttcatactacaggcttttgagatctgtcttgtagaagaaccgatagctgataagttgtccttgttctaactatgctttgttgcacagctatcttccctaaacaaggaattagacgaagctaaacaggcaatgctggagctagagaacaaactgaagttcaaggaagagacagcggctgcagcaatggcggcacgtgatgccgcagagaaatcattgaaactagcggatatgagatcaaccaggctgcgagagagactggaagagatcaataggcagctcgaagaatcagacaacagaagggactcgagcaatcgcaacgggcataggtatatgtgctggccatggcaatggttggggctgaactatgtgcgattgccaccgacagaggcagatcaaacctccaacgagatggagctatctgaacctctgatatagttgtgccatatctatacagattgaagaaatacacgacattttgaaaggaaaaaaaaaacgtgagaaggagatttcattttttttaatttgtgtagatgttcgggaaaattgttaatgcttgtgcaaaaactcacgagggtgttagatgcggcggtgcaattgtaaaatcatgcagttgggattatagttaagctgtcaataagttcatctttaaacaaaagtggagtaatttctaannnnnnnnnnnnnnnnnnnnnnnnnnnnnnnnnnnnnnnnnngtcaataaannnnggcgcca

SEQ ID NO: 10047 - DNA, 621 bp, Oryza sativa
  unsure (1)..(621): unsure at all n locations
agcgcctcattgattgcatcgtctagccngcacgcctgcaggtcgactctagaggatccccatctactcattacaaggattttggcaaagatatatttttataccggtggctggaagaattatagggatcttgtcatagaatgattgccttttaagtgcttcaacctgcaaaagcatgtgagtcagtacatgtttaccaccgttaagcatcaatttctaaaaatacttccttgtcagttgcaatttacctgataactaatttgacttggaacacctcttccatttgtatcaacacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10048 - DNA, 1294 bp, Oryza sativa
  unsure (1)..(1294): unsure at all n locations
gcgcgcttantttgattgcctactctgtaccccgacatgatagtaggctgtccagggccacttcgggactttgctcttgtccaaggtcggatcaagtacatcgagatgcaggttcatgtcaggccaggctccgctatcaacggcacctacgcctctcaaggctggattgctgccacttggagtgcaccacccaccaatccttggaagcaaggttggcgccaggactgccaaatctctgcctctcatcttgctgttgatcacaacaccatgaattttgagttgctgcctgagcttggcacacctcagcaaaccttggagagacttcacgtgggccttccaaagctcagcttgcactctgatgacattgtttgcttcatggctaaggtcgacctctgggatgaccagaatgcatgggtgcttgctgttgacatgaagaacaagaggctaaaagatgtggccgagtttggcgcaggaagaactcttggcattagctctgcctacataagcagtaggatatcagactatcttcctacggctccaggtaatttatgtgttctaccggcgcatccactaactaattctgtcatccgttgcattgctagccatcatgacctacaagttttaattgatactcctgcttgctttcagaaatattaaacctgtgagttataattgatagttatattaaatcaattagattgatgcatatgtatgtgctaatcaattggaaacatgtgcctttgtctttactaacaagaacaaggggacattactgtaggacatgatactcattgtttctatgccgctgatgataatcaagttcagaacgctacttgtctggtgttaacaaaatacttgacacagctgtcttggaacacttcagtgagctaataaacatattacatagatataacctatgtacaggcagggaatcatgaaacagaatggggtttatgaccaatgcccagttaaatggctgtgcatatatgactgtaaaatggatgcctttctctataatcgcaaaatgttacctaacaaacagatggtggaaacaaaaactgcatcatgaccatgtgctttcacagaaagtgcatgtcacctaggttgattgttttgctatggaattttagagggaaaggatatatatatatatatatatatatatatatatatatatatatatatatatatatatgagagctactgtttagttgtcattgagccggttttcacttaatattttgctggctgcaggtttaaagggtaacgggggtacaagtggattcattacggc

SEQ ID NO: 10049 - DNA, 6419 bp, Oryza sativa
cggttagaactgatagatatattaaatcaattagattgatgcatatgtatgtgctaatcaattgaaaacatgcgcgtttgtctttactaacaagaacaaggggacattcctgtaggacatgattctcattgtttgtatgccgctgatgataatcaagttcagaacgccccttgtctggtgttaacaaaatacttgacacagctgtcttggaacacttcagtgagctaattaacatattacatagatataacctatgtacaggcagggaatcattcatcagaatggggtttatgaccaatgcccagttaaatggctgtgcatatatgactgtaaaatggatgcctttctctataatcgcaaaatgttacctaccaaacagatggtggaaacaaaaactgcatcatgaccatgtgctttcacagaaagtgcatgtcacctaggttgattgttttgctatggaattttagagggaaaggatatatatatatatatatatatatatatatgagagctactgtttagttgtcattgagccggttttcacttaatattttgctggctgcaggtttaaagggtaacctgaaacgacaaggggttgtgttgaccgtgccttctcacaagaagcagacccgtgtggtgctgtctaatccctcttggaaaggtggagatcaacaaaattctggaacaagtatggatgataaagaggataacatggatttggacttggacatgttttttggatgaggggcatggataagtgtgatgcatcttcatgccttgctgttgtgttaacttatggctagattatctactgttttatctgtcctatgagtaacttatatgagggggctattgctagtattttgtagcaaggatgaatagttgtatctgtagcacaatcttaagagtgtgctcttgtttatgcccctgtttatttcttatcaatgtagcgaggttgtaaaccgtatggtcctctagctggtgtcaaattgctcacactttatggatgcgtgcctcctggtagagttgggcgtctcaagtcctattatttttcttctgcaatttggtttcctcgcagcttttcgttttctgagaatgtgaattgtgaatctgaaatcggctgactgcaatcaacatttgttatgccctggatggcctggcaatcaacaggtctgtccataattctagatggtgtttaattgagtactagagtattatattttgggacaggtggggtatgttttatcagaacttttgaatggaacaaacttgaagatgcaaactgatgaggacacctagcacaacaccttgactagagtaggatcatcaaccacaaaagctaacacccaggaattatcttagcagcttcactcgatcatatattgtattgtttacagcgataattatctgattagtatcttgcagcattcatggccttgctagtaaattgtatgttcgacctcatcagataataccatggctttggtttaattggaattattagattctcttcccgcaagttggagtcgtactttccgagtctttttcctttggttttttgtttttctcctctcttagaataagtcggtctggcttaatgcattgtgtaacgaatattcttatcttttaatatattgacgtgcaatccttttacgtcttcgagaaaaagaattattagattctctaacgaattgcacgcttacttgatactactactctactagtagagtacctgcttgtatgagacatatccatgaaccgatcagtttgtcagtcaattctggagccgtatcaagttgctagcccaataaaaacttcagacacttctgtcactaactacctatgcctggacctgcatctctgaaaccaccaaattcagacctgtttggatcgacggatggaattataccacctaggactgggaggagtgcctgagttgccttctggccatggtcttgcccatcaattaaatacttgtcgtatactccctccgtctcaaaaaaaaaagataaatcctgtgttttttttccaacatttgactatccgtcttatatgaattttttttataattagtattttaattgttgttagatgataaaacatgattaatactttatgcgtgacttgttttttcaatttttttcataatttttttaaataagacggacggtcaaacgttggacacggaacctaggatttgtttttttttggacggagtgagtagagattaagaaaaagaaatggagcaacgtgttttatcgatcatacattctcaagtaaagctgacactgatgaccttctgaagagttttgtcttcccttccactgctgattcggtaactgaactgaattctactactgatcgaggcaaaaattatctatcaatatctgttgttcagaatcaaggatgaggatttgtgaatagttctttgaaataagagttcatttacaaacaagacttttttttctgaatcaaggatgacgatttgtgccttggtgaactttttagatctttttatccttgttaatgtgagcaacccccaggattgcagctatcttccttctaatcttcctgtataatcttggatctgtgacgtcctttgggtggcaaagagtattgaatctgatggcttttgcttccggcagagatggtggtgcctgaggttaactaggacatgctggcggtactgtagtgctggtgcatgcaacaagataagttgtgagtgcaaaattagatatacattctacaatgatcggttattttaactgatggtttaattctgtgctgacgtatgaatgtaggtggtcactgatcttcatttttgtctactgcaatggacaatgctagaagctcctcaccagaaccatctgcaagaacaggtaaagacaccatattactcttcaaaggcaaagatgttctgcaattcagaataaatttacattgaattgtgattcattcacagagaaatgaactatccagtcaaaaatactctcctacttatccatgggatatttgttgggtggcatcttaaggaagcaattacatatatttagtggtcctgactgacacagcaaatgcctgatgaagtgcaaacccaaatggctgcattgttaatgtgtctgtttacctgatgcttatgcttgcatctcaatttcagcactatgtttgttaaaggcttcaactgcacctatatttcttcttcatgtacagaggccatctcattattggcgttctgttttttcttactacttgccattaggacgaatatgctatagaagaatttgataaatgctcgatccaacatgcaactgcctatttggattaaaggttgaattatcaagccgggcgactaatgatatttttcggtgatcgaaaaattgtaatatgtgtcgaccgttgtttatagtggagacaatatcagcgaagcccaagcggttgcccgatctacccaggaggtggctccgccactgtttatgagctgtgatgtggaccgaaatatataatatgacaagaaaaacaaatgcatatgggtggtgcatggaaaactgaacttgttgtccttttgggttggcttaagtaaacataatgccaaatgtacgatatagcgcccatttaactttcctctaggtaatagcagtagtgaagccttgaaggtgtcattaactggcattctgagtcccgagaggattagcttgcctgtatttttttatcagattgtgtatatttaggcgccggcgtctgtgcatatcaaattatttggtgttgctgaatgatgctttccataaccaaattaaccgcacatacaaaaaggggaaatggaaagataaggcaaagaaagagatccaaatcaagaatattttttttcaaaatattaaatgttaattttgtcctaggtacatggaaatcgcttcatcaagagaagaaatggatggaggtagacatgccaacgtcttcacatgatggaagatcaaaaaggacagagggcttctttatttagctacggagtcgcggcttcatgtaatagtggtagggacgggatcttcacgcgagtatgacaataatgataggtcttcatggacgagcgatgggccttcatgcgacgatggtgacggcttcacggaactagagcgaaaataatgacttcataaaaagatagcgacaacttcacgcacactaagtggaattgttaattactatgtttggagctctggtgaccgatcgattttggtcacatgacttaagctaattggcatgctagttttatcggatcaggtgaaggaaaaaagttttaaggtggtataaaaatgataaaaatttaacaatcttattcttaagtcagtgaatagatggaagttgaggaattgaggcatatgcctgcctccttcctcctcatgtcatgtgttcctctcctcttcatgtggagtcttgagtcttgacaagcaaagaaggaaggaaacctcctcctcctcttcttcggctccaaatcaaccaaacaaacacagcttcggactctctccctccctccctcggcttccgcccatccaatttcttaccccgttcgactccactcgactcgacccgacccgcaggagagcgggcgtcgcaaaccctagctccacccacacccacacgctcatgccccccaaaccctagaccatgcgcgcctccgccgcccccatggagacctccgcctccgcccgcagatccgccgcccccgaccccaagaagcctcgcctcgcccagcaccccgcccccagggatcccagatcttaccccgctgccgccaatggcaacgcccccgccgtcgaccaggcgcaggtggacgagctcgtcgcgcagtaccggaccgccctcggggagctcaccttcaactccaagcccatcatcaccaacctcaccatcatcgccggcgagaacctccacgccgccaagcccatcgcctctctcatctgcgccaacatcctcgaggtgacccttctcctcttccgctattccattccctttctctccatgtaaaactattgaggcgcctcctgtcctacttactactttatcatgtacgtcttgtgctagatacagcaaacgtgctcccatgagcagccatcttttttgtattctactctacatacataataacatagctaatcgagatgagatccctgtgctgtgcttgttgcccaaacatcaccttctttactaatgaactgcgcactgacctaatttctaacaaaaggtttaaaccacccgcatttcgcctatgttgatgtatgcaaatatcagggtaatgagtgtttcgctatggactgaatttctctttgtctacgatcaaatccctttctatgtgtgcgtgctcatgcactactcttgtatgacgttaaggcacatggttatatacgctttaccgttgcggaatccatttcaagttaccgtgtgacgattttatgcccacgatatcattcactgtatgaatatcagacttactcgtcatggcaaaaggatatcaatggtagggttctatcaccctatgcaagtgttctatgatgctagaaaatatcataagtatcgacttatggttgcaaactgtaccaggcaggcttcagtttcattcctactcttccactatctgatccccagatttgtgctgcactgcatgttgaactgttctcatgctgataatgttctcaaattgtgtacctcatctccaccgttgcacacaagatggatccagatttcagaaatccatgtttatgattgaactctttagcgtgttcctgtaaaggtgaaaaaactgtataaattgtgatgagaggatgtggaaatactgcacctcataactggcctacgctggttggtgttgtcatgtagctgctggctacttaacttagatggttttcgcactgttcacttcttttgtagcctctgctcttcctaggtgatgatgcctactgataactcttgcatttcagctaggctcattatcttcacacgtttcgtgtgtttgaacaaaatgttgttggacttctcaacaagtagatgtaactcaactaaacaaaagatggaaaaacattgggccttctctatgtgagggtcataaagaaaatttgtattggtctgttgtgtagcagatttttctagtcttggagagtggagacacagctattatagcagtgacaccaggttttccattgttgtacttgtatcacattaacatttctgtgattctcttttttcattgaaacctgtagtacctgcttatgtaattgtattcttataggtagaagggtatgctatttcatattattggctgcttgtgcttgaggttcccaatgaacagaagctaccatctctgtatctacttgacaattttgtaaaaatattgggaaagaatattgttaaacaattttctgcaagattaccct

SEQ ID NO: 10050 - DNA, 2451 bp, Oryza sativa
  unsure (1)..(2451): unsure at all n locations
agccnccntttgtannncatgatanaatctatgctagtatgcctggaggtcgactctagaggatccccgttaaacatttttctgcaagattacccgaggttagtaaataatcgttcttgctcttctaacttttttttttgttgacctgatagttgagatgaccagcttcatggaaaaataatgaatcctggtttctttctgtatgagatcaaccttagttttcttgggcggttccttgttattgtaggtgttctgcaaagcatataaacaggttgattcttccatacacaatagcatgagacacttatttggaacatggaaaggagtgttttccccaacttcactccaagtgattgagaaggaacttggctttcaatcatctactaatggatcatcaggcgctgcaccatcaaagcctgattctcaatccaatcgtccatcccacagcattcatgtgaacccaaaatatttggaagcaaggcagcagctccagcaaccaaataaggcaagccaacttctttttttttttttttgtagatgtagctattcaatgctcttgtcatcctgagtatcgtatcaagactgatagatattgctcccattgaaaaaatatagatatgttcatagcattgtaactgctgctttatactatcacatcactcgtgagattttttcacctcattctattctcccctcgttctgtacagggacaggggatactgggagctggggccaagactactacaatttccgattctggtgatgatattgagaggactagcaggacagctgttgatagaggtgcagggcggcggctggatgctttgaaccctaggactgtaagttcatcatttgatcattgagtaacataagtgcttagatgtatttactttgttatatatataatgcatatgttattatttgactttgatatgcagaatgtacagcgggcacaaagggacccttttagcaatcctattcatgaaaagcaagatagagatatgagggtccttggattctccaacatttcgcagcaggctgttgtgggaactggtcttgttcgtgcaaaacctaaaggccaagatggaagtggcggaccatattatactgctggagttggttcttctgaagaacagtttgacaggcgcagcaatttttatgcaaacaaggatgttagaccatcaggatctgtacgtttagatggtgcacttttgccaactcctgttagtaattctgataggattggtaggccgtcatccaacaaaagctggaagaattctgaggaagaagagtacatgtgggatgatgtacgttctcaaggagcagattatggaggtaccagttcaacaagaaaaagagaatggatacctgatgatggaaatgttggaagctttcaaagggttaaatgggcagaggcgggaggacctttggaccctgaccaacacaaattagatagcttccaaagatttggaaatgcgacgggtcaagatagaagaattacaccatatatggtatgtgaaaagaagacagtactataaaatcatattcaatacttgatagatacagcaagttaatttcttgtacctaatgttgttagatagtttgaactgctggttcgctctcaaatttgcaatttataatattgcctcaaaatcttaggttttacctgtataccatgctaaattttgatgacatatatacacatattccatctttgcactacttttggacaagattataatctgattgttttttcaattgttcaggatcatgaagagtaccttcatggtaagcacgaagtggaaccaagaattgatagggaaatgctcccggaaggacagccgttctcgtcatctcgtggttcctctctctggttatcccatgaaaaacctctcccagacattgtgtcagatcctaggatatcagcgttttccaatcagccagcggacaggcctaccatttatgctggtaccttgtcaacaagtatcacttcatctgtacctgttgggttgtcagcagcctatgctggacgatcaagcctagaaagtgcagcaacaagatcaactgagactataggacagcaaaagaatagatattggtcaacttcctcaccacctgtacagtcaccttctgcatcatttgcacgccagagttcccctagtcctgtagagcttgattactcttccaaaccattctcacagttgggtcaaaattctctggaagactataaccaaagaactcatgccttggctcaaaaccttgcactttctcagggcagacctaatctgctgggtgctccttcacatgcctcccagcagattgaaaagcacccttccttgctgcagtcaaagccacatctcaggacacttgatcaaccgcaggcaaacttnnnnnnnnnnnnnnnnnnnnnnnnnnnnnnnnnnnngtagtgtatatcaaaantnaggccac

SEQ ID NO: 10051 - DNA, 4158 bp, Oryza sativa
  unsure (1)..(4158): unsure at all n locations
gtgcgtccnangtaggacatnatnnnnnnnnnnnnnnnnnnnnnnnnnnnnnnnnnnnnnttttgtccagccttcagttaaaaaggaaacatccaatcaaaactcatctgccccatctaaggtgctggtgcatcaacctgttgaaatcaagaaggaacctgcagaaatcaagatggtagaccttattggctttgacttcaagcctgagatgctccgcaagtaccatgcacatgtgatcagcaccctctttgatgaccaaagtcatcaatgtaatacatgtggtctaagattcagtcttgaagaagagctctctgtgcacactgcgtgccatggatcgaagcaaagtgagactagaaagactggtatcgcacctgaaaaatggtaccctagcaaaaataattgggtcgatagatcacatgaagtgcagaacagcgccctggagtctgcttcttctgttgcagatttgagctctgaagaggaagtttgtgaattcatggttcctgcagatgagagtcagattatctgtgcactctgtggagagtcatttgatgacatttattccattgagaaggataactggatgtacaaggatgcggtctattttgattcttcgaagacagaaggcagcagtggcgacagtgctgagagtaaagagcgtgtacccatagtgcatgcaagatgtatgtcgataagctcaaatgatggcatggaggttgattagcatttgtgccaaacacaggggcagaagcagtagcaacagaaacagctcgaatgatgagattgaggtggattagctggaaatctggtgcttaacagaagctcaaatgaaatgatgccacaaaagtgggtcagcgtgaggggtgatccgcagcagcaactgcaatgatgctgtcgcggccatgacatgtaggtggattagtgtgaagttgacaacctgacgcgctgcacaagtaaattttggtcaaatgtttgtgttcatccctcagtcaccattaatcgtggataaggtgcttacacagaataaattccaagtccagctctggccttgtcaaccgatcatcctcgcaatcgagatcttcgggggtctgatatttgtatttttggttcaatcgaagggaaatgatctttctgttcatagaaggccagcttgtatgttaaaaaggagtgtattgtttcattacgagggaaagcaataggtgacgctgccattgagttactgttgttttttggcaaacttgtttcatcttccgaggactagagattttgtacctaaaaagaactgataatagaacatcatggaggcagaattaaactagttacttatggcttgcttgcttgatgtgggagttcttcattgtagttcgatgttccttcctccttgccattgtgatgcgtaaaattgttttgtcgtcggaagttgttaattcggcagatgatagatctgagtattatataattctgtaattaattgtgaaactgtaggcatcagtaataagcgattccattcccacctgatagatcctggtgaatagctcaatgatttgcctctcatggattcctggtacaagtcaatgttacgaaagaggccatttggattaataaatgtcccttcagtcatgacttatgttactaatcacttgatgaaacaatgcggtcaagtcgagttgcttgttaatgtggtagcttgatgcacgttactccattgtaatactagtacattttagcatgtctgatgcttccgttttgcgtaacagcaatggttgggcttaactaagctaatgcccagtgggagaagacagcagccgaccgccccaccctggtctagagtattagcggaatactaacttgattatataaataaattcaatttctttttcaaaaaataaacacaataaatggcttaaaacaagtaatgcaatggtcaatggaaaagaacacttcttaatagaacttttttttaaagagtgaagtaaataagctgtttcaacaagccgataaataacctgaaaagaaaatggctcatttcaacagtcgaacgccacctaccgcttatggagtttgtggttgcagatggttccccttgctacctctgtcggtcagccccaaccaccaaaccaaccacagccatattcccatcctatcaacatcaaccttacggagtacgtgctgccatggatgcatgtttgtttctcccagtactcaccaaactgtcttctatgttctatctgtaccatctacagtactatgtgtgtactcaaagtaatggcatgccatatcgatcagtgaattcattcattttttttttctcagcaacaagagagccaaacatttgtgagcagacaagatcacaggacagcagaaatgtggtggttgttttgattgttttaggcagctcttccattccaagatgtaaaattcgacttactgagaacatcatcatgatgtaaatccgcacccgcgaccgcaatcaaacattaggaggtcttcctcccctctctccaattttggtcacaaaaatttcaaaggaaaacaagaagaagaaagaagcaaattaaccaacaaaaatttgagcatttcttgagataactgtattcaactaccaataacagcagcagcatcagtcttgttgatcaatcagctgctgctggtgtcgccggcggtttggccggaggaggaatactcccagggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggccgtgcccacgttggcgtcgtcgacgagccggatggggcggtggcggtgtggccggctctcgatcttggtgaggctgatgtcccggaacgcgaaggccgacagcaccttgaagagcaccgacgtgccctccctgtcgtgcgcgaacacgatgctcgtcttgaatggccggtccgttcgcgggatgatgggctcccgcgccagcatcacgaaccgcgtcacgttcccggcgtcgtcctggatgccgtccgcgagcacctggagcccgtacagctcggcggcgcgggaggacgcgatggcggcggtgtcgcggagccccgcggcggcgacgtgctcggcggcggccgcggtgtcgtcgaaggcctcgcgggcgacgttgaggcccatggcgttgagggtgagctcgcactgggcgagcgcctgcgggtgggagatgacgcgggtgaggaggtccctgcggacgcccgggagcgcgaggaggcagtggtggacggggagctggacctcgccgacgatgtggaggcggtggcggaggaggaggtcgtagttgcggtggatgctgccgccgagggagttctcgacggggaggacggcgcggtcggcgatccagagctcgacggcctggaaggccacctcgaactggtcgcaggggatggcgtcgcaggaggggtaggccttcgccgcggcggcctcgctgtatgcccccgggacaccctggtaggcgacgcgcagctggctgccgtgcatgggcgcgggggagaggtcggtgatggtgagcgggcgagggaggttggagacggggagcagatccaggtcgagcggcggcgcggcgtggtcggagagggcgggcttgatgctgtcgccgttcacccgcggggcgccataggctttggcgttggtggtagtggtggtggcgaggatggcggcgcaggtggtctgccagtgggcgcgggaaaagggggtggcgcacggcgggcgaatggccgtggatctggggatctgggtggggctgcggcgcgggcagagtttccatcatccggcggacggcgacggcgaggggtgggtggcgggaaagggcggcctccctccctccctgtagctgcaagggaagggaagctaaagctttgtgtctctcggaggtgttgcgtttgtcgagaagatggagtgagggactgcctccacctcaacgagacgccgcgggaccaactatttgtttttcttaataatcacgattcttaaatattatttatatttttttaatacattgctattccattttggtaagcgcaccaactccgggtaccgagaacggatcacaggtntcagtttctctca

SEQ ID NO: 10052 - DNA, 8917 bp, Oryza sativa
  unsure (1)..(8917): unsure at all n locations
aggagacttgaatgcgacttcggactcgcacaataaaaacttgacgcacacggaaaagtgcgagagctcanaaaacacacgctgggccccctacctggcgcgccagatgacggaccgcggcgctcctcaccgggaagaccgaacaggccccccctttgtcggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgtttgcccttcttcaaacaacatcttgcttgtaatggttaggatgaagcctggcatatatcgatcggggctaacgtgtcatctctgggatgtaacacgctagctccagccggagacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgcttgtgctcacctaacccatacacgtggagtaaaaacgcgaggggtcggggcgcctcggccctcgggggcgaggcaggagtggtccaacccccccccctcgggaagaccaagaggtgggcgcacacatcaccctcgggcccgacgtcccccgagggtgccaggccacgtgggcgatggtgtctgcctcaagcctctagtcatgatactcccggtcccatgtcaccgacagagctgtaaacttacagtcagcttggacacaataaccaagaaactctatgagagatacaagtaggcactgtattaactataaagagctaactattatatgggtaggctgagagaagactataaaaaaccttatagccaacctgttggctgtattattagccttgctcttattgcatgggctcttcctgcaccgtctccatcaccgtgaactactccttgctccgttcttcttcttcttccatttttttactttgggtagtgcaattcaaacattaagtgatgggtgtagtatatatgatcgatttaattcagtgggacgacacgtgtgtttgctttcttgcttttcgagttttcggtcaaacctagctaggagttacttcctccgttccaaaaaaaaaacaatctaagtgtggatagaacattacctagaacaacaaatctggacatcacaacgaatatggatattctgatgtccagatttgttatcctaggtggtgttctatcctcaccaatgtttttttttggacggagggagtaacccctacgtatggaattagtcttagcttttattgaggacaagaattagtctttgtgtttgaatctcctgaaaatgaagatgaagataaatattaagtgtttcacgtaaaatgaggtggtaataacatgtgattaattaagttttaattattacaaacttcaaaaatggattaatatgatattttagaacaactttcatatagaaagttttcgcacgaaacacatcgtttagcagtttaaaaagcgtgtcacgataatccaaattttatcctctcttagtaggagaaacgatcagggctacatgtcccctaaaattacttgtagcaaggtcctatttgattaaagcaatgtcacaggaattttaaggatttcattcctatgaaactatttttctagacaaccctttaaataaaggaatggacacaattaaatcctatgaaatttttatataatatgcctcatgccatataagtttaggagaaaatctaacatgaggtagaatgtcatggaaatttttctttaatgttttttatcctcctatagttctcacgtttttcccgcggtttaatcaaaatattatttctatgcttcgtaattatttattctaaacttgtatttatgttagtatcgtactttttcttattcataagtcttctcaatctcgtgtttaaagggggcctaagtagttatcgtgtatctaaattatattaccatggtaatcatgcattcatgcatgcatgatccatggctgctttattttgctttgcatctccacaatgtttgtttaatttgtgtgagatgtcatgaagaatggagctagccgaggcttgcaaatgaacatgcatgcatgcaacttttttttttaaggcatacatacatcatatagtactatatagtatagtagtaagccagcacagactgctcctactctatatattccaacaagctggatgcgacttcattatcttggttggggaagagctttattttgccttcaaccaacccatcttgggtgcatgccttgggcaaattcaaaagtactagtattacctaggggcccaaacccattacgtatgactaaacttcaagctaaatttttcatgatatttatatagacctaattataaatgcttgaattttagcttttcacaaaaacttggtgagcattaataaccagcctatgccatatatctttctcgaacccttgaggagatgtatttcctacctcaaatgtgtgtgacattatattgaagatcctttgtcttttaaataatttgtacacgtgaaaggttaaaaatatatttacatgtaattatttttcattaaaaaaatctaattaacaatattttgatatgtcttgttttagaacgaatgatttcttttaatacttgattttacgcttatcgcttgcagccaaaaattggccttttaatttgacttgttttcgatgttttcaagtgtatttatttttcagcattagctttcatgtcataagaacacatatataaaaaatttacctataaatatttttcggtgaaaatgttactgctcataattaattaatgagccttcaaaagaaaacggtgtgcttacatttcatagaaacattttcttgtcaaatattgtcacaagtatagttagctttttaacaccacagaaactatggaaccatacttatggcatcgaagtttgacaagttcacggagccaaccaaacatgctccgttccggctgtaaaaccaagatagcgagaaaccgcgaggagcagacgagcagtctacacgctttgtcctctctgttttttttttttggcctggatcttctacgccctttcaggatctcgtgctccacttcttcttcctactgaactaactgctcttcttgtactctctctctctcgcctccaattcaccgacgtctctttggcttttgctgttgaactttatgcagcacatacatacatgcatactggtcgcctactagctagtatggttgcggagccacagtctctgccatgcctgcaaatttgtggtgttcaaagatcacaaagggatcaaaagattcaatacaattgtacccaaagaaggatcccgagacccctaccaacggaaaagctgcattaatctgcataccagtatgaaagtttaggtccattctttttcccctagctttgccggtgtacaaacagggagatgaacgtactgtccaaccatctttcatgttccaagcttaaggtgatatttgattcaggaactaacttttcacattggatgtttggacactaattagaaatattaaacgtagactaataataaaactaattacataaatgagagctaattcgcgagataaatttttaagcctaattttagcacatgtttactgtatcatcacataggctaataatggattaattaggcttaatagatttgtctcgtgaattagtctagggttatggatatgttttatcattagtatacatttaatatttccaattagtgtcaaactaaattacgagatgtatacatactttgagagaaaatataaaatatggagcgcccaactatgtgtgctttttgtacaaattttttttctttggtccataatatttgtttgttttagagttggacacaagaactaataaggtagataaaatggctgttttgttcagttaatcattccaaaaatgcgcatgtatacatggataaacaacttagttatgagttaattaaggaaggggtacggtacgtcagaccaaaaaaaagaccaaattaagctgtctatcgaaattgtaggtcaacaaatattttgaggactgtaaaataggttaaaagtaagtattttgaaccgaagagatcaaagtagaaaaaaaaaactctgacatgcatgtttcatgcaaatttcagtaggttccaaaatatacactccctctatcctctatcccctaatataagagattttgacattttatttgcactgcttgaccattcgtcttattcaaaaaaatttagaaattattatttatttttttgacttactttattatccaaagtattttaagcacaacttttcgtttttttatatatgcacaaattttttgaataaaatgagtggtcaaatagtgcaagcaaaatgtcaaaataccttatattatgggacagagggggtacttcacttatcgctcttttcaacatttcaaaattttaatgcaaagcaataaattaaacaaatcattaccaacacaaccataccaaatgttgtcacaccgaaaataactttgaaagatcactcaaatgtactatactctattgtttaattaataatatgtaaataaaattctctgagtcttaaaaagaaaactatgatagatcctttctagccaaacatagtttgccacatagttttggctccctggaacttaattgtcttagaacatgtatgcatgtttgaaaagttgttttgactttctttccaaacaacaagcaagctaggatacatgccgtaaactagctagctgcaagcctgcaaattactgaagaacaaaagcttttgctcagtgtgttgaggatcgatcgcctctccatttgtaagggacggttctttaatttgcccaacgggcagaacggatcatattgatcgatctactcctgcgcagcacgctgttcaatcaatctttgacctgaccgaacgtgttgattgtacatgtacataggagtatgtactccggtcagttacaacgggaaaacagctttgcttcatcagcacaactttggacctcgctcgctcacatgcatgtatcttctttttttttttttggttatatatagtactccaggtcgtagctgggggtaaccagctaagccagaaagggagacgcctggcctcgcacctctatccctcaatttatttttcttcattctccgatgtattgtaatctcctcatcaagctcgttgggttcgaatcatttgtgtgccacagtgttacattcgggtatacaagcagatatagcgaccgtctctaacaaaaggcttgtaaaaatcaggtgaatgccggtgaaaaatcattttttacatgtgagcttacaactccaaaattattacaagtggatattttatggcatgcctgtaaaaataaaacgctagcgaaaatgatttttttaagtagtgattttgaggttcaaaagtaaaaaaaaaaatcacatttgttagataagaaatggcaatttttatgtgcaattgaactacataacaattgtttcgtatgtctctagtgtgactattgcatgtacttgaattctcacaaataggattaactttgaagttgaattttttttgtgggctttgaaaatgtacatgacctcttttaactgatcatgacatttcttttattaacttttggacctgtaagtatgcattttctaatttgcacccgtataaaaaactagggtatatatatttgctctcgagatgtacgcactggtgaagaacacctggcttctgtagcagtggttgatcgttaaaaagaagaatattgtgctgcttgcaactctagctaggacggacggggggcaaaaatgctgtggtgcaccgtggtacgcaacgtaccggaagactacctaggtaggttcaagtgagtcgcaccaatgcaatgcagtaccatagataggattcaaaacctctctctctctctgtagagcaaaaaagaaaaagctagcacagagctgctcacttctcagtatagaggcagaggcagagacgacagaggcagcgcgattctttctttttggcctcctctcctcttgtctcgctcttcttcttctccctcttcttcttctatgagacctcgctctactctctctggcggcgcggccacactgctcttcttcctctgatcgagacctctctcggcggcgcgcacactggtagcgtggtgagcggagcggtacactccctactccccagtgcttcttgttctgtatacgcatcatgttcttgcatctcacatcttgcaatgtttttcatgttctatccgcctccctcttctttacaatctgtttctcgatctattgtgtgctagcttcttttcttaaagaaaataatttggataaagagatgtcgctttttctacatctcgctcatgctgcatgcttatatatgtttttccattgagatcgattggacagccatggttccaaaataactagtttttaaaatgtttcaataaaaagagcatcttttttcttgtcttgtgggcttgtggttagtacaaattttcggtccgatgccaaccggggttttggtgcacatacgaatgccagctcctctatatagtttttggatggtgtgagaggccaccatattcatcatcaaaaggagctgatagatcgatgttgcctgtgtccatggctagggaaatggcgcgcgcggcgagattccatcggctaggtagctgcatctcatcgatccagaccaacagtatgcgagccagcgagttggctttgacgtgtgcatgcgttggggttcattgggccttcaatatatttctcttgtgaaaaaaaaggtgtcttttaattaatttaatttcgtcgtcgaccctgtcgaatgggacagtatattgggagagcaatgcaaacgatctggagtatctatcactcgatctgagcgcatatttttatctcacattctcactcctaggcgccctagctaggatctcgatcggtaattaattagtgtatcatcctaagatgaacatatactgtataaactaatcggccggtcctcctttccttgcaaatatgcaaattttgattctttatatatacgtccttataaatactggtcctcatcatttcaatcttagtatagattcggaaagagctagctagatacagcaatcaagaaatttgcgcatttatttaaatatataatgtgtgtttttctcttgaaattatcgtaccgtatttgattgtttctttgcttgccgtttcgtttgcacaggtatgggtccaaggagcacaagaggccgtgttctcatgttccttttgctggtcctgatgatggccgtcggagccaatcgcgattcaacagtacgtcttctcattcccttccctatcaatcggagagatctagctagtccttaattataaattgttcgtcccacgcttgctaattaactcacacattgctaattaattaactcgtagtgttgtgtatatatattcaggcggctggatttgcaaggacggtgtccaaggctgaagtgttggcatcacctcctccaatttcaccagctgtcaatgctgtcatcattataagaaatcgggtggttctgtcaattggtaaaatcaatgttttgaatgattagatgcacttttttatataaaaaatagatgataatgtggctttatatataatttctattattacaatacaattcatgtttttttatacgtcgttgtgtattgttatgatatatgaaagttttttcatgtacaatctagatattgtcacaattagatagtgtagcatttctctgcttcatctcaagcatgtttcaaaaataagtttgaattaatgacacctaattattatacgttatctaattgtttataacaaaacaaaactcacatcttatgtaataattggagttgtatttagaaaaataaagattagtattatctttgaggatttagatgtgtagaatggataacaatatcacacgtgattatgaactaaagggaggtgaatggatgagcaatgattaaattagatagatgaatagctagcttcttgatccaacggctgataactctatacaaatgcgatccaatggcttaaaattgttgataatgtggctttttgcatatcttgatttttatgagtaaatgcttcttagtgggtatcaactatataggaagatatgatatgcattcatttctcttctgctctatttgattgttttcaaattaagtcatgtctagtctcgtgtactagttattgcttttatggcgattaatatgcatgcttacaatattattaaccggtctcccttttattttttttctctgcatctatttaatttattttattttatcttattgtagctaatatttttagcgtagcagtctnnnnnnnnnnnnnnnnnnnnnnnnnnnnnnnnnnnnngaaagtcaacaaaaanngcccat

SEQ ID NO: 10053 - DNA, 3598 bp, Oryza sativa
  unsure (1)..(3598): unsure at all n locations
cgatgttgntttgaaccttgatgaatacctactcggacccaggggacgtttttcacgaggttttggattcgcaacaatggcgatcgcagcggatgctgaaccggccgacgttgtcaccatgctcaatggacaggtcagtatgatgtatgtgcttaattagttaattcgctgcgtaaatccacatgggattgatgtataatcttccgtgaatgatgaattgatgataacttcttgcagattttggatgggcgtcccttgcgagtaaaatttgcagacaaggaccaaaggggatcatctgtatgtgtctagcactgcatgcgctcagtgaacttgcaaattgttaagagctgatcgaggcaacgcaaatggatgatcgatgctgatggttattttcatgtgaaggaggagaggagagtctggaataccaaccttcatttggcaatctcttctatttggaagttcatatgattacattcacacacacacatctatataaatatcctcttctatataaatatatctgcatcgatcttcaggggaaaagaatattacgcggttttgtcatactcacaagttgctatgaattttaagttgcaaatttgtagagtgatatattacgtattaatatattttatcaattttttttaaaaaaatcataactatttgagtggcattgatcttggggggactactacacggttttctcatactcactcatcagaatattgctttctctttagcgaattcgattacgaaattaagaaagttattacattccgggcaggtaattgcgggaaaatagaacaagattctgagctgctggtctagtgctcgccacatgactgtagcatccggctcgtcaggtcaagtcgtcgtcctgcaggccgtctcactttcactgaacgcggattgctttttttcttttcttcctcttctccccgtcaaggcaaatgctacgcttatggcatcatgcaactcggtgatattttaatcatatgttactacatggataccatattttagtattgctcttaactgaattctatgctagataaatcccatgccactacactagccagccaaccacaacaccaaagcatattccactagccatgccacttttcttttctttcaggtatgaactcacgagtcaattaagaagaactccaagaattcgctgcccttcttgcctgccactaccgtttttatacttaattagtacgtggtgcgagagcaagagattacagtagtactactcaattagtcagtgctagcaaaacagctgcactttgtctgaagactgaaagaatgaaaaatgcatcaagcaatcaagcattgtaaaacagcctgagcctagtattttcacggcaaccaccatctactcgtttcagcgtacacagcgacaacccttgcgcgttcttgccatattcttttatctaaaattttaaatcaacagagttgttgctctgaagcttcctgacgaccaatcgctcgccttcgcttcagctgattcgcttccttcgttactgtatataggctcaccatgctactgtgaaacgccttcatcttcgtgctgagctctttcttcacagtcttcttctttcttcgagaatcggcatgttcttttctactttcttgctgctgttctggaccatttattcttggactgtacgcctgaatagagatgagatcggcaacctgaggatcaacaactcctgggattcgcagagatatgataccttggatcaggtcagttgcagcctgtatgagtagttcttgaactgaactttttgcatgatttgccaatttatcatccagttactcagaagtgtattgttgagttatctttgcatgattcatccatgcaggttaaggaagctcttgaaaaggtcggtctcgagtcgtccaatattatcattggagtggatttcaccaaaagcaatgagtggacaggcatatatttttagcttccaagaatcgagatttctcattgttgcagtgttgcctcacgtcatggtttaatcagcgggtggaaattttcagggaaacattgtttcaacgggagaagcctgcatcacatttcagaggactccctcaacccgtacgagcaagcgattagtatcatcggcaagaccttatcgacgttcgacgaagacaacaggatcccatgttttggatttggggacagtaagcaaaagcttctccatcgtcttctagttctttctctctgcaatctgcatttctctgttcagaaatgaagtgattttcagcatcgacgcacgaccaaaatgtcttcagcttctactcgggcaggcgacagtattgcaatggtgtttctgaagttctaaggggatacagagaaattgcgccacgtgtccggctgtcaggtatctatattgtgaccgacgagttcattcttgcgaaggatgaacgatgaattcatctctcttcttcagaaagataactggtgagttgtggtttaggtccgacatctttagctccaataatagaaactgcaatgagaataactcaggactccggctaccagtatcacatcctactgataatagctgatgggcaggtgtgcctttttctctgaacttctgaaaagaagttgccgttcttccagaatcttattgacaccttacctgttccactagtttttttttaatccatgtattttgctcatgctacctcaggttccaagatgttgtggtgctaactctgcgaacaatcgggatgagaactacctggaagaaaggactctacaggctcttgttcaggcgaggtacatagtggcaacactaattagattagatgtttctgaattctatctaaaagtactgactgaacataaggtgcaacttttttccctatattaataaacttcggctggcttccgccagcccggcgaaaaaaaaaacataaggtgcaacttactattcttttaaaatatatagctatacttgaatttgagtaaggaaaatgtgtacttatgctatgcactcatttccctctttctatcgtgcttgtcggagtgggcgatggtccatgggatgagcagctgatgcactgtcaggaggatcgacagctgtttgacaatttccaggtgtttgttgggcatcacaacattgatttatatgggaggatttgctcataattaagctagttttgtcttcgcagtttgttgatttcaccaaaataataatgtcaagagaaatgcctgaaaccgagaaggaggaacaatttgctttagaagcgctgaagaagataccgagccagtacgcagccataatcagcaagaggatcaggtttgtagcatatctgacaggaactgaagatacaaatagctggtttcacctgttgctacctgctaggaatgttcttttggttctgaattctgattcattttcctattgtgttgtggtgttcagtgatctggctgcagatgcgccttcaaggatgcctcttcctccccctcctccaaggcctgnnnnnnnnnnnnnnnnnnnnnnnnnnnnnnnnnnnnnnnnnnnnnnnnnnnnnnnnnnnnnnnnnnnnnnnnnnnnnnncatctatcatgtctatcaatgcacca

SEQ ID NO: 10054 - DNA, 2280 bp, Oryza sativa
  unsure (1)..(2280): unsure at all n locations
ccattctccgcgctctttcatatgcaaaactaaaatgacccactgaacttcagttcagtacttcagtggactcctgtgcaaatgcacttcttttatttttcatttacctgcttggtcacttgctctgttgaaacttattataatttttaatctagctggctcatctgtgtggtaggctggtaggatactagtgtttacaagaactgtccctgttttactgttaggctgcggattacagttatttttgtgtttcacatttaaaacctgcaagatgggcagctgtggcttatttatctctgtgggcatcctacttgtgttatgaaagatgcctttgatatttaccttcccgtctttagggtattcatttatttattatgtgaaccgtatagaggcagttagacaaaatattaggatatgcatggttttgttcttttgatcagaaatgaacctctattttcgcgtgttcaggtcatctacaacagagaaacagatcggagtcgtggatttggatttgtcaccatgagcaccgttgaggaggctgagaaggctgtggagatgttccatcgctacgtgagtctctctctatctaaattgccctatttcccctcaacattttcttcattttgttgaagctcaagataacctgatttcctatgttagttacagctcatgttcattgtgtacacagtaatttctgtacttgcagtatgcatgtaactggcttcaaacagtttgcatttgttttccttatttcaactatggcattgtggtattggcgtttcattctgaatgatcatggatggacatgatagtttctcttagtttctcattcaagggtacactataatgtttaagtgaaaaagaaagggagggtcatattaggcatatgtcatccttattgactgatatgactatgaggaataacaattctaaagttgtaagagctgtgatttctatgtttaactttctttgacagacctcttaaaacttgttcttctgttgctactaaatttttaaaagtatggtagtatgatgtaaagaatgtacagatttcatgctttgatgataaacctttttaatgtggataggatgttgatgggaggcttctgactgtaaacaaggcagctcctagaggcgctcgggtggaaagacctccccgtcagtttgggccttctttcaggatttatgtgggcaatctcccttggcaagtggatgactctaggttggtacagctgttcagcgagcatggcaaagtagtcgacgccagagttgtgtatgacagagaaactgggcgttcacgaggatttggttttgtaacaatggcgacacaggaagaattggacgacgctattgcagccctcgatggacaggtaagtgtatattcgattcactgacatctttacaactgggattaagcaaccactggtaatcattgttacatggaggctgtgaactgatgctaattgactcataccatcaataacttttgtgtcttttaactttgcttacccaagtaacacacttttccaatctgaattcaacagagtttggatggccgtgcgctgagagtgaatgttgcagaggagcgaccaccgcgccgaggcttttaatgggatagcaggctttgtgggggtttaacagcatcggaggcatcatagcacgtctgatactggtttagtccctcaaatagtagctttcttgcgattcttggttctgtatcctcccaagtcctttctcatgcctgctgtttactgctcctttcttgttaactgttggttgtggccacgagttgatgcacgtaggctactgttatgatgcccctctaccccaatttgtcgatgcatccaaaagttttgtctaacatttatctatttaagcaaaagaagagcatggtgtgtgtggcatttgtgctgtttctcttgcggaaactgcttattggatcaggcttgttcacccgccttaattattccttttgggttttgtttgcacctttgcattgttttttctaatcgtgtcgtattaggtttcatcaggctatgctgtattatctgaggaaacgatcatatcatacgttggtttccgttgcatgtagggtagtacgtcctcgttaattacgtttttgcatacatacatcatacagggcagtccaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10055 - DNA, 2102 bp, Oryza sativa
  unsure (1)..(2102): unsure at all n locations
tggggcctnnntttgatagtactatcttnnnnnnnnnnnnnnnnnnnnnnnnnnnnnnnnnnnngcatcctccgccccggcgacacggcatggacgacggtagagtcgaaggggatgaattactccgccttggggtacggctgctgcaccacgtatcaccaaggcggcgtcgtgttcgccgacctgtaccagacgttcgtcgccagggtgctcgtcgacgacgccggcggcggcggccgagtagtggaatccaggacaagaagatggccgcctgattatggcttcctgtacaagcggctgctatcgacgtacaccttcgagtttcggggcaagctgatgtccgcctgcgtcgagattccatggcagagcagcgcctaccagatcgacgccgccgcgctgtcggtgtccctgtacacgctggggacggcggcggcggccggcgacggcgacgagctggcgcatctgtgggtgagggcggcggacggcgggaggctgctgggtgagcacgcgctgttcctggggtgcccgaccagcttcgccgtcgacgccgccaggttcggcgccggcggcgaggtgagcggcggatgcgcctactttgtcatttggacaatgccggatgtgtgccacgtgtacaagtactccttccacgacgatgcggcgacgccaatggcagagctgccattcgaatggaccttcatgatcaagagaacactgtggttcctgccccagtattccagcgtagccccaactccaacccaagtaacttatactcctaactatttccttcctcccttccgcaatcccaccctaaaattttttaacatgtcacatcgaacgtttgaacacctgtataaaatattaaatataggctaaaaaaaaactaattacgcagattgcgactaatttgccagacgaatcttttaagcctaaatgctccatgatttaacaatgtcgtgtttacaatgtcatgttacagtaaacatttgccaatgacagattaattaggcttaataaattcatctcacggttttactgacggattctgtaattagtttttttttattagtgtccgaacatcccatgcgacaccatatataatatccgatgtgacacgccacaactttacacccctagatctaaacaccccttaggacttgtttagttcccaaattttttttcccaaaaacgtcacatcgaatctttggacacatgcgcgaagtactaaacatagataaaaagaaaaactaattgcacagtttgtatggaaatcgcataacgaatcttttgagcctaattagtccatgattagccataagtactacagtaaccccacatgtgctaatgataaattaattaggcttaataaattcgtctcgtggtttataggcgagctatgaaattagttttttttcattcgtgtccgaaaatgtcttccgacatccggtaaaccatgcgatgtgacacccaaaaattttcttttcacgaactaaacagggccttagttttgtttttgtccaaatggctgtgtacatctggtttgaataggagagggccgtgttcttaattatttttagaaaagaaatcattttttctaagtcaattttgttaaacattgaccgatcgagtttatgacagcatgcaccaacatctacaagatcagaataattttattattaaattacccatcaaagatattttgttaatgatatatattgttataggtgttgggtatattttccataaacccggtaaacgttagataagtttaacttaagataaagctaaaataatttactatattaaacggagggagtacccatctttctaataacaaacgtgcaaattcttaacttgtttaggtcactaaaattgctttgaattttagttacctttaacctagctttggatttgggagaaataggagggggtgactcaccgatgacaactactttcatgcggtggtgactagatggcgagctcttcttcggcaactatgtggcggtaggaaggttagagtttggaggttttgggtaggnnnnnnnnnnnnnnnnnnnnnnnnnnnnnnnnnnnnnnnnnnngtaatgcaattcaaangggcgcac

SEQ ID NO: 10056 - DNA, 2029 bp, Oryza sativa
  unsure (1)..(2029): unsure at all n locations
ggagtgttttggattttgagattcgagctctgtacccaattgtgcatttgtgccccttttttttttgcttgctgtaacctgaaatcgctgttgatgagttagaagtgactgcggtaaagaaaatgccatgcccaccttcacattatctatgctttgttgcttcacccttggtccatggatttcgatcagggggcggttgcctgccacttgtttggaatttacaggtcacctgtgcatgaatttgtgttatttgttttatggtgaaacaaataaacttgaaaaagatttctgctaatgctgatgcaccattgggttttaattcttcgtgtatgtctgcatcttgctgcagaaggatgtcagaattgggaactgttttgggaccatgctactatgctttgacattgttgttttctcagtttcacaatgtgatgaggttaacgtgcttatttattttctatatctacagggcatgggatcaccatgatattatttcagttaaaccagagtacaatgacagcagcagatgctcaactagtgctcgtttggcatcaattgctccttacagtggcaggaaggaaacttctgtctatgccactgatattattagtggaatcacaatacattgcaaagtttttgttgacagaatctctcggatcaggattttccatcatgctgtaaaaattgacctagatgaagttgccaccttgcgtgttcatgcctttgatgatgaaggtaattcgtatagccttccatgtttgcaaagagctattttccatagtttatttctttaaggttctcagaatatggatgagctcttgttatagaaaattccattaggcctcccacctccactaactcgtacttgttactttgatactgcttgaatatgtcaatctagctcgtgctatgcttatggaccatcactgttcttactgtttgccgtaaacttccacatattcatgaatttcaatgtgcacaaattggaattcctgattccatcacctgtccgttacctttttcttacgttggttctcaactgtaacctattctattcttggtctagaaactttctactgaaacaatcaatagcatagtttctctagtctctagtacttcattgggtcagctattctaatagctgtagaatcctcttctcttgttgtaacttagtttgtttccttttggttcagacaatgtgttctcatcattggtggggttacaattcctgtggcagcttaccccgaggtgggttgatactaatagccatcatctggttcatattccattgaaagaaacacatttaagtgactgcagtggcttttgtggtgatatgaatatacgatttgagcttgaagacagggtatgtatatctgttattaaatatggcctcatttttcattaactttaccgataagcagttacatgaaaatgcatactcttttatgatacctctcgcagaatcttggttcagatttatttgtggtcaagggcattgagattggccaagaggttgttaatgcccagttatttgaacctcagtttgaacatgtgaatgatacaatcactttaactgttgctgaagctatgtcactagagcccccttcaccagtccttgtgaccgtcggtgctatggtaaagttcaaactcaaggtttttcgacaaaaagttccccaaggtacttcaaacaaattgagtcttgttcataagacattctctaagtatagaaaccaaactttagccagagttcatgcaacagaaagttaaacttcagcttcaggtgacccatgtcatatattgaagcaatataaaaaaagagaagcacaactagcaaattatgctatgctttacagtgaaacggtttagaaaaaccatatggagttcttatttgttattctcactattagaatctatctacctgcaattcctttatttcagcctgcagctgaaagctaacaaatcctctnnnnnnnnnnnnnnnnnnnnnnnnnnnnnnnnnnnnnnnnnnnnnnnnnnnnaaaannnagcccac

SEQ ID NO: 10057 - DNA, 597 bp, Oryza sativa
  unsure (1)..(597): unsure at all n locations
gatgcggttttgggacctgtctactctcgctcggtacccatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcatgcggcgatgtggaaaaagaactctatattttgggagttaccatattaggaattcttggacgtacgccacgcaatcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10058 - DNA, 652 bp, Oryza sativa
  unsure (1)..(652): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgcctactttgtcatttggacaatgccggatgtgtgccacgtgtacaagtactccttccacgacgatgcggcgacgccaatggcagagctgccattcgaatggaccttcatgatcaagagaacactgtggttcctgccccagtattccagcgtagccccaactccaacccaagtaacttatactcctaactatttccttcctcccttccgcaatcccaccctaaaattttttaacatgtcacatcgaacgtttgaacacctgtataaaatattaaatataggctaaaaaaaaactaattacgcagattgcgactaatttgccagacgaatcttttaagcctaaatgctccatgatttaacaatgtcgtgtttacaatgtcatgttacagtaaacatttgccaatgacagattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10059 - DNA, 885 bp, Oryza sativa
  unsure (1)..(885): unsure at all n locations
tggggcggnnnnttttgtgtagnnnnnnnnnnnnnnnnnnnnnnnnnnnnnnnnnnnnnnnnnnnnnnnnnacctaacaaacagatggtggaaacaaaaactgcatcatggcttgtgctttcatggaaatagcacatcacctaggttgattgtttcgctatggaattctattagagggaaatgatagaaatgagagctactatttagttgtcattgagccaggattttttattttgctggctgcaggtatagagggtagcctaaagcgacaaggggtttgttgaccgcaccctcacacaagaagcagacccatatgatgcatatgtctcctccctcttggaaaggtggagatcaacagaattctgtgggaggtgaagttgattacatggattttggatgaggaggggcatggctaaggggagagcattttcatgtagtattgctgttgtgttagacttcttattgcttgattatctactgttttgtcagttctatttacgagggggtattgctggtactttgtaccgaggatgactatctaagcacaaaatcttaagagtgtagtttatgcctctgtttatttcttatcaatgtagcgaggttgtaaaccgtatggtcctctcgctggtgtcaaattgctcacaatgtgagcctcctggtagcattgggcgtcttaagtccgattaatctggaagctgattacatggattttggatgaggaggggcatggttaatggttagagcatgcatgatgcaaatgtctggaactctgggagcagtacaacccgatgaaaaagaatattaaacttgtctagctcttcaagtattgaggatttagtacttgttaatttcaggtacaagtagcagagtgtctctctctattgn

SEQ ID NO: 10060 - DNA, 1853 bp, Oryza sativa
  unsure (1)..(1853): unsure at all n locations
ataaaaanaaagtccgattgctataagaaaggaaaaaagaaagttcgactctagatctaaatcacccttaaaaacgaaaaataaaattgatgtgccggattaaagatctgtttgcaaaaacgaaacctaccggtcgagagcattccatttttatatgattttaatttttggatctatacttttgcatttgagtccctgtaatttttatatttacatttgagtccatataagtttgaaataaggtattaaggtcgtttttgattaaaaaataataaaaggggaagaataaagacagaaaggtgcataaaaagaaaaagaaaaaccgcacaataaaagaaaataaagaaaaagaaagaaaaacaacaacaacaacaaaagtccgtttctcctaagtggcaaaaaaaaaccgtagatccgattcctataaaaggcaaaaaaaaagtggtgaaaaaaatgctagatctaattcctttaaaaaggaaaaaaaaaggtctaattgctataaagatgaaaaaaatcccaaaaaacatctaaaaaagttcgtccgattctctaagaagaaaaaatggttcgtaaaaaataaaaagctggttcatataaaataaataatgcgcgcgagaaaaaaaatgaaaagggcgaaccaaattccgatttctaatcttcgttatgtctaatctaatctaactatttaaaaagagaaaatgcatgacaataaaaacagttcaaagaaacgtgtgagaaaagttagaaaaaagcgcaaaaaaaacacgctaaaaaggttttccatcttccgtaaaaaaaataaaaaaccgcgtgacaataattatttccatcgtcggtaaaaaaattacttaaaaaaaagggaggaaaaaactgtcagaaaaaacacgccatttctaaaaaatggtttaaaaaaaccgtgcaagaaaaaaacatcgtcgattaaaaaataaatcgctctgaaaaatctgtcagaaaaaaaagctaaattgatggacgcttgagccggataggatccatcgattttttgtcatctactacacggttttatttcatcagaaatttgttttaaaaaaaaacatgcgaggaaaaaacgcaccatttctaaaaaatggtttgaaaaaaccgtgcaagaaaaaaatcttctattaaaaacaaattgctctgaaaaatctgtcgaaaaaacgctaaattgatggacgcttgagccggataggatccatcggttttttttgtcatctattacacggtttttatttcgtcatatattctcctgtattggaaaaaaacaaaaaagaacattcgaaaaaaaagtaaaaaacgcacgagaaaataattgttagaaaaaacatgcaaaaaaacacacgagaaaagaaaagcaaaaaagggagaaaaatatggttttcgtcgtcagtaaaaaaacaaaaagaacatgctaggaaaaaactgttagaaagaaatgtgccatttttaaaaaatggtttgagaaaatcgcgcaagaaaaaaaatcgtttatagaaaaacaagtcgttcgttaaaatacaaacattgtcattgacatgattatgtatgaaaaaaatatattatcattagaatttttcacccgttgcaacgcacgggcatttttgctaatatatatatatatatatatatatatatatatatatatatatatatatacacacacacacacacacacacgtgtgttggtagatcagattagattagataggaaaagattgataaattcacattcacccacagggtaagtactccctccgtttggttttatttgacaccgatgactttttagcacatgtttgncctcncacgttatataaacaaccatatcc

SEQ ID NO: 10061 - DNA, 1376 bp, Oryza sativa
  unsure (1)..(1376): unsure at all n locations
agaaccacttacggctaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaatcttgagaggaccatagtcaagttcccatatgtcctcgatggcaccgtaatacgtggcagttgttccatcgtgtcccatggcatcgacacgaacagcgctgttttggttcgtgctcttcgtcttgggctctcgtgtagaatgtgtacccattgatctcatatccctggaatgtcgtgatcgacccagacggtcccctcgccaggaaggcaagttgttggttgatcaactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccatagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatcgcgctgacccttgatgatgtggctagcttatgatacctcggatggaggttagcaccaaaaatagtggcgctgagatgttggatctcaacgccacttccgatggcactgagttcgtggttcattttttaaataagtttttgacacggtttattcttgtaataagtttttgtaaagggtcaaattgttaaaaattgtgccttggattactcattgtacttatgtgattggatgtttatattaaaaaggtgtctctcaacctggtacttcaaaattaaacaaacgtggatgctcatggataggcatctcattgtcaacttcccctacctcttgagggatgtctgccgtggggtgccgagatagataatcaaannnnnnncgaca

SEQ ID NO: 10062 - DNA, 891 bp, Oryza sativa
  unsure (1)..(891): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggaacgaccaccgggttcgccagccactccggatagatgacctcacggataaatccggcctccagaagtctcgcgacctcctcgcggatgaaggcttgacgttccggggcctggcgccgcactttctgccggaccggccttgcgcccgaccgcacggcgagacggtgctcaatcaccgatctcaaactatccataatattagcaaatgaaggtctccgccatggctcactgtaacagacaaaattgccgttagtctcgcatgtcattgcgaattgattcatatacaaaaatagatgggtcaatgcatactttgcccagcacgactcaattaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10063 - DNA, 690 bp, Oryza sativa
  unsure (1)..(690): unsure at all n locations
tggtccattgaaatcgttatcgatctcggnacccataatggggatagaaacagaagctaataattacccatggacgaaattggtggtgccatctagggggtcgacgatccacgtcgggtcgtcggtgaggtccgcggtggcgccgagcgccgcggacgtctcctcgccgatgaacttgtggtccgggtagtgcttccggaggtggttgaagatgaggtcctcgcaggccttgtccgtctccgtcaccaaatccacctgcagttgcaatgcagccacggtcaccaagaaaccccaaattccaatccagggcaaaccaaactccatcagctatggggaaaaggaatgcgatgagatcggtggaaccgtggaagaaggaagagagacctggcccttgtgctccacgttcttggtctggtaaaagcccttgcggatgatctgcggagaagcaccaggaaatcaagaacgggcaaggaaaaagaaaaacacgaggaatcgtgcacagggaggagggggcaagggaggaatcgagtggttcaggagagggcatacccttgccggcggtctttgggggcgttcacccggacggcgaggaactgcttcttcgtcatacccgcttacttccaatctattcccccgccgggggaattagaaagaagaaattggttgggtcttttgcaacgcttcaccttt

SEQ ID NO: 10064 - DNA, 684 bp, Oryza sativa
  unsure (1)..(684): unsure at all n locations
tgctcccccatganatcgatatcgatctcggnacccgcaaggcgattacgccgtggacgagacgagtgagaggaggagagcggccatggcggggcggagtggcgccggcggcggcgggagctccgggaagagcgggacggggaggatggtgtcgctgcaggagttcgtctcgtccatggcgcctctcatagacctggagaaggttccgtactccgatcccccatcgcttttctttcgctgtttggttcggaaggtggaacggatggtagtggtggtgggtggtgacgcgtctgtggtgtggttgcgcaggcggcggagatatcggcggagtcggcgacgagctcgaagaccctcgagaggaggggttgcgtcatggccaacctcaagtgcaccgacgcccaggttgatttgcttccattttgctgcttgcttgcttgcccatcggtgccaatgtgtcatcgaggcgtggtgctaatcttgttctggccttgttggacctgcttggtgcgtagagtagacggggctgatggggaagacgctcctggagttccaacccaacaagggcgacgtgcttccacctcacaaggtgaggttacctttgccctcctgtcgtattgttgttattgctcgctgtgataaaatctgggtaagaaattattttggggattttaaaagcggtttttn

SEQ ID NO: 10065 - DNA, 1004 bp, Oryza sativa
  unsure (1)..(1004): unsure at all n locations
agaggatttgaatgcaaatcccactccgcccagcacttngagtacatgttctacatcgacttccaggcgtccatggcggaggtcagggcgcataacgcgctgtcggagatacaggagttcacctccttcctccgggtgctcggcagctaccccatggacatgacgccatgggagtattcctcctcatcgtcaccatcaccggcgcccggcggcgacaccagcagataatgctgatcgatcgacaagactgatgctcaaattctgttagtgactaattgcttctttctcttctttttttttctgtcaaattagagaaaggggaggaagactctcttcctcatgtttactttcggttgcggatgatactctgattaattagtcaaagttatgctcggtgaggatcggagtagatgagatgccatagcggagaggggagacagcgatcccatctcattaccagaaatgaatttttgtactctgaacattagaaaaaagggaatgaattaggataactgatggttcaactggagtactagctggcaaatgaatcaattgatgatttgctgttctttgatcttccagccagacataagaaggaaacttgatttttcaaatttggtttacaaacagtccattactctggccgaccccggtttagtctccgtattactccactattagcgtacctgactcggactcgtagtcggattcaattctacttccgccggccgcctggctccatataactcccaagtcccaaccgtcaatctcagctcatcgcaacaaatcgatctgcagagataggatagttgttttcaggtcgatcttgccgtcctctttttcgtgtcaaagccgncggattgcaatttaattacatcttggaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10066 - DNA, 949 bp, Oryza sativa
  unsure (1)..(949): unsure at all n locations
cacctggctttgattgatctncttcgtctgcaagtagttcatcacgcgacagtatggaatgcagatggagaattctgtgcaaattaaaaccttgataactttgccttctggtcatggaatcgagctaggttttttttgacggtttcagaaccacgggcctgacagaagagagactggatttggagagttggacccccagagatttttctagaaattacttaccattggccacgaagcagcggttgtttcggcgaaacgtcgaatatctgagggtccacaactggttctcaacgaggtggttagtatagggatggcacataggacgttagggtgtataggatcgacgatgtcggtgtcaagcgcgtcgactaaccgcgccgttaagttaagctggcgggcgcgacactgtggaatgcagatggagaattctgtgcaaattaaaaccttgataactttgccttccggtcatggaatcgagctaggtttttttttacggctgcagaatcacgggcctcaccatagagagactggatttggagagttggacccccagagatttttctagaaattacttaccataggccacgaagcagcggttgcttcggcgaaacgtcgaatatctgagggtccacaactggttttcaacgaggtggttagtatagggaaggcacataggacgttaaggtggatagcttagacgatgtcggtgtcaagcgcgtcgactaaccgcgccgttaaggtaggctggcgggcgcgacactggaatgcagatggagaattctgtgcaaattaaccccttgataactttgccttccggtcatggaatcgagctaggtttttttttacggctgcagaatcacaggcctcaccctagagagcctggatttggagagttggacccctgatgaactnctgtaccagtgatagcgatcaacaaannnncccaccg

SEQ ID NO: 10067 - DNA, 897 bp, Oryza sativa
  unsure (1)..(897): unsure at all n locations
aaccgctgcttcttgccctatggtnggtanttcaaagaaaaatctctgggggtccaactctcgaaatccagtctctcttgggtgaggcccgtgattctgaagccgtcaaaaaaaacctagctcgattccatgaccggaaggcaaagttatcaaggttttaatttgcacagaattctccatctgcattccacagtgtcgcacccgccagcctaacttaacggcgcggttagtcgacgtgcttgacaccgacatcgtctaagctatcgaccctaacgtcctatgtgccatctctatactaaccaccgcgttgaaaaccagttgtggagcctcagatattcgacgtttcgccgaataaacagctgcttcctggcctatggtaagtaatttctagaaaaatctctgggggtccaactctcaaaatctagtctctcttgggtgaggcccgtgattctgcggccatcaaaaaaaacctagctcgattcaatgaccggaaggcaaagttatcaaggttttaatttgcacagaattctccatctgcattccacagtgtcgcgcccgccagcctaccttaacggcgcggttagtcgacgcgcttgacaccgacatcgtctatgctatccaccctaacgtcctatgtgccatctctatactaaccacctcgttgaaaacccgttgtggaccctcagatattcgacatttcgccaaataaaccgctgcttcctcgcctatggtaagtaatttctagaaaaatcaatgggggtccaactctcaaaatctagtctctctagggtgaggcccgtgaatctgcagccgtcaaaaaaaacctagctcgattacatgaccggaaggcaaagttatcaaggtttaatttgcacagaattctccatctggattcan

SEQ ID NO: 10068 - DNA, 21717 bp, Oryza sativa
  unsure (1)..(21717): unsure at all n locations
tttcaggaaaatctctgggggtccactctaaaaatcagtttctctttggtgaggccggtgattctgaagccgtcaaaaaaccntagctcgatcccatgaccggaaggcaaagttatcaaggttttattttgcacagatttctccatctgcattccacagtgtcgcacccgccagcctaacttaacggcgcggttagtcgacgtgcttgacaccgacatcgtttaagctatcgaccctaacgtcctatgtgccatctctatactaaccaccgcgttgaaaaccagttgtggagcctcagatattcgacgtttcgccgaataaacagctgcttcttggcttatggtaagtaatttctagaaaaatctctgggggtccaactctcaaaatctagtctctcttgggtgaggcccgagattctgcggccataaaaaaaaacctagctcgattcaatgaccggaaggcaaagttatcaaggtttaaatttgcacagaattctccatctgcattccacagtgtcgcgcccgccagcctaccttaacggcgcggttagtcgacgcgcttgacaccgacatcgtctatgctatccaccctaacgtcctatgtgccatctctatactaaccacctcgttgaaaacccgttgtggaccctcagatattcgacatttcgccaaataaaccgctgcttcctcgcctatggtaagtaatttctagaaaagtcaatgggggtcgaactctcaaaatctagtctctctagggtgaggcccgtgaatctgcagccgtcaaaaaaaacctagctcgattacatgaccggaaggcaaagttatcaaggttttaatttgcacagaattctccatctgcattccacagagtcacgcccgccagcctaccttaacggcgcggttagtcgacgcgcttgacaacgacatcgtctatgctatccaccctaacgtcctatgtgccatctctatactaaccacctcgttgaaaacccgttgtggaccctcagatggagaattctccatctgcattccacagtgtcgcgcccgccagcttaacttaacggcgcggttagtcgacgcgcttgacaccgacatcgtcgatcctatacaccctaacgtcctatgtgccatccctatactaaccacctcgttgagaaccagttgtggaccctcagatattcgacgtttcgccgaaacaaccgctgcttcgtggcctatggtaagtaatttctagaaaaatctctgggggtccaactctccaaatccagtctctcttctgtcaggcccgtggttctgaagccgtcaaaaaaaacctagctcgattccatgaccagaaggcaaagttatcaaggttttaatttgcatagaattctccatctgcattccacactgtcgcgcccgccagcctaacttaacggcgcggttagtcgatgcgcttaacaccgacatcgtctaagcagtccaccctaacatcctatgtgccatccctatactaaccacctcgttgaaaaccagttgtggaccttcagatattcgacgtttcgccgaaacaaccgctgcttcgtggccaatggtaagtcatttctagaaaaatctctggggtccaactctccaaatccagtctctctagggtgaggcctgtgattctgcagccgtaaaaaaaaacctagctcgattccatgaccggaaggcaaagttatcaaggttttaatttgcacagaattctccatctgcattccacagtgtcgcgcccgccagcctaccttaacggcgcggttagtcgacgcgcttgacaccgacatcgtctaagctatccaccttaacgtcctatgtgccatccctatactaaccacctcgttgaaaacccgttgtggaccctgagatattcgacgttttaccgaataaacggctgcttcctggcctatggtaagtaatttctagaaaaatctctgggggtccaactctccaaatccagtctctctatggtgaggcccgtgattctgcagccgtaaaaaaaaacctagcttgattctatgaccggaaggcaaagttattaaggttttaatttgcaaagaattctccatctgcattccacagtgtcgcgcccgccagcctaccttaacggcgcggttagttgacgcgcttgacaccgacatcgtctaagctatccaccctaacgtcctatgtgccatccctatactaaccacctcgttgaaaacaagttgtggaccctcagatattcgacgtttcgccgaaacaaccgctgcttcgtggcctatggtaagtaatttcaagaaaaatctctgggggtccaactctcgaaatccagtctctcttgggtgaggcccgtgattctgaagccgtcaaaaaaaacctagctcgattccatgaccggaaggcaaagttatcaaggttttaatttgcacagaattctccatctgcattccacagtgtcgcacccgccagcctaacttaacggcgcggttagtcgacgtgcttgacaccgacatcgtctaagctatccaccctaacgtcctatgtgccatctctatactaaccaccgcgttgaaaaccagttgtggagcctcagatattcgacgtttcgccgaataaacagctgcttcctggcctatggtaagtaatttctagaaaaatctctgggggtccaactctcaaaatctagtctctcttgggtgaggcccgtgattctgcggccatcaaaaaaaacctagctcgattcaatgaccggaaggcaaagttatcaaggttttaatttgcacagaattctccatctgcattccacagtgtcgcgcccgccagcctaccttaacggcgtggttagtcgacgcgcttgacaacgacatcgtctgtgctatccaccctaacgtcctatgtgccatctctatactaaccacctcgttgaaaacccgttgtggaccctcagatattcgacgtttcgccgaataaaccgctgcttcctggcctatggtaagtaatttctagaaaaaactctgggggtccaactctcaaaatctagtctctctagggtgaggcccgtgattaagcagccgtcaaaaaaaacctagctcgattccatgaccggaaggcaaagttatcaaggttttaatttgcacagaattctccatttgcattccagtgtcgcgcccgccagcctaccttaacggcgcggttagtcgacgcgcttgacaccgacatcgtctaagctatccaccttaacgtcctatgtgccttccctatactaaccacctcgttgaaaaccagttgtggaccctcagatattcgacgtttcgccgaagcaaccgctgcttcgtggcctatggtaagtaatttctagaaaaatctctgggggtccaactctccaaatccagtctctctatggtgaggcccgtgattctgcagccgtaaaaaaaaacctagctcgattccatgaccggaaggcaaagttatcaaggttttaatttgcacagaattctccatctgcattccacagtgtcgcgcccgccagcttaacttaacggcgcggttagtcgacgcgcttgacaccgacatcgtcgatcctatacaccctaacgtcctatgtgccatccctatactaaccacctcgttgagaaccagttgtggaccctcagatattcgacgtttcgccgaaacaaccgctgcttcgtggcctatggtaagtaatttctagaaaaatctctgggggtccaactctccaaatccagtctctcttctgtcaggcccgtggttctgaagccgtcaaaaaaaacctagctcgattccatgaccagaaggcaaagttatcaaggttttaatttgcacagaattctccatctgcattccatactgtcgcgcccgccagcctaacttaacggcgcggttagtcgatgcgcttaacaccgacatcgtctaagcaatccaccctaacatcctatgtgccatccctatactaaccacctcgttgaaaaccagttgtggaccttcagatattcgacgtttcgccgaaacaaccgctgcttcgtggccaatggtaagtcatttctagaaaaatctctggggtccaactctccaaatccagtctctctagggtgaggcctgtgattctgcagccgtaaaaaaaaacctagctcgattccatgaccggaaggcaaagttatcaaggttttaatttgcacagaattctccatctgcattccacactgtcgcgcccgccagcctaacttaacggcgcggttagtcgatgtgcttgacaccgacatcgtctaagctatacaccctaacgtcctatgtgccatcccaatactaaacacctcgttgaaaaccagttgtggaccctcagatattcgacgtttcgccgaaacaaccgctgcttcgtggcctatggtaagtaatttctagaaaaatctctgggggtccaactctccaaatccagtctctccatggtgaggcccgtgggtctgaagccatcaaaaaaaacctagctcgattccatgaccggaaggcatagttatcaacgttttaatttgcaaagaattctccatctgcattccacagtgtcgcgcccgccagcctaacttaacggcgcggttagtcgacgcgcttgacaccgacatcgtctaagctatccaccctaacgtcctatgtgccatccgaatactaaacacctcgttgaaaaccagttgtggaccctcagatattcgacgtttcgcccaaacaaccgctgcttcgtggcctatggtaagtaattgctagaaaaatctctgggggtccaactctccaaatccagtctctcttcggtgaggcccgtgattctacagccatcaaaaaaaacctagctcgattccatgaccggaaggcaatgttatcaaggttttaatttgcacagaattctccatctgcattccacactgtcgcgcccgccagcataccttaacggcgcggttagtcgacgcgcttgacaccgacatcgtctaacctatacaccctaacgtcctatgtgccatccctatactaaccacctcgttgaaaaccagttgtggaccgtcagatattcaatgtttcgtcgtaccgaccgctgcttcgtggcctatggtaagtcatttctagaaaaatctctaggggtccacctctccaaatacagtctctcaagggtgaagcccgtgattctgcagccgtaaaaaaaaacctagctcgattcaatgaccggaaggcaaagttatcaaggttttaatttgcacagaattctccatctgcattccatagtgtcgcgcccgccagcctaccttaacagcacggttagtcgacgcgcttgacaccgacatcgtctaagctatccatcctaacgtcctatgtgccatccctatactaaccacctcgttgaaaaccagttgtggaccctcagatattcgacgtttcgtcgaaacaaccgctgcttcgtggcctatggtaagtaatttatagaaaaatctctgggggtccaactctcaaaatctagtctctctagggtgaggcccgtgaatctgcagccgtcaaaaaaaacctagctcgattccatgaccggaaggcaaagttatcaaggttttaatttgcacagaattatccatctgcattccacagtgtcgcgcccgccagcctaccttaactgcgcggttagtcgacgcgcttgacaccgacatcgtctaagctatccaccctagcgtcctatgtgccatccctatactaaccacctcgttgaaaaccagttgtggacgctcagatattcgacgtttcaccgaaacaaccgctgcttcgtttcctatggtaagtaatttcttgaaaaatctctgggggtccaactctccaaatccagtttctctagggtgaggcccgtgattctgaagccgtcaaaaaaaacctagctcgattccatgaccggaaggcaaagttatcaaggttttaatttgcatagaattctccatctgcattccacagtgtcgcacccgccagcctaccttaacggcgcggttagtcgacgcgcttgacaccaacatcgtctaagttatcctccctaatgtcctatgtgccatccctatactgaccacctcgttgaaaaccagttgtggaccctcagatattcgacgtttcgccgaaacaaccgctgcttcgtggcctatggtaagtaatttctagaaaaatctctggggtccaactctccaaatccagtctctctagggcgaggcccgtgattctgcagccatcataaaaaacctagctcgattgcatgaccggaaggaaaagttatcaaggtttaatttgcacagaattctccatctgcattccacagtgtcacgcccgccagcctaccttaacggcgcggttagtcgacgcgcttgtcaccgacatcgtctaagctatccaccctaacgtcctatgtgccatccatatactgaccacctcgttgaaaaccagttgtggaccctcagatattcgacgtttcgccgaaacaaccgctgcttcgtggcctatggtaagtaatttctagaaaaatctctgggggtccaactctccaaatccagtctcgctagggtgaggcccgtgattctgcagccgtcaaaaaaagcctagctcgattccatgaccggaaggcaaagttatcaaggttttaatttgcacagaattctccatctgcattccacagtgtcgcgcccgccggcctaacttaacggcgcggttagtcgacgcgctagacaccgacattgtctaagctattcaccctaatgtcctatgtgccatccctatactaaccacctcgttgaaaaccagttgttgaccctcagatattcgaagttccgccgaaacaacggctgcttcgtggcctatggtaagtcatttctagaaaaatctcagggggtccacctctgcaaatacagtatcttaagggtgaggcccatgattctgcagccgtaaaaaaaaacctagctcgattccatgaccggaaggcaaagttatcaaggttttaatttgcacagaattctccatctgcattccacagtgtcgcgcccgccagcctaccttaacggcgcggttagtcgacgcgcttgacaccaacatcgtctaagatatccaccctaatgtcctatgtgccatccctatactaaccacctcgttgaaaaccagttgtggaccctcagatattcgacgtttcgccgaaacaaccgctgcttcgtggcctatggtaagtaatttctagaaaaatctctgggggtccaactctccaaatccagtatctctagggtgaggcccgtgattctgcagccgtcaaaaaaaacaaagctcgattccatgaccggaaggcaaagttatcaaggttttaatttgcacagaattctccatctgcattccacagtgtcgcgcccgccagcctaccttaacggcgcggttagtcgatgcgtttgacaccgacatcgtctaagctatccactctaatgtcctatgtgccattcctatactaaccacctcgttgaaaaccagttgtggatcctcagatattcgatgtttcgccgaaacaaccgctgcttcgtggcctatggtaagtcatttgtagaaaaatttctgcggctccacctctccaaatccagtctctctagggtgaggcctgtgattctgcagccgtcaaaaaaaacctagctagattccatgaccggaatgtaacgttatcaaggttttaatttgcacagaattctccatctgcattccacagtgtcgcgcccgccagcctaccttaacgacgcggttagtcgacgcgcttgacaccgacatcgtctatgctatccaccctaatgtcctatgtgccgtccatatactaaccacctcgttgaaaaccagttgtggaccctcagatattcgacgtttcgccgaaacaaccgctgcttcgtggcctatggtaagtaatttctagaaaaatctctgggggtccaactctccaaatctagtatctctagggtgaggcccgtgattctgcagccgtcaaaaaaaacaaagctcgattccatgaccggaaggcaaagttatcaaggttttaatttgcacagaattctccatctgcattccacagtgtcgtgcccgcctgcctacgttaacgacgcggttagtcgacgcgcttgacaccgacatcgtctatgctatccaccctaatgtcctatgtgccatccctatactaaccacctcgttgaaaaccagttgtggaccctcagatattcgacgtttcgccgaaacaaccgctgcttcatggcctatggtaagtaatttctagaaaaatctctggggttccaactctccaaatctagtctctctagggtgaggcccgtgattctgcagccataaaaaaaaacctagctcgattccatgaccgaaaggcaaagttatcaaggttttaatttgcacagaattctccatctgcattccacagtgtcgcgcccgccagcctaccttaacggcgcggttagtcgacgggcttgacaccgacatcgtctaagctatccaccctaacgtcctatgtgccatccctatactaaccaccttgttgaaaactagttgtggaccctcagatattcgatgtttcgccgaaccaactgttgcttcgtggcctatggtaggtcatttctagaaaaatctctagtgttccacctctccaaatacagtctctcaagggtgaggtccgtgattctgcagccgtcaaaaaaaacctagctcgattccataaccggaaggtaaagttatcaaggttttaatttcgcacagaattctccatctgcatttcacagtgtcgcgcccgccagccaaccttaacggcgcggttagtcgatgcgtttgacaccgacatcgtctaagctatccagtctaatgtcctatgtgccattcctatactgaccacctcgttgaaaaccagttgtggaccctcagatattcgatgtttcgccgaaacaaccgctgcttcgtggcctatggtaagtcatttgtagaaaaatttctgcggctccacctctccaaatccagtctctctagggtgaggcctgtgattctgcagccgtcaaaaaaaacctaactagattccatgtccggaaggtaaagttatcaaggttttaatttgcacagaattctccatctgcattccacagtgtcgcgcccgccagcctaccttaacgacgcggttagtcgacgcgctggacaccgacatcgtctatgctatccactctaatgtcctatgtgccgtccatatactaaccacctcgttgaaaaccagttgtggaccctcagatattcgacgtttcgccgaaacaaccgctgcttcgtggcctatggtaagtaatttctagaaaaatctctgggggtccaactctccaaatccagtctctctagggtgaggcccgtgattctgcagccataaaaaaaacctagctcgattccatgaccggaaggtaaagttatcaaggttttaatttgcacagaattctccatctgtattccacagtgtcgggcccgccagcctaccttaacggcgcggttagtcgacgcgcttgacaccgacatcgtctaagctatccaccctaatgtcctatgtgccatccctatactaaccacctcgttgaaaaccagttgtggaccatcagatattcgatgtttcgccgaaccaaccgctacttcgtggcctatggtaagtcgtttctagaaaaatctctggtgttccacctctccaaatacagtctctcaagggtgaggcccgtgattctgcagccgtcaaaaaaaacctagctcgattccttaaccggaaggtaaagttatcaaggtttttattttgcacagaattctccatctgcatttcacagtgtcgcgcccgccagcctaccttaatggcgcggttagtcgatgcatttgacaccgacatcgtctaagctatccaccctaatgtcctatgtgccattcctatactaaccaccttgttgaaaaccagttgtggaccctcagatatttgacgtttcgcagaaacaactgctgcttcgtggcctatggtaagaagtcaagaacccatttttgtgctttgtttctgcttgttatatggagtttattagagtaaaagccttttcttttctgttggtcgtgtagacgctgcagcttcggaagatccgctcttcgtggaagttgaagccggcgtttgggaaagcgagcaaggcaagtcacatcatccttgaacatattgaatcccattttataaaattatgttgctttaaaattattgcattatcgctttatttaaattcccgcgttatcactgttttatctagccatgcctatttacctttgttatgaccttattattgttatcgttattatttccttgttcaccctagaataaacaaaaccccaactagtggacactctactcatggtaccactagtatgattttaggtagatgcttcgctatttaattaggtaagattaggcggttttacaactctagactttgggatattcatatcacctggacactttggaattgttggagtattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcggtggtcgatggacatctccagggcaaatgaaggctacacgagctgcggccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcagattcgtgtgggttcacggccttgataaataatattgtatagttctagaatcgtgtttacaaaatagctttgagcaactaagtatctttaaatgctgtttactgcaaccctaaccctttgtattataactcccttgtactcccttgcatttattatgcacttgtgggtgtgtcttgttgagtacggtggttgtactcagtcttgctcaatttttttcccaaacccagaagaggagtctctggaagatgaaggttttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgaactgtatcaacttttggtgtaccttgcctcctgggacaaggaataatgcactcacgtaaggaacgcccgttgggttatttccggtcgtgacaagttggtatcagagcccccttgaccctaggacgagccttagatcccaagccttagcaatattttcaaaaataaaaatcctgtctgaattgtgaaaaccctctagtctctctctgtcctgctgcttcatttatcgccaaaatctgacttttaaatgttgcttttctttttgtttttgtttgtagatggccggcagcatcaaccgtcgtggtctggacctgactggtttcgtcttggagctgcggggcatgtgcgttgtcctggggtatccgcatggagtggactaccagggcaggccgctcccggagcaggagggtgacgatgcagagccccacgctgcttgggaggttactgcagtgatcctcaccggctcacccgagaggacttcgttggaagtcaccgcgggtggagattctttctccgccgcttgccagaacgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaaaaaggacctagacgcagtggaggcgcagctgcatcagctcaagatcgcccagggagaggtctgtcgccccaagtgccgccgcgtctgccgcagccagaagatcaccgcccgcaagagcacctctaggcccgagcttgttcgtcagtccctggcgtggacttgcttcgttgagacccctcgtgccgagcccgcgcccgtggttcctcaagagggggaagcctccggcgttggtagcacggaggatgcgctgttgctcaccttccgtcctggcccgtcgcagcggtagacgagcagttagtaggctggcgcgtgtgttctttctcgtttgtcttcttgttggagtcgtgtgggggcatggtttatgccggtgtgtggcataactgtgtcggagcctgtctttattttatttgcttaagcaacttgaactttaatgaaccaatttaatagcagtaataaattcaagaattatggtagtcgtggatggttagctttaattgtcagctctctctgtttgctggttctgtgtggggttttcagatggtgacgaccaggagaagtgctgccaccggtgatggcaaccaacccgaaggcagcaaccacaacaaccatggcagcccaccttcacctcctcctccgccttcaccaccaccaccagacaccaacgccattctcacccaaatcctcgcccagcaggccaacatgatggctgctttcctccaccacatccaaaatccaccacaacataatgctccaccaccacccccacaacactctaaactcgccgagttcctccgcatccgtccacctaccttctctagctccaacaaccccgtggatgcgttggattggttgcatgccatggggaaaaagctagacaccgtgcagtgcagcgatgaggagaaagtcgtcttcgccgcccaccaactgcaggggcccgcatctctatggtgggaccatttccaggctacgcagccagaggggcagcctattacttgggcccgcttcaccgccgccttccggaggacccatgtgcccgccggagtcatggcccttaagaaaagggaattccgagagttgaagcaaggcaaccgctctgtgatggagtatttgcatgagttcaacaacctggcccggtacgccccggaggatgtacgggaagatgaggaaaagcatgagaagttcttggcaggaatggaccctgagctgtccgtgcgtctagtctccggggactatccggatttccaacgtctggtggacaagagcatccgcttggaagccaagcacaaggaactggagtcgcacaagcgtcgcttggcgaatttccgtaatcaacagggagctaaccaaaggatccgctacaccaatccctatccagggggatcctcctcgcagcagcaacaacagtagcagcaaccacgctccgcgccccgacctcaattcgtggtgcgcgtcccagagccgcagcagcagcagagtcagcaagggacccgtgtgccccgtcctcctacgcccgccgtgcagtctggtcaaggccgcagggacgttcaaggtccgcagcgtctgtgcttcaactgcttcgagtccgggcactttgcggacaaatgcccaaaaccgcggcgccagcaaggccaagcgcctccccgctccaacaacggtggtaaggatgtcattcggggtcgggtgaaccacgtgacggccgaggacgtgctgacaactccagacgtcatcgttggtacgttcctcattcattccatccctgctaccattttgttcgactctggagcttcccactcgtttgtatctgtgccattcgtggggagaaatcagttgggggtagaaaggcttaggaaccctctcctcatcaccacccctggaggggttatgacagcaaagtattatagtcctgccgttcctatagaaatttaggggattccttttccctcggatctgattcttctagacaccaagaacttggatgtgatccttgggatgaattggttggctcaattccaaggagtagtggattgtgcaagacgcactgtcactctgtaccgagggccggaacaaccggttgttttctttgcacccccaacctctgtcagtagttcagaacttcatcagataggactgtcagaaatccccatcgtcagagagttcggagacgtgtttccgaaagaactacccggtatgccgcccaagtgagagattgagttccggatagatcttgctccaggaaccactcctctgtacaagcgaccctaccgtatagcagcaaatgaactggccgaagttaagaaacagttggaagagttgaaagaaaaggggtatatatgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccacggtattctccaagattgatcttcgttccggatatcacctgttgcgcatccgtgaagaagatattccgaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctggtatactcacaatcagaggaagactatcagcaccatctccgtctggtattggggaagttgcgggaacatcaattgtatgccaaacttagcaagtgtgagttctggttgtccgaagtcaaattcttagggcacgtgatatctgctaaaggagttgctgtggaccccgaaacagtgattgccgtcactgattggaagcaacccaagacagtcactcaaattcgcagtttcttaggtttggcaggatactacaggaggttcatcgagaacttctccaaaatcgctcgacccatgacacagttgttgaagaaagaagagaaatttgtgtggagcccgcaatgcgagaaggcgttccaaactctcaaagaaaagctggtttcctcgctagtgttaatcttgccggatactcgcaaggacttcatggtgtattgtgacgcttcgcgccaaggattggggtgcgtgctcatgcaggacggtcatgtggtggcctatgcctcacgccagctacgacctcatgaaggcaactaccctacccatgatttggagttagccgcggtggttcatgctctaaaaatctggcggcactatctcattgggaatcgctatgaaatatatactgatcataagagtttgaaatacatcttcacccagtcggatctgaatcttcggcagaggagatggttagaactcatcaaggattatgatgtgggaattcactatcatcctggtaaggccaacgtggtcgccgacgctctaagtcgaaagagccattgcaacactcttaacgtccgtggctttccacccgaacttaaccaacagatggaagccctgaatctaagcatagtgggtcgtggattcttggctgcgttggaagccaagcccaccttactcgatcaaatccgcgaggctcagaagaacgacccggacatgcatggactcctcaagaatatgaaatagggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgcacttagacttgaaggagaaatactggtgggttagtatgaagcgggaaattgcagagttcgtggccctttgtgatgtgtgccagcgtgtcaaggcagagcaccaacgaccggccgaacttctccaacctctccaagtaccagaatggaaatgggatgaaattgggatggatttcatcaccggacttccaagaacccaaggtggatacgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccctatgaagcgttgtatggacgcaaatgccggacaccgctattgtgggaccaagttggggaaagccaagtgttcgggactgatatcctgagagaagctgaagctaaagtcagaaccattcgggataatctaaaggtggcccagtctcggcagaagagttatgcagacaaccgacgtcgtgacctggaattcgcagtggatgactttgtgtatcttcgggtcacgcccttgcgaggtgtacacaggtttcagacaaaggggaagctcgcacctcggtatgtgggtcctttccgtatcattgctcggcgcggagaagtcgcttaccagttggagctgcccgcctccttgggcaacgtgcatgatgtgttccatgtgtcgcaactcaagaaatgtcttcgggtgccgtccgagcagactgacccagagcaaattgaagttcacgaagacttgacctacgtggagaggccagtgaaaatcctggacaccatggagcgcaggaccaggaaccgggtaatccgtttttgcaaggtccaatggagcaaccacgccgaggaagaagctacctgggagcatgaagacgagctgaaggcagcccatcccgatctcttcgccagttcttccgaatctcggggtcgagattccgtttaaggggggtaggtttgtcgcgtcccaaaacgactctaaaatacatccccgaaattatgcctagaataattaaaatccgtgtgaaagcctccaacaattaaaatgtgcaatgttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtccttttccccctcctccccctcttgggccggctcggcccatctctctccctctctctcctctcccccgcggcccattcggcctcctccccgcgcgcgtgccgctgacgggcgggcccgcccgccaccctcgctgacgggtggggcccacccgtcatccccttcctcccgccgctcccgccgcctcgcccgtgccctagcgccgccgccgccgcgaatcccgccgcctcccgccgtccacgcacgcaataaagtggggggaaatattccccgtgattccctccctctttccccccatttttccctccctctctccctcggattcgtttggaaacctctcccctaaccttgccggcgccatcaatggcgaccggatcttccgcgcccgtttccccctcgtccggcagctccctccccctcccaatcctatataaaccttccacgtgcctccctccaccgtttccgccactcgccgccctctctccccgtcggaatcgagctcgcgccgtcgctctctctctccgccgtcaccgccgagctccggtccgccgccgtcgtcgccccggaccacctcccgcctcggcgtcgccaccttcggcttcaccgcatccccggcgacctcgtccacccctccgtttcgctcgccgaccgccggagcaccgtcgaccccgtccacccgagccgcgccgccgccttcctccgctccggtcgccgtttccgtcatcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgtcctcgggtgtggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccatttcaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttatagggtgaaatcggtacgccgtgtcgtggaagatgtagttgtggcgctcccgtagtctggccatcatcaggtatgctgcctcctgacaggcgtgatctgctgtgcctccggacgcctcaaccaccatattagctaggcaggtacccacgtagccgtggacctccaagcgaacacggtgaggaagctcgccactgagcggtggaaccgttgtgtactctggcgcgttggggtagcccaccaccagtgtcatacgtgccaactctgccacaaagtcgatcatgccttctccacgatggttgggtgggtggccggccatcttgcaacccatgttcctgagctacgacctaatgcatttcacccatcaaatcccactgactgacgaataaatctcaacagttttactaaaaccctagactgacttgttttgacaaatctcgcttaaacgagcgaccaagatttttcccttgaaccacaagaacagatcccaattttcccggaacaaatccaatcgcaaagaacatatgcaatgaaaaggattcagagggctcttaggtttttccatttggcttgtcctacggtcaaggtcggctctgataccaacttgtcacgcccagaaattcccgaatagaatttcaagcagaatgtgcattaaattccccgtccaggaccagccggggtacacaaacgacaatgttgacattcagatccacgtcttacaaacatcataaaagtcttacataaatgcagcggaagaaaagatagacaacaggagctaagccttgactagaactgcagcgggaacaccactccacaggcatcctcgacggcacggacgaagcctactcctcggagaaaccttcatctgacacatactcgtactctggggttgggaaaagtagagcaagactgagtactacccactgtactcagcaagtcataccggaataggggtatgatgcagggaatcatcaaagaagagctgaagtggttcatttgcataaagcgagcatttataaacagaagttgaaagatttaaacagttgtaataattaattagtatcaactatccactgcccaacgctaacccacgttgcaacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacaacacgtttccgtgcgccgacatgccaccaagacatatcggaaagaggccgtgacaggacccttcgcataaccctctctaaccaagcacaccacacctcaggtttcacccccactcctcgcaaggtagcgggcagtcccctctcgtgcctaggtgaatccggaagcgacagaggccgtcgcagggctcgccccgctccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcgcaccatgtggtttattttaattaaccaacaccaaagcggtgttactaatccaacaaaaccattagaaccaacagtctaaacattaataggattttccccattgtgcactagttgaactaagcatggctaagcaatccctagtccaaaccctaatcatgttataccccaagttgacaaagaaacatggtacaacaatagcatggctatgacaataggtagacaacccatagtaacattataaaacgatgcaatatttgaaagaaaacaatagagcatttgcaatataggatcaacatgttcaagtgacaagcatgacttgccttgctctgctgctggaggaacctcggcgactattccgaagtacaccggagcatcggaggaatcggaatctagcgacatacaaggcaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaataaatcccagggctgacgtcagcacggagggggcgcggcgccggcaagcgggccccaccggtcagcggctcaggggagggaggaaggggcgccggcaagtgggacccgcatggcagtgactcggggagggcggtccacggcggatcgggtccacggaccggggaggagcggcgcaccacgcggcggccacgcgacagccgaaccgatgaccccgatcggatggcggcgggagctcgcggccggtgcgcgcgggcacggcgcaanccnntntnnnggnggtncctatcgttncattctttntaaccg

SEQ ID NO: 10069 - DNA, 1621 bp, Oryza sativa
ctgaaaccagatgaagattctgggcaaattaaaacattaatactttgcctcccgttcatgaaacaagctaggttttttttacggcttcaaaatcacagccctcccgaaagagagaatgaatttgaagagttgaacccccagagattttcttagaaattacttaccataggccacgaagcagcggttgtttcggcgaaacgtcgaatatctgagggtccacaactggttttcaacgaggtggttagtatagtgatggcacataggacgttagggtggatagctaagacgatgtcggtgtcaagcgcgtcgactaaccgcgccgttaagttaggctggcgggcgcgacactgtggaatgcagatggagaattctgtgcaaattaaaacattgataactttgcctttcggtcatggaatcgagctaggttttttttgatggctgcagaatcacaggcctcaccgaagagagaatggatttggagagttggacccccagagatttttctagaaattacttaccataggccatgaagcagcggttgtttcggtgaaacgtcaaaaatctgagggtccacaactggttttcaacgaggtggttagtatagggatggcacataggacgttagggtggatagcttagacgatgtcggtgtcaagcgcgtcgactaaccgcgccgttaagttaggctggcgggcgcgacacggtggaatgcatatggagaattctgtgcaaattaaaaccttgataactttgccttccggtcatggaatcgagctaggttttttttgacggcttcagaatcacgggcctcaccaaagagagacaggatttggagagttggacccccagagatttctctagaaattacttaccataggccacgaagcagcggttgtttcgaggaaacgtcgaatatctgagggtccacaactggttttcaacgaggtggttagtatagggatggcacataggacgttagggtggatagcttagacgatgtgggtgtcaaccgcgtcgactaaccgtgccgttaagttaggctggcgggcgcgacagtgtggaatgcagatggagaattctgtgcaaattaaaaccttgataattttgccttctggtcatggaatcgagctaggttttttttgacggcttcagaatcacgggcctcaccgtagagagactggatttggagagttggacccccagatatttttctagaaattacttaccataggccaggaagcagccgtttattcggcaaaacgtcgattatctgagggtccacaacgggttttcaacgaggtggttagtatagggatggcacataggacgttaaggtggatagcttagacgatgtcggtgtcaagcgcgtcgactaaccgcgccgttaaggtaggctggcgggcgcgacactgtggaatgcagatggagaattctgtgcaaattaaaaccttgataactttgccttccggtcatggaatcgagctaggtttttttttatggctgcagaatcacaggcctcaccctagagagactggatttgggagagttggaccccagagatttttctagaaatgacttacccattgccacgaaacagcggttgtttccgcgaaacgtctaa

SEQ ID NO: 10070 - DNA, 723 bp, Oryza sativa
tttcggcgaaacgtcgaatatctgagggtccacaactggatttcaacgaggtggttagtatagtgatggcacataggacgttagggtggatagcttagacgatgtcggtgtcaagcgcatcgactaaccgcgccgttaagttaggctggcgggcgcgacactgtggaatgcagatggagaattctgtgcaaattaaaacattgataactttgccttccggtcatggaatcgagctaggttttttttgatggctgcagacccacaggcctcaccatagagagaatggatttggagagttggacccccagagatttttctagaaattacttaccataggccacgaagcagcggttgtttcggcgaaacgtcgaatatctgagggtccacaactggttttcaacgaggtgtttagtattgggatggcacataggacgttagggtgtatagcttagacgatgtcggtgtcaagcgcgtcgactaaccgcgccgttaagttaggctggcgggcgcgacactgtggaatgcagatggagaattctgtgcaaattaaaaccttgataactttgccttccggtcatggaatcgagctaggtttttttttacggctgcagaatcacaggcctcaccctagagagactggatttggagagttggaccccagagatttttctagaaatgacttaccattggccacgaagcagcggttgtttcggcgaaacgtcg

SEQ ID NO: 10071 - DNA, 759 bp, Oryza sativa
  unsure (1)..(759): unsure at all n locations
cgggattgaatnacgtagattcgacttcgactgcagtggaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggacttcacggtcagcaggagtttgccacgcgacatcagtcgaagattctgtatggaaatgggcgacgacagcttcaggacattgatt

SEQ ID NO: 10072 - DNA, 755 bp, Oryza sativa
  unsure (1)..(755): unsure at all n locations
cagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtaccatctngtagggcatccaatcatgccg

SEQ ID NO: 10073 - DNA, 15792 bp, Oryza sativa
  unsure (1)..(15792): unsure at all n locations
cggaatgcataacagacggtacagtagttcatcacctcattatggaaaatcaagacaactttcttaatgttgtatcttgatgtgcattcttttgaatctaggcttatttttatgcagttaaatttatgatttatactcctccaagttccatcagcccgctttgtataatattatgctttagatgggattagaggcctttcaaaggcagaaagagaaattatgctcctccagttggcctaggcttcaactctgggtttttatttctattgctggtcattcatacacaagatttcatgagcccacagttcaccttttggtcctacctcatttatcagcataggcgatagtagttgatgattatataccatttcccagactattccgaaagagcctaatgttggggatatttcaaggatgctaattgttgtaatgggtgcaagccatgttattaatgggtcatgaggaattagtctctgaccaaagtatctaaaaaatgctaagaaagaccaatttgtggtgctacttgatcccaagaaacaaggtgtacaggaagggaatgtgaaatcggtttctcactttttatggtagtcagtatctaaatcttacagtagaaaccaccttgaccgtgctgaaatggcatgagttattgaggctgctggtagaacacttgaaactttgcctcatttttgctgcttgatcttcatttcagccaattgcttgttagctatttagcttcatgttgcgattcatgttttgagcagcatttgtaaaatcatttatttaagaaagtggccatggacaagctcttttagatattgctaccttactatctttgggagagaaaaatgttgaatgaacattactagccatgatttggcaagaggccttcagattacgtgactattttgtattgatttgtacttgtgctattttgcttttcaagccaattacttctagaaatggatcactgagcctgtacacatgacacaataagagctaagcttttagcattctctgaaccctgactgcgacatagggtggctaatgaaatatgatcattagtaaatatgctgagtgcaataaactcttttccatgtaggcaaaaattttcttgtttgtaaaaattgtcatgtgcctagagctgagctctcttccgtggccaagatgtttctatagtttagtaagtggtatttcttggtagacgtttggctaatggaactcatgttctcagatattccaagatcttcagaagggaatagatcttggtgtagtctctccttagatgctacagatgttttttttaccttgagaaatgccctgttagggcatgtttaatggtagagacgagtatggtctcttaagcaatacaagattatttagagaccgtatctttacaatagtagagacgacaaagtctctaatcattaactcaaaaaatattccttttgttaatattctttccatttttttaccctcatgcaaccatatttccattttatattgattaagagtcgttgttaagctgttgttatgcatgacaacgatattttgtctctcctctttctctttcttccatgtcaacaagtattccaaattaacatcactaagagaccactattgacaaccattgtacatgcccttagtgcttcacagtttccaggtaagaaaatattcttttttttcccttcttagtgcttatcaattcttagtcttatgaataattctgttttaaacatagttatcctataattttgaggcagaatatacatacacttcatttcaataaaccaaatttcttagcggttgtgcaaaagattgctgggcagaccccaaattctcttctttttattatatatggctctcttgttcttctacattgataaacacacttttcagacaagttcttttgctcatggttttgcatactgcagatatccatagaagcaattgaagatttacaagtaaaacatgctttccataataacgcaaaatgttcctattattctggtgtgggtgtctgatgaaaggctttccttggaagtgcaactgtaggtacctatttctctcctttttttgtgagattacaaagtgccagacagacgcatatttctgcacatagttgtgtattcttgaacataggtctaggcttggtcagtattggatataattacatggtctgttttgtcacttccatggtataattgttttcttcaacttcctttttttttccaagcttagcaaaccttgtgacacaaggccacactaaactgcattagtgacatattatattaataaagacaaatatgtatatacacatgccactttgcgtttaggatgacagttttgtcaggtgttttgttacatagcaaagatttaattttttttattttatatttggctagccgtttgcgctttttcttacataaagtgttagtaggattaactaattaaattcataaaacactgtttgccacaatcatatatggtggcactctctattttccaatttagttagcataatgaaatgctcataattaatcctgtgctgaactaaattactatttgttagattactagccgttatttatgtatgcctgtttggttgttttattcacaaatctgtctcaattctctctttatttaatggaactgttctgacagtgcatgcatttcttattattcaggatggtgttcttcttgggatgaaatatcaaaacatatttttgatttgctttagctatgatacttcagcaagactcctggctgccttatctttttatataattgtcttgagcagttgtccctcaggtttttgcatagcttgtaggaacaagagtagagccatggaggcataatagcttgaagtaattatggttaatgtgcttacttaaaaaaggtgtttaatgttaacattgaattctgaaaacttgaagcagatttttctaagtgtacctggatgtttcttaagacatcggtttcttttgctatggtgctcctcgggagtatatacagccacaaaatcaaatgaactatatgcaggcggcgcgtcggggcttccctgacttccagcactcctttctaactagatgcgtacaggcggcacgctccaacctttagtcggttatattaaaacctactgggaattggcgagctgagagcgattcggagcggcgtgttcgcacacggaggcattcacgtcgcccgcgagcgctgggaggcgggcggaattcgcgccccctcgtgcgtccgcgccgtgcagctcccagccgtccgattcgtcgcagcgacggctgagatcgatcatcgtcgcgagtgcggtggtaatttttcaaaaaacccctccgttgcattgataatgtgttttagatcccaagtcatacggtgcgacgttgtggtcttttacgtataagacctccataaccaagaaaatcttacataaagaagagagaaatctaaaaataggaccgcactctgaaaaacgagcatcaaagggcttttctgaaaaccaatatatacctataccccttcccctgaaaccctagaatcattgctttccttcccctctccgccccatcgacgccctgcgccgccgctccattctccggcgccaatcctcgccctgacaccgccgcaccccgctgcccgtcctccattacctctctctcctcttgccgctggttcctctgagctcaagctcgatggtgagaggccgactccgtccgtcggcgacgagtcagtcgatccggctttcaatcgggttagatctccgtcctctgcatcacctcgtcgtcgatttacctgtctccacaatccaagcccattctgccttcagatctggtgactctgccttgcaattggctgaaatgaagatcaagcagcaaaaatgaggcaaagtttcaagtgttctaccagcagcctcaataactcatgccatttcagcacggtcaaggtggtttctactgtaagatttagatactgactaccataaaaagtgagaaaccgatttcacattcccttcctgtacaccttgtttcttgggatcaagtagcaccacaaattggtctttcttagcattttttagatactttggtcagagactaattcctcatgacccattaataacatggcttgcacccattacaacaattagcatccttgaaatatccccaacattaggctctttcggaatagtctgggaaatggtatataatcatcaactactatcgcctatgctgataaatgaggtaggaccaaaaggtgaactgtgggctcatgaaatcttgtgtatgaatgaccagcaatagaaataaaaacccagagttgaagcctaggccaactggaggagcataatttctctttctgcctttgaaaggcctctaatcccatctaaagcataatattatacaaagcgggctgatggaacttggaggagtataaatcataaatttaactgcataaaaataagcctagattcaaaagaatgcacatcaagatacaacattaagaaagttgtcttgattttccataatgaggttattcccctagttcgtggtaagctgtatgggtaattaatcgtggcaagtaaattatatgcagcaagctgcaaagaggttaactcatgtggtgcggcaaaaaaattgagatgtaaaccatggaatctagtttcaatatccaagacacatgtattgaacaccttgcatgactgctagagagcattgtttcgtacaatataaccaatcacacgtcaacgaattcatgatttgactaaagattattttatgtacattttgagaaatatcagaaactttttaatgcaaattgctagaggaatatcagaaaaagaatgaaataataaatagtgtcgagcactcaagccttggataacatttatcaccagcaactcaattgtgattcaaatagcagaaaaattcaatcttcaaattatgtcctaaataactgtccctatttaggacaaaaaccagcagcgatgtgtagtgcaaagtttatgaatcctagctaaaatagtcctacaacacatttacctgtccaaccaaaatagtgcattcaaaagccatggtttgcagagcaatagagcatcaaaatgcacaaaatatactaaacatttgaagattagcacaacaacaactaatcacaataaatctgagttagcacatggaatttaaaacaacataaaaggaaatattttttctatggaaaggaaggtcaaaatcaactgcctcacaaactaagtgtgcacaaaggaaaagaaaaaacaataccatatgcaacaaggagttctggatcaccatatatatcaacaaggacctacatggttttgtccatgagtcacaaaggattacactaaacatctcaatcctcttgtagaacaggcaaaatatataagaaaccttgggctctacttcttgcgtgttaagagtatggaaacctagtgaatgtggaaacctacaacagtaaatgctgaggaaggaagtagaacaggtcatggacgactatcacataacatgatctaccaaaaaaatacttttttttcctatatcaagaacagatgctagaggagatgattggactgaattgattcgtacctagatggcagcgacattggtggggaagccatagatgcagatcaccatcctggggttgaccccatgcacagaagagaccaaacctgcatcagtaagaaatttccattcctaattaaacccacaaggcaggagctgtagcacgcctcgaaacacaactgaattaaagataactgaatggagagggcaatgcaagataaacctataatatgaagtaattggttctatccacttcaagaaagaaatagaagaaaattaaaggatggtggaagaaaaataacatctctgaaccaatcttatctgctctgcctgctagacatcacttaggccaaggcctgttgcatgccacatgaaccacatccaacattttcttacattgccaaccacatgccaggcaggcatacatgatgagaattgaaagagaaaaaagttgggcttaaatcaggtcacaaacctcaaattgaatgagaaaattcaaattagatcgcctcactaaaaaaagtagaaggatacctataacttctcatcaagtaccagaatgctaaatgataatctctgaataaatgagcatcaatcatagcaggcagcctgttgcattcatattctgctttctacagtggattaagctcacccactataaattaacctgcttctctgcatttttagatggtgtgccaaagtgagtagaggtagcagctatagtggatggtttttcaacgacaataatctaatccttaagaagactcctgaaatatataaataagtaaggcacatatatgaaagtaaaactctcaaacatttagtaatatcattatatataaaaatatgctactcgttaaccactgaatgtgttggcttgcaaagccagtttttttggatgggaccaagggctaaaacaattagtcaatttaataacaacccaacagcatcatcacattttttattctgtgcaaacaaaatagtgttcatttgtcaaaactattgggtacttggttttaagtttctgaaatagatcatgagtgtgcaaattgtgaatatttaaataaccgcaacattcagttcacatatatacctctttgcatggaacaccaaaagatagcattttcatagaacatgaatacatatagagaaatattctagaagcattaaatctaaaacacataacaaaatactgctaaccaaaaatttaatactttaataaaaaaacaaggttaatacggatggaagcctttggaaatgaaaaaaaaaaacagttgcctgtgtatatataagtttcaagcggcaaaaataaattaagtttatgcactacatttagcgaaaactttgctgcaaacagctacaattaaaatgactggtactcaggtttcagcatcaagtagcaccgtttgcacctctttgcaatgttgctatttccttcagcagattattaaacagcggcataaccactgcacccctactttctttgaatattttttagagtatagctaccacacagtgaatatatatgctgataactaaatggcttgtattaagacttgtaccaagatttttctggtctgaaatgtgtagaattcacccagacaaaaagtgagatttctgcatcagaagagatctagctaaggtttgcacttcagtgactggaaactaatcccacatatcatttgaatgtgcaggcaacattcacaacaaactatcgagaaacagtaatggataaagaatttaatagagtcaaaaggaccaaaagttgaaaataataccagcaattatattgttttgtttatgtagcaacatcatccatggtagatgcagattcctactgctcgagcacctcacgtatgcagtgactttaagccctgagagagtgcaaataaccattagatgttattatgatacaataaatcatctattccattgaaaaagatacagtaaatcatctcccaattagtgaacaaggtaacctttggaagattatttgggtgacatattgcattaagatcaaatttgctgtcactaagtagctgtgccaaaatttcagtgagttagcatttatgatgatagatcaggatgtcccccattgtgccaaagacataaataaagatcggcaatcgaactttcttagttgaaattatcatattcatcggctactgatctaatacaggaaagtggcaagtctgctcgcacttgaagctcaacgtctagtggagatggatgaggccttaccgatcatgcaccttgacaaatatcctaagctggagaaacctatcgatggagatcctgtgcttggtggcgtactcatcaagcacacactccttcatggccgcagcggccaccggcggcggcgtagacacacacaactccagtgtgtacttcgcgagcggcctacagaacaagtgaaacactgatgacagcaacacaaaaatgaatcacatagctaaggtcggcggattagggacctgactgcaggcacaatcatcgcaacgcgcgtgctgttgcggatcccggaagttggttgtgttcccctttaatctctctttacatttttgtgaacattgcagctagatttctgctctaaaaaccaaaaactactcatttttgtaaataaaacagagaggatacaatataaatttctaaactactctaaaatttagatgcaaagaaactcaattttcagatgccacattagttgcaaaaaaaacgttgagatgtaaacctgagtgaatgatgtgcatatcgggagcaggcacagcggtcacggtactacgaactgtgcagcaaaccgacgttgctccggctggatacatgagcagattacagcacccagagcagacgagctggctttgggcccctgaaattgcacaatcatggctcttcagagttcagagactgactgaatgtcacatttcagcagctagcattttcattttcagaggacaaaagcattctccatgcattattttcatttcagacaacagaacacagtagtaaaaaaaacttccattttctcaacagggagttctctctaaactttcaggatttctatgagcacaataaactgcaacctctgaaccaggaagagtaacatcttattcaagaaaaaccaccctaacttaacacagaattccacagtgtcgcgcccgccagcctaacttaacagcgcggttagtcgacgcgcttgacaccgacatcgtctaagctatccaccctaacgtcctatgtgccattcctatactaaccacctcgttgaaaaccagttgtggaccctcagatattcgacgtttcgccgaaacaaccgctgcttcgtggcctacggtaagtaatttctagaaaaatctctgggggtccaactctccaaatccagtctctcttctgtgaggcccgtggttctgaagccgtcaaaaaaaacctagctcgattccatgaccggaaggcaaaattatcaaggttttaatttgcacagaattctccatctgcattccacactgtcgcgcccgccagcctaccttaacggcgcggttagtcgacgcgcttgacaccgacatcgtctatgctatccaccctaacgtcctatgtgccatctatatactaaccacctcgttgaatacccgttgtggaccctcagatattcgacgtttcgccgaataaaccgctgcttcgtggcctatggtaagtaatttctagaaaaatctttgggggcccaactctccaaatccagtctctcttcggtgaggcctgtgattctgaagccgtcaaaaaaaacctagctcgattccatgaccgaaaggcaaagttatcaaggttttaatttgcacagaattctccatctgcattccaaagtgtcgcgcccgccagcctaacttaacggcgcggttagtcgacgcgcttgacaccgacatcgtctaagctatccaccctaacgtcctatgtgccatcccaatactaaccacctcgttgaaaaccagttgcggaccctcagatattcgacgtttcgccgaaacaaccgcggcttcgtggcctatggtaagtaatttctagaaaaatctctgggggtccaactctccaaatccagtctctcttcggtgaggcccgtgattctgcagccatcaaaaaaaacctagctcgatttcatgaccggaaggcaaagttatcaaggttttaatttgcacagaattctccatctgtattccagtgtcgtgcccgccagccttccttaacggcgcggttagtcgacgcgcttgataccgacatcgtctaagctatccaccctaacgtcctatgtgccatcactatactaaccacctcgttgaaaaccagttgtggaccctcagatatttgacgttttgccgaaacaaccgctgcttcgtggcctatggtaagtaatttctagaataatctctaggggtccaactctgcaaatccagtctctcttcggtgaggcccgtgattctaaagccgtcaaaaaaaaccttgctcgattccatgaccggaaggcaaagttatcaaggttttaatttgcacagaattctccatctgcattccgcagtgtcgcgcccgccagcctaacataacggcgcggttactcgacgcgctggacacgacatcgtctaagctatccaccctattgtcctatgtgccatccctatactaaccacctcgttaaaaaaccagttgtggaccctcagatattcgacgtttcgccgaaacaaccgctgcatggtggcctatggtaagtaatttctagaataatatctggggggggtccaactctccaaatctagtctctctagggtgaggcctgtggttctgaaaccgtaaaaaaaacctagctcgattccatgaccggaaggcaaagttatcaaggttttaatttgcacagaattctccatctgcattccacagtgtcgcgcccgccagcctacctcaacggctgtcccaccgtagcgcacctgcctcgctcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttagttttatttctcctttcgcaaatcatgtcatcaatatcgtggcaatgtggtgctcatgtctctacatgccgcatctcaattaccttcccaaaggtaattgcccaagcatatagtatttgataaatatgagtatgcatgattctagaatagcatttctaagcatttgtcatagttgactagggactcatacgtaaacatggttacgaaggaataaggggtaaacaataatcaaggcatggcataatcgcaagtaggatgttcaccattgcatgcaattttatttgtaaacaaacaatttcgcaattgggatcaacatgttcaaggaatagtgatgacttgcctgctcagaatagtccttattcttgatacaatcttgatcaaccttcacctcctgtaagctgcatacgttgcctcacgactaaccgatatacaaattctataatatgcgagaaaaaccaatattcaaacaacaatcaaatatgtacaaacaaaatatagttgttggggttgctcatactactcgtgtttgctaatggattctaatcaaactaagaactaaggtttcttaatctttatgttgtcatggtggtctatataggagctaaccaatgtagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaactccactccagactcaacttctggagttatatttaggagttggagctgtgccaaacaggcccgtagtatgaatgagatacgtatctggctactatgtggtttagtctagcaaatggctattcatgcgtctatctaaatagaatggttatacactagaggttctgttgccggatggatttggattggttaaataattactgtgaatcatttgtattattattttattgatggaggctttattttaattatgtacatattttacttgtaaaaataaattataaaggttaacaattacccatgctttgtatgttagaattgtttaggttaatcttattatggttacggactatcccatcacataattttacaatgaataatcctaatttacaattatattaggtcaagatttataattagtattttatccactatagatgtttgtcatagactcattagtttactatacacaaaagggtaggtttttgatataccgtacatctaaattgggatgtacaatgtatgtgtgtgcaacaatatttaatcattggatcatttactgaatagttgctatttactagaagctatacgatatatgtgattaagatagctctgttttgttaactaatggatgtcaatcgaactatatatattccacttcacatgacattataccaactaacttttaagtggtccaattacaactagctcagttattattcttcttagacaagttgaaggttcatctaagtgtgtttatattttagttacaaagtatgaggctaaacttatgtaaataatttataagtcataggtttagttatatttggacatagactaataaatggcactaatatttcctatgctttaattaatttgaaacaatgctcctagttagtttacataggttttatagtgagaaagcatgttaaagacaattatttgacatctactttatagtacaatatcaattttattattagcacatttttaagttaactattatgcatcatcttgatattaattattaataattataaatatattttattaaatagtgaattatataccattggaaagcttgtgaatttaggttcaagtttcactcaaatcggagctaaaatgaataagttatgctagtgtaaagattcaaatttgaattaattctaataattgcgaaatggtactgttcctaattcatttatttttaatacaaccttatccacaggctatagtgactgacaggtggggtcttcctattttcttttcttttattttatttttctttctaaaggaatcatatgggcaaatgacaggtgggcccgactcctttgactagggtcaaaccggccattaaacccggtagggcccgcatgtcatagactcgggattataaaacctcaataattagatttttaaccacccggacccacatgtaatagactcaactaataaagattaagatggggattactattcactaaacacgtggggcccactctaatctttcctctcctttctcttttctctctctctgctatctctttgcttcctcccacggctcggctggaattggcgggcggcgcggcgcggcgtcaagcggtgggggaggggaaggctcaccggaccgatggcggggtcgacggagatgcggcggcggggtcgacgtcggagcacggcgcggcgacgaggcacagcgcagcggcggggcgcgtcggctcagcggcggcggtggcttccgaagaggcggcgacgccggggacgggaaagagaggggaaagggaggggaggtggtcagggtggtgtgggaagtaatgggcggcaagggggaggggtttatataggtggaaggggcgggcagtgcttaatgacgacggcgacgcggcacggcggcgtggggcgcgacggcgacgggacggcgataggtgacatcgtgcagcggcgcggggctcggggcacggcagcggcacatggcgacggacgagcggcgcgcaacagagagaggcgacggcgacgggcgacagtgacgcgcacggcgcggtaggggcgcggagcacgaggcgggggcgacggcggcagcgcgcgcggaggggaggggctcgagacaacgcaacagacgacggggatgcgatggagtgcggcgcggcgacaggacggcgcgcggcagtggagtcaacgggacggcgatggcgcgcggcggggtggagactcggcgcggcatcggcggcacggggctcgaagcggcgaggggacgggcgcgcgacgacgggatgggcaatgcgacggcgagacggggctcgaggcgatggcggcacgcgcggcgcggcagcgggatggcgacggcgacggcgcggcagcggcggcgcgcagctcggagcggcgacgcgacgggcgggcggcgcggcgcggggctcggcgcggcttggcggggctcggcgcgacttggcggggctcggcgcgacggcgacaggcgacgcgacagcgacgcggcgcgggcgcgaggtggcgatgggacggcgcagtgtggcagaggagggggaagggctaggggaccacatcaagcagatggcgtgcaatgaatagtgacggcagtgaataaaaaaaagaatttaggtttttggttggttttaaaaattgagaataatagctatttgaatttatattttcaccaacgcatttgagtgacattattaagtgttcaaatgtgaattttatttaaagttaatgttgtccaatacttaatactcgtatttattatagtctttgtaatttcctaatgagacaattacagagaggcagtgatattatacactctatttatttatgtgagtgaattttatgcgaagatggttgcgttaaatattgatttaaatattccagcaaaacactcttttatagatgggatcctggtaacgatgtgatcattatttcgtgtgaacaaattattctatctaattgcaatgtatgagctaaccttgttcttttaaaattggttttacctctatatggatccttataatttaatattcgtggttcaatacaaattatgtaacatctaattaattattcccagtaaaactattctatagatagagttccatttatttgaacgattatcatttcctaagtgtctatatttcatggcacgcatcacaaggttcaattatttaatgtttgatccataaattaaattagtaattaacattccctttgtctggctttgtttcctggtgctctaattattcgtagggttaacaattaaatattctcgtaaatttatctattacttaaattttagatccttactttactttccttgtgatcatttacggtttggcaagcaataatattcataacaaccatcatgatgcaaatgttttaaaaagttctaaattttagtgatttttattgtcttgaattttcaggatgttacatgacgctcgtgattctgcagccgtcaaaaaaaacctagttcgattccatgaccggaaggcaaagttatcaaggttttaatttgcacacaattctccatctgcattccacagtgtcatgcccgccagcctaccaaacggcgcggttagtcgacgcgcatgacaccgacatcgtctaagctatccaccctaacatcctatgtgccatccctatactaaccaccacgttgaaaaccagttgtggaccctcaaatattcgacgtttcgtcgaaacaaccgctgcttcatggcctatggtaagtaatatctagaaaaatctctgggggtccaactctccaaatccagtctctcttgggtgaggcccgtgattctgaagccgtcaataaaaacctagctcgattccatgaccggaaggcaaagttatcaaggttttaatttgcacagaattctccatctacattccacagtgtcgcgcccgccagcctaacttaacggcgcggttagtcgacgtgcttgacaccaacatcgtctaagctatcgaccctaacgtcctatgtgccatctctatactaaccacctcgctgaaaccagttgtgaaccctcagatattcgacgtttcgccgaataaaccgctgcttcttggcctatggtaattaatttctagaaaaatctctgggggtccaactctcaaaatctagtctctctagggtgaggcccgtgattctggggccatcaaaaaaaacctagctcgatccatgaacggaggcgaaatatcaacgttttagtttgacagaatcatcatctacatccacagngggcggcccgcaactaacctaa

SEQ ID NO: 10074 - DNA, 728 bp, Oryza sativa
  unsure (1)..(728): unsure at all n locations
gatgtgacctccgactcagtaagagcgaatcaaagctggcgaccgggggatgctttagagtctgcctgcaggcgtgcatgctagctaaacttttcttcatcacagcggattgtgctgagagagcaccttatgctgtgtgcaactacccaccaattcgcacaggcaaaatacttcatctctctctatctgacatagacgatggtcaaatgatgataaggaccatcatcaccatccttttcgctattaccaccactggaaaaccggggatgtgatgcatggtgattaagtctggtcacgccatactttatgaaatcacgaggtagctaacgcactcctcggaaggtatttcttcctctctgacgcttgggtatccttgctgcgtcttcaggagtaaattctgaaccggtgatgatcatggtcctgccattatccatcttccatatcactgtcctgttcgctccagagttgggctgcaaagtaccatccttcttgtcggtagactgacttggagcttggttactccctgggcactacttctcgtctttttcaggtgacctggcgaacaccttccatggacagttccttacataatgaccttgctcaccacagtcataacaggtagcacttactggncttttgtctgacgttgacttggctgtcgttatcttccgggatctggactgcattttgacaggggtctttcgtgctgatattgggaactcctgact

SEQ ID NO: 10075 - DNA, 745 bp, Oryza sativa
  unsure (1)..(745): unsure at all n locations
gttatccaccctacggtctattgtgccatctctatactaaccacctcgttaaaaccccgttgtggaccctcatatattcgacgtttcgccgaataaaccgctgcttcctggcctatggtaagtaatttctagaaaaatctctaggggtccaactctcaaaatctagtctctctagggtgaggcccgtgaatctgcagccgtaaaaaaaaacctagctcgattacatgaccggaaggatagtccgattacatcggatagtctgatttgacttagagaaaaaaatcactcaagaggaataaaaagcaattcaacacagagagtgaagttctgagaaatttcagatagtccgatgtatcagacaatctgaccttatatcggatagtccaatatttttgagccaacacccagaccaaagacagagagcaaagttttgagaaatttcggatagtctgagcatcggatagtctgatcaggatcggatagtccgacaggagaagaacaagaacacttcaaaaacaggatttcgagcactagtgttctaccaattataagcatgtggtatccctcttaatagtatgacatcctaatactaaagaacacaagatatacatggattagaagacaattaccacaaaagatgccacaatacttttaaactcaagttccactcctttttatccttgcatccatctcaacaaatgatgaactacttgcagtaanagggaattcatnngnaatcacatcg

SEQ ID NO: 10076 - DNA, 1332 bp, Oryza sativa
  unsure (1)..(1332): unsure at all n locations
aattctgtgcaaattaaaaccttgataactttgcctcccggtcatggaatcgagttaggttttttttgacggctgcagaatcatgggcctcaccctagagagactagattttgagagttagacccccagagatttttgtagaaattacttaccataggccaggaagcaacggtttattcggcgaaacgtcgaatatctgagggtccacaacgggttttcaacgaggtggttagtatagagatggcacataggacgttagggtggatagcatagatgatgtcggggtcaagcgcgtcgactaaccacgccgttaaggtaggctggcgggcgcgacaccgtggaatgcagacggagaattctgtgcaaattaaaaccttgataactttgccttccggtcatggaatcgagctaggttttttttgacggcttcagaatcgcgggcctcaccgaagagagactggatttcgaaagttggacccccagagatttttgtagaaattacttaccataggccacgaagcagcggttgttttggcgaaatgtcgaatatctgagggtccacaactggttttcaacgaggtggttagtatagggatggcacataggacgttagggtggatagcttagaagatgtcggtgtcaagcgcgtcgactaaccgcgccgttaaggtaggctggcgggcgcgacactgtggaatgcagatggagaattctgtgcaaattaaaaccttgataactttgccttccggtcatggaatcgagctaggttttttttgacggccgcagaatcacgggcctcaccctagagagactagattttgagagttggacccccagagatttttctagaaattacttaccataagccaggaagcagcggttgattcagcgaaacgtcgaatatctgagggtccacaactggttttcaacgaggtggttagtatagagatggcacataagacgttagggtggatagcacagacgatgtcggtgtcaaagcgcgtcgactaaccgcgccgttaaagtaggctggcgggcgcgacactggggaatgcagatggagaattctgtgcaaattaaaacttgataactttgccttccgtcatggaatcgagctaggatttttttgatggctgcagaatcatgggcctcaccctagagagactggatttggagagttggacccccagagatttttctagaattacttaccataggccacgaagcagcggttgtttcggcgaaacgtcgaatatctgagggtccacaactggttttcaaggaggaggttagtataaggatggcacataagacgttagggtggatagcttn

SEQ ID NO: 10077 - DNA, 710 bp, Oryza sativa
  unsure (1)..(710): unsure at all n locations
catgggnnggtgatgtgctnctactgcaagtcgttcatcacaactggttttcaacgaggtggttagtatagggatggcacataggatgttagggtggattgcttagacgatgtcggtgttaagcgcatcgactaaccgcgccgttaagttaggctggcgggcgcgacagtgtggaatgcagatggagaattctgtgcaaattaaaaccttgataactttgccttctggtcatggaatcgagctaggttttttttgacggcttcagaaccacgggcctgacagaagagagactggatttggagagttggacccccagagatttttctagaaattacttaccataggccacgaagcagcggttgtttcggcgaaacgtcgaatatctgagggtccacaactggttctcaacgaggtggttagtatagggatggcacataggacgttagggtgtataggatcgacgatgtcggtgtcaagcgcgtcaactaaccgcgccgttaagttaagctggcgggcgcgacactgtggaatgtagaactcatcaaggattatgatgtgggaattcactatcatccttgtaaggccaacgtggtcgccgacgctctaagtcgaaagagccattgcaacactcttaacgtncgtggctttcacccgaactaaccaacagatggaagccctgaatctaagcatagtgggtcgtggattcttgg

SEQ ID NO: 10078 - DNA, 1086 bp, Oryza sativa
cgtggttagtatagggatggcacatagaacgttagggtgtataggttagacgatgtcggtgtcaagcgcgtcgactaaccgcgccgttaaggtatgctggcgggcgcgacagtgtggaatgcagatggagaattctgtgcaaattaaaaccttgataacattgccttccggtcatggaatcgagctaggttttttttgatggctgtagaatcacgggcctcaccgaagagagactggatttggagagttggacccccagagatttttctagcaattacttacgataggccacgaagcagcggttgtttgggcgaaacgtcaaatatctgagggtccacaactggttttcaacgaggtgtttagtattcggatggcacataggacgttagggtggatagcttaaacgatgtcggtgtcaagcgcgttgactaaccgcgccgttaagttaggctggcgggcgcgacactgtggaatgcagatggagaattctttgcaaattaaaaggttgataactgtgccttccggtcatggaatcgagctaggttttttttgatggcttcagacccacgggcctcaccctagagagactggatttggagagttggacccccagagatttttctagaaattacttaccataggccaggaagcagcggtttattcggcgaaacgtcgaatatctgagggtccacaacgggttttcaacgaggtggttagtatagagatggcacataggacgttagggtggatagcatagacgatgtcggtgtcaagcgcgtcgactaaccgcgccgttaaggtaggctggcgggcgcgacactgtggaatgcagatggagaattctgtgcaaattaaaaccttgataactttgccttccggtcatgtaatcgagctaggtttttttttacggctgcagattcacgggcctcaccctagagagactagattttgagagttggacccctagagatttttctagaaattacttaccataggccaggaagcagcggtttattcggcgaaacgtcgaatatatgagggtccactgatgaactacttgcagagaacgcaaatcaaaggtagcgg

SEQ ID NO: 10079 - DNA, 712 bp, Oryza sativa
  unsure (1)..(712): unsure at all n locations
tggcgcnncnttggatggcttgccgatcgcacaggagctcatcatgcattccacactgtcgcgcccgccagcataccttaacggcgcggttagtcgacgcgcttgacaccgacatcgtctaacctatacaccctaacgggctatgtgccatccctatactaaccacctgttgaaaaccagttctggaccgtcagatattcaatgtttcgtcgtaccgaccgctgcttcgtggcctatggtaagtcatttctagaaaaatctctaggggtccacctctccaaatacagtctctcaagggtgaagcccgtgattctgcagccgtaaaaaaaaacctagctcgattcaatgaccggaaggcaaagttatcaaggttttaatttgcacagaattctccatctgcattccatagtgtcgcgcccgccagcctaccttaacagcacggttagtcgacgcgcttgacaccgacatcgtctaagctatccaccctaacgtcctatgtgccatccctatactaaccacctcgttgaaaaccagttgtggaccctcagatattcgacgtttcgtcgaaacaaccgctgtagatctactcgatcagctgtagatgtcaacgatacataatctatccattgaacacacttagatcgggtgattgggatagatcgggcgttatgccgagacagtataaatcactcaacaactaagtgtgccccan

SEQ ID NO: 10080 - DNA, 843 bp, Oryza sativa
cacaaaccacaaaggggggttgtttcttctcacaagggccaaaaaacagtagttgtttttgcaaaccgtcaaatatcggagggtccacagcgggttttcaacaggtgggttagtataggaggggcacatagcacatgggggtggatagcttacacgtgggggtgtaaaaggcatggactaccggccccttaaggaggcgctggcgggcgcgacattgtaaatgcagatggagaattctgtgcaaaataaaaccttgataactttcctttccggttaaagaatcgagctaggttttttttgacggctgcagaatcacgggcctcacccttgagagactgtatttggagaggtggaacaccagagatttttctagaaccgacttaccataggccacgaagtagcggttggttcggcgaaacatcgaatatctgatggtccacaactggttttcaacgaggtggttagtatagggatggcacataggacattagggtggatagcttagacgatgtcggtgtcaagcgcgtcgactaaccgcgccgttaaggtaggctggcgggcccgacactgtggaatacagatggagaattctgtgcaaattaaaaccttgataactttaccttccggtcatggaatcgagctaggttttttttatggctgcagaatcacgggcctcaccctagagagactggatttggagagttggacccccagagatttttctagaaattacttaccataggccacgaagcagcggttgtttcggcgaaacgtcgaatatctgagggtccacaactggttttcaactgatgtgctacagtgcgattagtaagcccattcgcc

SEQ ID NO: 10081 - DNA, 1180 bp, Oryza sativa
  unsure (1)..(1180): unsure at all n locations
nggcctatggaagtaattttctaaaaattctcgggggttcaacttctaaaaatctagtctctctagggtgagggccgtgattaagcagccgtcaaaaaaaacctagctcgattacatgaccggaaggcaaagttatcaaggttttaatttgcacagaattctccatctgcattccagtgtcgcgcccgcaagcctaccttaacggcgtggttagtcaacgcgcttgacaccgacatcgtctaagctatccaccttaacgtcctatgtgccatccctatagtaaccacctcgttgaaaaccagttgtggaccctcagatattcgacgtttcgccgaaacaaccgctgcttcgtggcctatggtaagtaatttctagaaaaatctctgggggtccaactctccaaatccagtctctcaagggtgaggcccgtgattctgcagccgtcaaaaaaaaacctagctcgattccttgaccggaaggcaaagttatcaaggttttaatttgcacagaattctccatctgcattccacagtttcacgcccgccagcctaccttaacggtgcggttagtcgacgcgcttgacaccgacatcgtctaagctatccaccttaacgtcctatgtgccatccctatactaaccacctcgttgaaaacccgttgtggaccctcagatattcgacgtttcgccgaataaaccgctgcttcgtggcctatggtaagtaatttcaagaaaaatctctgggggtccaactctcgaaatccagtctctcttgggtgaggcccgtgattctgaagccgtcaaaaaaaacctagctcgattccatgaccggaaggcaaagttatcaaggttttaatttgcacagaattcttcatctgcattccacagtgtcgcacctgccagcctaacttaacggcgcggttagtcgacgtgcttgacaccgacatcgtctaagctatccaccctaatgtcctattgccatctctatactaaccacctcgttgaaaaccaggtgtggaccctcagatattcgacgtttcgccgaaacaaccgctgcttcgtggcctatggtaagtaatttctagaaaaatctctgggggtccaactctccaaatccagtctctcttctgtgaggcccgtggttcttgagccgtcaaaaaaaacctagctcgattccatgan

SEQ ID NO: 10082 - DNA, 1838 bp, Oryza sativa
agttgtgaaccccaaataatcgaggtttcccgaaacacccgttgtttggtggccaatggtaagtaattctaaaaaaatcttgggggtcaacttctcaaaatccagtcttctttgtgtaaggcccgtggttctaaaccggtcaaaaaaacatagctcgattccatgaccagaaggcaaagtaatcaaggttttaatttgcacagaattctcaatcagcattccatactgtcgcgcccgccagcctaacttaacggcgcggttagtcgatgcgcttaacaccgacatcgtctaagcaatccaccctaacatcctatgtgccatccctatactaaccacctcgttgaaaaccagttgtggaccttcagatattcgacgtttcgccgaaacaaccgctgcttcgtggccaatggtaagtcatttctagaaaaatctctggggtccaactctccaaatccagtctctctagggtgaggcctgtgattctgcagccgtaaaaaaaaacctagctcgattccatgaccggaaggcaaagttatcaaggttttaatttgcacagaattctccatctgcattccagtgtcgcgcccgccagcctaccttaacggcgcggttagtcgacgcgcttgacaccgacatcgtctaagctatccaccttaacgtcctatgtgccttccctatactaaccacctcgttgaaaaccagttgtggaccctcagatattcgacgtttcgccgaagcaaccgctgcttcgtggcctatggtaagtaatttctagaaaaatctctgggggtccaactctccaaatccagtctctctatggtgaggcccgtgattctgcagccgtaaaaaaaaacctagctcgattccatgaccggaaggcaaagttatcaaggttttaatttgcacagaattctccatctgcattccacagtgtcgcgcccgccagcttaacttaacggcgcggttagtcgacgcgcttgacaccgacatcgtcgatcctatacaccctaacgtcctatgtgccatccctatactaaccacctcgttgaaaaccagttgtggaccctcagatattcgatgtttcgccgaaacaaccgctgcttcgtggcctatggtaagtaatttcaagaaaaatctctgggggtccaactctcgaaatccagtctctctttggtgaggcccgtgattctgaagccgtcaaaaaaaacctagctcgattccatgaccggaaggcaaagttatcaaggttttaatttgcacagaattcttcatctgcattccacagtgtcgcacccgccagcctaacttaacggcgcggttagtcgacgtgcttgacaccgacatcgtctaagctatccaccctaatgtcctattgccatctctatactaaccacctcgttgaaaaccagttgtggaccctcagatattcgacgtttcgccgaaacaaccgctgcttcgtggcctatggtaagtaatttctagaaaaatctctgggggtccaactctccaaatccagtctctcttctgtcaggcccgtggttctgaagccgtcaaaaaaaacctagctcgattccatgaccagaaggcaaagttatcaaggttttaatttgcacagaattctccatctgcattccatactgtcgcgcccgccagcctaacttaacggcgcggttagtcgatgcgcttaacaccgacatcgtctaagcaatccaccctaacatcctatgtgccatccctatactaaccacctcgttgaaaaccagttggggaccttcagatattcgacgcatgtgggtcccggaggtcaaaaatttaattattgaggttttataatcccc

SEQ ID NO: 10083 - DNA, 847 bp, Oryza sativa
  unsure (1)..(847): unsure at all n locations
nccctatactaacacctcgttgaaaaacagtggtggacctcagatattcgacgtttcgccgaaacacccgctgcttcgtggccaatggtaagtcatttctagaaaaatctctggggtccaactctccaaatccagtctctctatggtgaggcccgtgattctgcagccgtaaaaaaaaacctagctcgattccatgaccggaaggcaaagttatcaaggttttaatttgcacagaattctccatctgcgttccacagtttcgcacccgccagcctaccttaacggcgcggttagtcgacgcgcttgacaccgacatcgtctaagctatccaccctaacgtcctatgtgccatccctatactaaccacctcgttgaaaaccagttgtggaccctcagatattcgatgtttcgccgaaacaaccgctgcttcgtggcctatggtaagtaatttcaagaaaaatctctgggggtccaactctcgaaatccagtctctctttggtgaggcccgtgattctgaagccgtcaaaaaaaacctagctcgattccatgaccggaaggcaaagttatcaaggttttaatttgcacagaattcttcatctgcattccacagtgtcgcacccgccagcctaacttaacggcgcggttagtcgacgtgcttgacaccgacatcgtctaagctatccaccctaatgtcctattgccatctctatactaaccacctcgttgaaaaccagttgtggaccctcagatattcgacgtttcgccgaaacaaccgctgcttcgtggcctatggtaagtgatgaactgctgtaccacagatgatgcgccaactnnnnnacacatcct

SEQ ID NO: 10084 - DNA, 773 bp, Oryza sativa
  unsure (1)..(773): unsure at all n locations
ccgttnnnangatgaagtaccacnttatggaacagcncatcattagcagcgtctacacgaccaacagaaaagaaaaggcttttactctaataaactccatataacaagcagcaacaaagcacattaatgggttcttgacttcttaccataggccacgaaacagcagttgtttctgcgaaacgtcaaatatctgagggtccacaactggttttcaacaaggtggttagtataggaatggcacataggacattagggtggatagcttagacgatgtcggtgtcaaatgcatcgactaaccgcgccattaaggtaggctggcgggcgcgacactgtgaaatgcagatggagaattctgtgcaaaataaaaaccttgataactttaccttccggttaaggaatcgagctaggttttttttgacggctgcagaatcacgggcctcacccttgagagactgtatttggagaggtggaacaccagagatttttctagaaacgacttaccataggccacgaagtagcggttggttcggcgaaacatcgaatatctgatggtccacaactggttttcaacgaggtggttagtatagggatggcacatatgacattagggtggatagcttagacgatgtcggtgtcaagcgcgttgactaaccgcgccggtaaggtaggctggcgggcccgacactggggaatacaaatggagaattctgtgcaaataaaaaccttgtaactttaccttccgggcatggaatcaagttagttttttttatggt

SEQ ID NO: 10085 - DNA, 818 bp, Oryza sativa
  unsure (1)..(818): unsure at all n locations
agggccatctctatactaaccacntgttgaaaacccgttgtggaccntcagatattcgacgtttcgctgaataaaccgttgcttcccggcctatggtaagtaatttctagaaaaatctctgggggtccaactctcaaaatctagtgtctctagggtgaggcccgtgattaagcagccgtcaaaaaaaacctagctcgattccatgaccggaaggcaaagttatcaaggttttaatttgcacagaattctccatctgcattccacagtgtcgtgcccgccagcctaccttaacggcgcggttagtcgacgcgcttgataccgacatcatctaagctatccaccctaacgtcctatgtgccatccctatactaaccacctcgttgaaaaccagttgtggaccctcagatattcgacgtttcgccgaaacaaccgctgcttcgtggcctatggtaagtaatttctagaaaaatctctgggggtccaactctccaaatccagtctctcttgggtgaggcccgtgattctgcagccgtcaaaagaaacctagcttgattccatgaccggaaggcaaagttatcaaggtataatttgcactgaattctccatctgcactccacagtgtcgcgcccgctagcctaccttaacggcgcggttagtccaggggcttgacacggacatggtttaagctatccaccccaacgtcctatgtgccatccctatactaacctcctcgttgaaaacaattgtggacccctaaatatttgacgtttcggcgaaactacccctgctttcgggcctattggaaggaaagtctagaa

SEQ ID NO: 10086 - DNA, 6562 bp, Oryza sativa
  unsure (1)..(6562): unsure at all n locations
naatctgagggtccacaactggttttcaacgaggtggttactatagggatggcacataggacgttagggtggatagcttagacgatgtcggtgtcaagcgcgttgactaaccactccgttaaggtaggcttgcgggcgcgacactggaatgcagatggagaattctgtgcaaattaaaaccttgataactttgccttccggtcatgtaatcgagctaggttttttttgacggctgcttaatcacgggcctcaccctagagagactagatttttagagttggacccccagagatttttctagaaattacttaccataggccaggaagcagcggtttattcagcgaaacgtcgaatatctgagggtccacaatgggttttcaacgaggtggttagtatggagatggcacataggacgttatggtggatagcacagacgatgtcggtgtcaagcgcgtcgactaaccgcgccgttaaggtaggctggcgggcgcgacactgtggaatgcagatggagaattctgtgcaaattaaaaccttgataactttgcctttcggtcatggaatcgagctaggttttttttgacggcttcagaatcacgggcctcacccaagagagactggatttcgagagttggacccccagagatttttcttgaaattacttaccataggccacgaagcagcggtagtttcggcgaaacgtcgaatatctgagggtccacaactggttttcaacgaggtggttagtatagggatggcacataggacgttagggtggatagcttatacgatgtcggtgtcaagcgcgtcgactaaccgcgccgttaaggtaggctggcaggcgcgacactgtggaatgcagatggagaattctgtgcaaattaaaaccttgataactttgccttccggtcatggaatcgagctaggtttttttttacggctgcagaatcacgggcctcaccatagagagactggatttggagagttggacccccagagatttttctagaaattacttaccataggccacgaagcagcggttgtttcggcgaaacgtcgaatatctgagggtccacaactggttttcaacgaggtggttagtatagggatggcacataggacgttagggtggatagcttagacgatgtcggtgtcaagcgcgtcgactaaccgcgccgttaaggtaggctggcgggcgcgacactgtggaatgcagatggagaattctgtgcaaaataaaaccttgataactttgccttccggtcatggaatcgagctaggtattttttgatggccgcagaatcacgggcctcaccctagagagactagattttgagagttggacccccagagatttttatagaaattacttaccataggccacgaagcagcggttgtttcggcgaaacgtcgaatatctgagggtccacaactggttttcaacgaggtggttagtatagggatggcacataggacgttagggtggatagcttagatgatgtcggtatcaagcgcgtcgactaaccgcgccgttaaggtaggctggcgggcgcgacactgtggaatgcagatggagaattctgtgcaaattaaaaccttgataactttgccttccggtcatggaatcgagctaggttttttttgatggctgcagaatcacgggcctcaccctagagagactagattttgagagttggacccccagagattttactagaaattacttaccataggccaggaagcagctgtttattcggcgaaacgtcgaatatctgagggtccacaactggatttcaacgaggtggttagtatggagatggcacataggacgttagggtggatagcttagacgatgtcggtgtcaagcgcgtcgactaaccgcgccgttaaggaaggctggcgggcgcgacactggaatgcagatggagaattctgtgcaaattaaaaccttgataactttgccttccggtcatggaatcgagctaggttgtttgtcacgaccggaattgacccaacgggcgttccttacgtgcgtgtattattccttgtcccaggaggcaaggtacaccaaaaattgatacatttcagagtttatcaagcggaagcgtaaatagttaatttattacatgggcggcgaaggcccagcacacacaaagacaaacgagaaacagcggaagactagggtgacgaccacaggcacttgacagcaggcacgagctagacaccaaagccttcatcttccaggggctcctcttctgggtttgggaaaaattgagcaagactgagtacaaccaccatactcaacaagacacacccacaagtgcaggataaatgcaggggagtacaagggggttgtaatataaagggttaggttttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccaactcgtcccaagccaacccaggccaaccattccacattttagttgttaagcaggttttaagaattaaaacactaacttgggtacattgctcggcttgcccataaccgagggcgtggctattcgaatagattatactctgatcagaggtgtacatctttacccacaagacacatcttcctcacgtgtaaccacgtgccgcataccaccacggtatacggacggaagacgtgacatagtttccaacccatcctagccatagacaagagtaccgacccaaccccacctacggccagaacccccgggacaggtaggcaggactgagcctctagtagcaggacaccagccctgtgccatgacatctcggctaccgggccgcagctcgtgtagccttcatttgtcctagagatgtccatcgacccgagccacaaactaagccttacccactagacatgtggaagtacggtagcgctttgcaacagaggcccgaagaccggtccttatatggccgaggtgctactatcaaaaccatgcaccccgagcccaacctaaaactattttgagggttttgaatagagggggaggtgtgaatccaattccacaatgatccaacaaatccatagtgtccaggtgatgagaatattcccaaagtctagagttgtaaaaccacctaatgttgcctaattaaccagcgaagcatctacctaaattcatactagtggtaccatgagtagagtgtccactagttggggttttgtttattctaggatgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaccgtcggcttcaacttccacgtagagcggatcttccgaagctgcagcgtctacacaaccaacggaaaagaaaaggcttttactctaataaactccatataatgagcaggaacaaaggacaaaaatgggttcttgacttcttaaggaaaaattagagacttgaacggtccaattccgagttcaaatggccaagttatgaccatttgaagtttatatgctctttaaatgaatatttgcgaatttcttcatttaaattttaattttaaaagggtttattgcgtcagccgaggggaggggcgcgcggaccgggtccacgggagtggggcccacgcggcagcctcacggtccacggtggaccaggtgcacccgggctcacaccagccggcgccgtgggccccacgcgtcagccgcacccgagggcgcgagcggctgacggccgggccccacgcggcagccgctcggtgcgcccgaaggcggccacggcggagcggcggccgagagaagggagggaaagggggaaacgaggcggcggtccacggctcaccctaggtcgacggcgacgacgaaaaggcggccggagcggaggaaggcggcggcgtggttcgggtcgacagggacggcggcgctccggcggtcgacgagcgaaatggaggggtggacgaggtcggcgaggatgcggcgaagccgaaagaggcggcgccgaggtgggaggtggtccggggcgacgacgacggcggaccggagctcggcggtgatggcgaagagagagagcgacggcgcgagctcgattccggcaaggaggaagggcggcgagaggcggaaacggacggaggaggtgcggggagggtttatatagggttggaagggggagagagcggccggcggggaaggaataggcgcgggaggtccggccgccatcaatggcgccggcgagatttgcgggggcaaatccgcccgtttgaacgcgaggaagagaggggaaaatggggggaaagggtgagggaatcacggggaataattcccccctattgattgcacgcggggaataatcaggcgggaataatggcaggcgcgacactgtggaatgcagatggagaattctgtgcaaattaaaaccttgataactttgccttccggtcatggaatcgagctaggttttttttgacggctgcagaatcacgggcctcacctagacagactggatttggagaggttgactgtcacgcccagaaattctcgaatagaattccaagcagaatgtgcattaaaacccccgtccaggaccggccggggtacacaaacgatgaaattgacatacagatccacgtcttacaaacatcagaaaagtcttacaagaatgcagcggaaaaattaaaaggtaactggagctaagccttgacttggaccgcagcgggaacaccactccacaggcatcctcgacggcacggacgaagcctactcctcggaaaatccaccatcggacgcatgctcaaactctgaggtttggggaaaaagagcaagactgagtacaaccaccgtactcagcaagtcataccggaatagggggtatgatgcaggatatatccaaaggataggtagagcgattcatttgcataaagtgagcatttataaacagtagttgaaagcagtaaaaatagttgtaataattaatcaatattaatcatccactgttcaatgctatcccacgttgcaacaggcccaaccctccacctgaactaatcaatttcactagactaagctaggatgagactaatcacggtgaacctggttgaccgcgcataaccgcgggtatggctattcgaatagttttactctgatcagagatgtacaattgtacccacaagacacagccccacgacacgtttccgtgcaccgacatgccaccatgacataccggaaagaggccgtgacaggacctttcgcataaccccctctaaccaagcacaccacacctcaggtttcacccccactcctcgcaaggaagcgggcagtcccctctcgtgcctaggtgaatccggaagccgcataagtcgtcgcagggcccatccaaactccatcacgcccacccttccctggatgcgtcagctagaggaaagcaacactacaagcccagccgttgcccacactggcttgtggtaagtacgataagttcttccagggcatcccgcgaaccggtccttgattgccatgggtgcgactagcaaaaccatgcacccacagcccaccatttaatatatttaattaaccatcactagagcggtggcactaatccaacatcaacactagaacctgaagtctatgcattaatgtgattccccattgtgtgctagttgaactaagcatggctaagcaatccctaatccaacttctagtcatgattcaacccaagctaccaaaggaaatgatggtacaacaatcatatagccgagtacaataggtaatataccatacagaatcattgtaaaacaatgcataacttagagagaataaatgagaatttgcaatataggatcaatatgatcaagagacaagcatgacttgccttgctctgttgctggagggacctcggtgactatttcaaagtacaccggagcgtcgggagagccggaatctaagcgacatacaaagcaaacaatacaaacaggccataagactactgaaacagagaacaaaatcatttttaatggattctatgcatttttcttgatttactgagacttgaatgggcttaaacggagctcggatgaattttctatgaattttagaaggtttactgtgctttaactataaacagaaaagccttaaatgatttattgcgcaataattaaaaccctggagagagaggaggcggcgccgacaggcggaccccacatggcagtggctcggggtggcggtccacggtggaccgggtccatggaccggggaggaggcggcacaccacgtggtgcacacgtggcgccgacgcggcgcacacgtggcggtcacgtggcaaccacgccggcgggggggttggaccgccccgatctaccaccccggagattcgacg

SEQ ID NO: 10087 - DNA, 30963 bp, Oryza sativa
  unsure (1)..(30963): unsure at all n locations
ngcggccatggcgatggccggcccggcaccggcggtccaaggcggcgaccgacaaccggcaaagggtggcggcgtcgcgccaacgcgaacgccgacagcggcgattaagcggctagcgggcccggagaggaagagaaagggaagnaggtgtctcaccgaagcccgtccgccggttgccgtcgtcctcccgtggcttgccatcgccgttcgctgtcatcttcctccgcgccggccaccctcggtgaggcttcctctcccctctattcccctccctctccttcctagccgccgcttagcgccgccgccttcgcgtcgcctttgcgccgtcgcctccgccaccggttgccgtcgctggcaacgcgttcgcgcgcgcgcgccgtcgccatcgccgtggccggtcggctggccttgagccgagccgagccgggtcgccaccgcccgtccgatcggccccgggtcgatccgggccatcgatcctgtggaccggcggtggaccacccgcgtggtcccggtccacggtggaccaccccccctttgagccgctgccgagtggggcccgtttgccggcgccccttttccctctctcccgagccgctgaccggtgggccccgcatgtcggcgccgcgccccccttgatgacgtcagccctgggaattattgcgcaataaatgatttaatgactttttgttatagtaataaacacagtgaatcttctaaaattcataactaattcatccgagctccgtttaagcccattcaagtctcagtaagtcaagaaaaatgcgtagaatccattaaaaatggttttgttccctgtttcagtagtcttatagcctgtttgcaatgtttgccttgtatgtcgctagattccggttcctccgacgctccggtgtacttcgaaatagtcgccgaggttcctctagcagcagagcaaggcaagtcatgcttgtcacttgaacatgttgatcctatattgcaaatgctctattgtttttcttcaaatattgcattgttttataatgttactatggggtgtttacctattgtcatagccatgctattgttgtaccatgtccctttgtcagcttggggttataacatgactagagattggactagggattgcttagccatgcttagttcaactagtgcacaatggggaaaattctattaatgtttagactgttggttctaatggtattgttggattagcgccaccgctttggtgttggttaattaaaataaatcacatggtgggctgtgggtgcatggttttgctggtcgcacccatgacagttaaggaccggttcgcgggatgccctggaagaacttatcgtacttaccacaagccagcgtgggcaacggctgggcttgtagtgtagcttacctctagctgacgcatccaggcaagggtgggcgtgatggagcggggcgggccctgcgacggcctctgtcgcttccggattcacctaggcacgagaggggactgcccgctgccttgcgaggagtggcggtgaaacctgaggtgtggtgtgcttggttagagagggttatgcgaagggtcctatcacggcctctttccggtatgtcgtggtggcatgtcgacgcacggaaacgtgtcgtggggctgtgtcttgtgggtacagttgtacacctctgattagagtaaaactattcgaatagccgtgcccgcggttatgggcggtcaaccagattcaccgtgattagtctcaccctagtgtaatctttagaatttggatagtataggtggatggttgggcctgtcgcaacgtggcatagcgttggacagtggatgattaatattgattaattattacaactgtttaaatcttccaacttctgtttataaatgctcgctttatgcaaatgaaccactctagctctcctttgataattccctgcatcatacccctattccggtatgacttgctgagtacagtgggtagtactcagtcttgctctttttttcccaaccccagagtacgagtgtgtgtcagatggaggtttctccaaggagtaggcttcgtccgtgccatcgaggatgcctgtggagtggtgttcccgctgcagttctagtcaaggcttagctcctgttgtctttcgcttttccgctgcatttatgtaagacttttatgatgtttgtaagatgtgggtctgaatgtcaacattgtcgtttgtgtaccccggccggtcctggacggggattttaatgcacattctgcttggaattctattcgggaatttctgggcgtgacagaagcggacggcgtggccctcgggctcgcgaacgcgacggcgttgacggcgtggctcggtgcagtagctagcgatggctagcggcggccgaagatggctaaggcggcagcggcggcgggtgcacggcgctagggcggtagaggccatgggtgagctcggtgaaatggggaaaaggatagggggaggggcgatgatgcttaaataggggaagagggggccggacatggccgagagacgacgggagaggtggccgacgtgggggagtgggagaggagagagaggcgggattcgaaaatagagtcccggccatctcatgggcgcgggcgagcaggagagagagggagtgggcgcgggcggcgacgtgggcgacgtggcccgagagacgcgggagcgagcgggtggcggttgcgggatgcggcggcgccggctggaggtgggagacgggcccgacaggtggggcccacctgtaggtgaccctaggggaggaggagggggcgcgggctgagctgggccgtggcctccggccggcctagcaaggcgcaggagagagaggagggggaataggccggcggcccattaagggaaaaaggagggaaaaagaaaagaaaaagaaagaaatgaatttgcagggatttaaataatgcttgtgctcatttttagttgattaaaattatttctagagctctgaaaattccactaaaaatcttgttagcatatttcgacatgtagaactcaagaaaaattctacgtgccaattccgattattatttgcattaatttattagggtttcactcttgcttttacaccgatatttttcttgagaccatttattaattcattttaggcttgggagaagaacttcagggtgtgacatggacccccagagatttttctagaaatgacttaccataggccacgaagcagcggttgtttcggcgaaacttcgaatatctgagggtccacaactggttttcaatgaggtggttagtataggaatggaacataggacgttagggtggatagcttagacgatgtcggtgtcaagcgcgtcgactaaccgcgccgttaaggtaggctggtgggcgcgacactatgtaatgcagatggagaattctgggcgaaattaaaaccttgataacattgccttccggtcatggaatcgagctaggttttttttgacggctgcagaatcacgggcctcaccctagagagactggatttggagaggtagacccctagagatttttttagaaatgacttaccataggccaggaagcagcggttgtttcggcaaaacgtcgaatatctgagggtccacaattatagtagcccccgactgataactcaaggaagaacttgatgttagcagtcaaagaggaaaataccaaaaaatagtgcctaagcataaaaacgacggagatgctcgatattccaagagttgtcaacatgagtactgtcttcacgcttgagtcggtatgaatctggccgagtaacttcagaaattatgaacggtccttcccataaaggagataacttgtgccgatctcgtgtagtttgaattttcctcaaaaccaggtctccgactaagaaagctcgtgatcgaacgttgcagttgtgataacgtcgcatcccttgtaaataccaagccgactggattaaggctgcttcacgggcttcctccaatcggttgagatcatccactcggttttcttcgtagcgctcctctctggagttacgaaatcataaagactcaaattctacctcagtcggcaacattgcttccgcaccataaaccaaaaagaatggtgactggcccgtagcccgactgggtgtagtgcgtagggaccaaagtacagacggcagctgatccacccatttgccagcgtagggacgcagttggtcaaaaactcgtgcttttattccttggagtaccataccattggcgcgttcgacttgtccattgctcataggatgcgctacggaggcatagcagattttaataccaaagtcttcatagaaatctttaaatactccgccagtgaactgagtaccattatcggtgatgatccaattggatactccaaacctgtgcacaatgttaatgagaaaatctctagccttgtctgctgtaattgtgacgactggtttggcttcgatccagttggagaatttatcaatagctacaaagagatgagtataaccaccggttgcctttttgaacgggccaaccatatcgagccgccaaaccgcgaacggccaggataatgggatggtttgcaactcctgagctggtagatgagtctgtcgggcaaaaaattgacaaccctcacacgtccgcacaatcttgtcagcatcggatatggcggtaggccagaaaaaaccctgccgataagccttgccaatgatggttcgcgcagctgcatgattgccgcagatgcccgaatgtatgtccgttagcaattgcctcccttcctccaaagacacgcaacgttgcagaatccctgacggacttttcttgtacagttcagccctatgcatgatgtaaagtttgcttcacctggaaattcgcttggcttcgtctttatcttgagggagttcttgcttagttaaaaatttgatgaagggctctctccagtcggcttcgagcatgttcacttcttgagtgtccgtggcatcggttgtttcttttcttggtacggtcagttcataaagatgttcaacgaacacatcggaaggagctgcttctcgttttgaaccaaagttggctagtctatcggctgcctcattattgtgtcggagaacatgagttagctcaaggccatcgaacttgtcttctagtttgcgtacctcttgccaataggcagtcatattatcatcgaggcaggaccactctttcatgacttgattaacaaccaattgagaatctccatgaactgtcagacgccgaattcccaaagaaatcgcaatccttaatccatgaagaagcacctcatattctgccacgtaatgggacgcagaaaaatgtatccacaacacgtacctcagccgttctccagtcggggaaatcatgacaactcctgctcctgtgcctgaaagcctttttgacccgtcaaaatgcatagtccagtactcctccttttccacagttgtgtcttcctggcattcggtccactcggcaacaaaatctgctagggcttgggacttgatcgaagttcgtggcttgaaggataaatcaaaagacattaattctaaagcccactttgtgatccgtccatttgcctcacgattgtgaagtatgtctccgagtgggaacgatgtgaccaccgtgaccgagtgactttgaaaatagtgagataacttcctaacggtaattaaaacaccatataacagcttttgtacctgaggatatctggtcttggagttggctaaaacttcgctgatgaaataaatcggccgctggactttttgaacatgtccatcttcttcgcgctcaacaaccaggaccgtgctcacaacctgagaagttgccgatacgtataacaacaacggctcttgtgggtgtggtgaagctaagaccggtggagtggtgagaagtttcttgaagtcttcaaaggctttttgcgcttcgggtccccactggaaattgtcggttttcttcaatagcttgaaaaagggcatcccccgctcgccgagtcgtgagacaaatcggcagagcgccaccatgcacccagttagcttttgcacgtctttctgggaactcggcggtttcatgttgaggatggcattgatcttctccgggttccctatgggataccataaagccaagcagcttccctgacggtactccgaagatgcatttttcaggattcaacttcatcctgaatgtgcggatgctcacaaaggtttcttctagatccgcagtcaaatcgtccttctgcttggttttgacgactacatcataaacataagcttcaacgttgcgaccaatctgtcttgaaaagcatctctgaatcatgcgttgataaattgctcctgcgttctttaatccaaaaggcatggtgatgtagcagtaggccccgaagggtgtgatgaatgaagtcttcaggcagtcggactcctttagtcggatctgatgatatcccgagtagcaatccaaaaagctgagtaactcgcagctggccattgaatcaaccacctggtcaatgcgaggtaatccaaaaggatctttgggacaagattagttgaggtcggtataatcaacacacatatgccattgtcccttcttcttccgaaccaggactgggtttgccaaccagtcaggatgtaggacttccttgatgaagcctgctgctaacagcttggtcaattcctccttgattgcatccttcctatcctgtgcaaaacggcggagtcattgcttaatgggtttagcgtcttccttaacatgtaaagagtgctcaatcacctctctgggaatactaggcatatcagatggtttccatgcaaagatatctttattattttgaagaaaggtgatgagcgcgctttcctatttacaatctaactcagcccctattacagcagtcttagtaggatcagagggatctagaggaattttcttggtcttggtgtcgctttctccgctctttgacatcttggttgcaggcacttctccttcggttgcagttgacgcggccagtcggatttcttcttgagcgagcgtgatctcacggttctgggccatctcacaactttccttatcgccggtaacggcttgcttgatatcgctctgcagggatataactcctcgaggacctggcatcttcatcatcatgtaggtgtaatgtgggacagccatgaacttggctaacgcggggcgtccgagtatggcgtggtacgctgtctcgaaatctgcgacttcaaagcaaatgttctctgtgcgaaagtctcccgagtgccaaaggtgactggcagagtgatctggccgagtggagtagcagatagcccggggatgactccgtgaaagggcgcactactcggcttcagctccgtccgagggatctgcatgtcgtccagagtcttggcgaaaaggatgttgagtgcgctgccaccatcgatgagagatcgtcggagcttgacgttgcaaaccactgggtctagtactagggggtaccgccccgggtggaccactcggtcagggtgatctgagcggtcaaacttgatagttgtctctgaccaccgaagatattggggcatatcgggctaaacagcattgatctcccgctcggtgagcttttgcttccgcttggattcataagctagaggtccgccaaagatgtggttgagctccttgcgggagtcttgaaaaccagtcggggcatcatctccatcgtccttcttcttcgacatgccttggtctccatcagtcggcttgcgtgcgttcttggcgtattgctctgcgacctgtttgtagacgaagcaatctttggccgcgtgattggaatttgggtgatgtggacattgggagttcatgatcttgttgaaagtgttgacgcgcgaacgttgccgggaggatggtgtggtagttgctacaagttcctcgggcttacgcttgtgatccttgtgattggtactgttaacagtgaaatttggtaagcccaaagttaccatcggcttagagttagtgtcggcttcaaagttctagaattagccgatgggagtcaagtcgccacgatgtcgtgttcttggttgagtcggatcaatcaaaggaagattatctagaagagtccgagttcaagacggatgcgacatgacagtttatctattaattaggcatagtttgttagtttccttttatctttaggaaagtgtgtttagtgtccgataaggattttatcttttcctttttagtttctttcttgtccgacaaggacttgtatcaacccatgggtataaatatgtacacccggggtctatgtaatctatctcttgatcaatacaatttggtgcatcgccaccctttttacttctacttttgtttttacgttccgtcggaacttggcacccgacgcggggctgcatcgtcttcaatctccggcgaagggataagtccaatgtttcgccggtccaggcaattgtatcatctacgtcagcgtcgttcaaggctgcatcaatacattcgacctcttgaattgctctggtttggatgatatatttgcctacctatttatcatatgtctctgttaatctagtcttagcatatcaatttagctctatcggctgcttctcgttttagggtttatgtcacgtcccaaaacgactctaaaatacatcctctaaattatgcctagaataattaaaatccttgtgaaaccctccaaaaattaaaatgtgcaaagtaaaagtcaaataaggcttagaggatttttgtatatttcctaaaagcctaaaatgcgtaaataaatattagtggaattttcagagcacaaataataattaagaagaaataaacaaagttgagaaagttttataaaaagaaaaaccctaaaaatcctccttccctctcttgggccgaatccggcccatctccctccccctctctcctctcccccgcggcccatccggcctctccccgcgcgcgcgccgctgacgggcgggcccgcctgccaccctcgctgacgggtggggcccacccgtcatccccgacctcccgctgctcccgccgcctcgcccgcgccctagcgccgccgccgccgcgaatcccgccgcctcccaccgtccccgcgtgcaataaagtggggggaattaatccccgtgatcccctctccctttccccccatttttccctctctctctcgcgttcaaacgggcggatttgcccccgcaaatctcgccggcgccattgatggcggccgacctcccgcgccggtttccttcctccccgtccgccctctcccccttccaaccctatttaaaccctccccgcacctcctctgtccggttccgcctctcgccgcccttcctcctcgccggattcaagctcgcgacgtcgctctctctctccatcgtcgccgccgagctccggtccgccgccgtcgttgccccggaccgtctcccgcctcggcgccgcctccttcggctttgccacatcctcgccgacctcgtccacccctccgtttcagtcgccgaccgccggagcgccgccatccccatcgacccgagccgcgccaccgcctccctccactccggccgcctcctccgtcgccgccgtcgccccggggtgagccgtggaccgtcgcctcctttcccccttccctcccctctctcggtcgccgctccgctgcgccggtggtcgccggcggcgaccatcagggcgcgggctcgccgcctcccgccgaccgcgccggcatggccgccctcgggcgcgccgagtggctgccgcgtggggcccgaccgtcagccgcccgcgcccttgggtgcggctgacgcgtgggacccaccgcaccggccggtatgagcccgggtgcacccggtccaccgtggaccgtgaggctgccacgtgggccccactcccgtggacccggtccgcgtgcccctcccctcggttgacgcaataaaccctttttaaattaaaatttaaatggagaaattcgcaaatattcatttaaagagcatataaacttcaaatggtcataacttggccatctggactcggaattggaccgttcaagtctctaatttttccttaagaagtcaagacccatttttgtgctttgttcctgcttgttatatggaatttattagagtaaaagcccttttattttccgttggtcgtgtagacgctgcagcttcggaagatccgctcttcgtggaggttgaagccgacatttgggaaagcgagcaaggcaagtcacatcatccttgaacatattggatcccattttataaaattattttgatttaaattattgcattaccgctttacttaaattcccgcgttatcactgttttatttatccatgcctatttgcctttgttatgaccttattattagtgttattgatattattaccttgttcaccctagattaaacaaaaccccaactagtggacactctattcatggtaccactagtatgaatttaggtagatgcttaggcaacattatgtggttttacaactctagactttgggaatattttcatcacctggacactatggaatggttggattattgtggaattggattcacacctccccctctattcaaaaccctcaaaatggttttaggctggactcggggtgcatggttttgatagtagcacctcggccatataaggaccgctcttcgggcctctgttgcaaagcactaccgtacttccacatgtctagtgggtaaggcttagtttgtggctcagtctagttataaacaaaagtacacggatggagatggacgaaatcgggggttgatggacatctctagggcaaatgaaggctacacgagctgcggcccggtagtcgagatgtcatggcacagggccggtgtcctgctgctaggggctcagtcctccctacctgtcccgggggttccgtccgtaggtggggttgggtcggtactcttgtctatggctaggatggattggaaactgtgtcatgtcttccgtccgtatgccgtggtggtatgcggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggaccgtgtttacaaagtagttttgagcaactaagtgacttttaatgctgtttactgcaaaccctaaccctttatattataactcccttgtactcccttgcatttattctgcacttgtgggtgtgtcttgttgagtacggtggttgtactcagtcttgctcaatttttcccaaacccagaagaggagttcctggaagatgaaggctttggtgtttagctcgtgcctgccgtcaagcgcctgtggtcgtcgccctagtcttccgctgtttttcgtttgtcttctggtgtgttgggccttcgccgcccatgtaataaattaactatttacgcttccgcttgttgaactctgaaatgtatcaacttttggtgtaccttgcctcctgggacaaggaataatacacgcacgtaaggaacgcccgttgggttatttccggtcgtgacagtttatgccggtatcagctaaatcgtgttgctagattacattagcttagacatctaccaccctgaaaactcagtcaatggcttgattgtctagatattatgtttcttttcatacttagtgctgcatcagttaagtttgatctactaagttgtgcttagaaccataatctctagcctgcttcttgattgccaataagggtttcatcggggtttcagccggtgagttatctagacgttgcatcggctaataaggattgcatatacatataagttggatttagccgatgacaacaaagtttcactgtttaatctaatcttgtggatttcatgacatcggacctccagccgatgtgtgctttaaccttcggatcgatgcttatttatttgccgattggtttatactggattatcttgttattttattacatcatcatcagccgatttcctttatatcatcatctacattagacatatagccgattgcttaaaccctatcgctatcggctggtatcggcatcggctattatcggctatcggctggaactactctatcagcttgtcagccgatcggctgttttgtctactatttgcatatcttgtcaattgcaggatcaaactgactggcacgcccgcatctcatcaagatttggacctgcacaggagctaagcagatctcctaggccgccatgttcgattttttcgtcaacaggtacttccactcccccctgtagtcggcgcatctttctttggcttccaggtgctgcccgactgcttggatgcagtgaccgcgtcttcggctttggcatactcattggctttctcaaacatctacttgactgtcctaggaggtttgcggccgaatttgccgactaaaagctcatgacgaatgcccttggtgaaggcggcgatgatgacgtcatcggtgatgttgaagatcttgttgcgttgcttagaaaaacgacggatgtaatctcgaagggattctccgagcttctggataatgttatagagatcaaactgggtgccagggcgttcaaaggtgccttggaagttggcgatgaagtggtcgtgaagctccgcccaagatccgattgtgccacggggtagcccgtggagacaggaccgggtagaatctgctagagccacaggcaggtagtttgccatggcttttgaaagtgcatctaggacccctcatttattttggtgttaatgataacacaattagaggttcactaatgctctttgttgagatggatgcaaggataaaaaggagtggaacttgagtttaaaagtattgtggcatcttttgtggtaattgtcttctaatccatgtatatcttgtgttctttagtattaggatgtcatactattaagagggataccacatgcttataattggtagaacactagtgctcgaaatcctgtttttgaagtgttcttgttcttctcctgtcggactatccgatcctgatcagactatccgatgctcagactatccgaaatttctcaaaactttgctctctgtctttggtctgggtgttggctcaaaaatattggactatccgatataaggtcagattgtctgatacatcggactatctgaaatttctcagaacttcactctctgtgttgaattgctttttattcctcttgagtgatttttttctctaagtcaaatcagactatccgatgtaatcggactatccgatgatacagagactccaaaattcaatggaacttgagtctctgtgaggatgaagattttgcttcaaaatatcggactatccgacatgacttcggactatccgacatgtcagatagtctaaaattctccagaacttcgttctctgtctctggctagtttgggacgcaaaaacatcgaactatccgatgtcatctcggactttccgaggtgggatgaaaagatttccttcccaatggccacatttcgggggcatctataaataccccccacctaacccttttctagggttacccaactcattcattcacattcactttgggttgagcttggtgctaaggtgctttggatctttgagctctttctccctctctcaaatccctcctcgttctttgtgtggtggatcttggtggttctggatttggtgtttgagggcctagtgtgtgtttcactcgatcttgagcactagggtttgaccaagagttgtgtggtgtttgctactcttggaggttgaggactcctagatggctaggtgttactcccgagcctctgatctacgtatggttggccgggagaagtttgtaaaggccgaatctcgcctctgcaaggaaagagataccccttagtggaaggaggagtgcttagtgcaacctcttgaggaaagggttagcaaagacccggctcttagtgagctcctcaacagagagtagaatcccctcaaggatttgaactccgggaacaactcggtgaacttcattgttggtgatatctcttcatcccctatttagctttgcttattgtgccgctatagatatagtcgctgtttgcgctatactcttgtttgtgcactagatctacttcatgtgtttctttagtggatcagacagtctgttccaacatcagactatctgatatttttggatagtctgactgtggatcagactttccaaccctaactcagttttagcttccgcataaagttttaaattagcctattcatcccttccctctaggcctaattgaccctttcagctttgttgtctcctcctgctgcgcggattgcgagaccgtagacggtgagccaagattcagggttagtggtgccgtcatacttctcgattccagtcggcttgaagccagccggccaatccactcgacgcaggtcgtttgtgaaggcagcaactccatccacatcgtcatcgtaacgatctggtgaatggtgggggttgtagcctcttgtcgcgcgacgctggttgatggtctcgcgaagatcgatgggacgcctgcggtgtggggagtgggcacgttcagctcgacgctccctatgccggtcagggggcgagtggacagatcgttcgctgtgatccctgctcctgcgattggatccctcgccgacgacactaaggcttggttggtgatagtcttgagatcgaagaggtggaactcggctgccggtcggcgtgcggatgctcgtggagttaactgggaccgagacggtgatcatggccttggtctagttcaagatgttgacgacgtgatcggcctgattgagtgcgccttccttgaggagggtatcgaggagggtgatcgctgcaaccgtgttctgctgaggggtgcgaaaaaccatcgtcccctcgacatcttgttgcctgatgagttctcgtgctcgtcgcccggattccaaggtgcgctgtcgtcgatcctcagcctccttcgcagcccgctcgcgatcttgttgttcacgctgcaatcgttctcgctcttgtcgttgtcgttcttcctccagtcggtgacgttcagcttcttgtcgtgtgcactcttcttccgcttctcgggttcaccactgttccgccgtctcgttgtcggccatgaatacgccaaagaagagaggcgtgtagtcgtcttcgtagctttcgtcgaagtcgtcgaagttgctgaagtcatagcgatagccgaagtcgtcgtactcgaggatctccgttggtcgagaactgacgccgggggagctgaggtagccgtccaattcttccgtcgagaccgtcccgagaggttggagtataacgccgacttccctagagttagattggattgaagccgaagctgggtcccgtctaggccttcggggagaagacgccttggtggtgaagacagcggccagatcattggggagtctcatcaggattgagggatagggcccatcgtcttgatcaggtcgtgctggagtagattggatctcgtccaagtggtttgaagccgactcgatcgagatgatcttggggtagatctcggccgagttcggaataccgaacggggcggagacctagcctctcctcgactggttcggatccgagtcaaggagagaaatcttgccgaagtcgttggtgatgaagtcgaggctgccaaaccggaacgcctgcctgggagggaagacaaagtcgtcgatgccggagacgaaacccatcgcactaatcagcgaaaaacttgacactacccctacctagcgcgccaactgtcgaaacaagatttcggcaatactaaaagggggtggctattgagctagaaaagtggatgggtttagagacaagaaagtttatacaggttcatgccttcttaataagaagtaataccctactcctatccggggattgatccgccgagtgtattattgatcgtatgatctgggagtaaaaagtcataccccaagaggcgcccggacccctccttatataggcgaaggagtccgtattacaaaatacagcccatatccctaacggaataggtagttacaaatatggcctaatcgtaaccgacttggatcccgggtatttccttaacatacaagtttggaacttaacccaagtctccttaaagatattctatctatacatggcaccccatacccagtcggattatacatgccgtgtaggtatggggtatccataatctccacaagtatgctcaaccatgttgaggctctgtttgtcgcactgtaccactaacttggcgtttccctggatagtgattatcccttttggtcctggcatttcgagcacttgataagcatagtgggacgctgccatgagctttgcgagtgcagttctccctatgatggcgttgtatgcagtgtcgaactctacgacatcaaaggtgatctgctctgttcggaagttgtcggcttgtccaaaggtgatggccatgggtattgtgatcttacccaatggcttagatgatgattctggagtgattccatggaagggctaatctgtaggcgccagctcgcttcgtggtatccccatggcatctaaggtattggcgaaaagcaggttaatggaactaccaccatcgatgaaaacccgtgctaccatgatgttccgaatagtgcgctcgaccacgatcagatatctgccaggtccggttgcaattttcgggtggtccgcctgcaagaactcgatcttgtgttgggaccatctcatcttgggaccatctcatcttgtgttgggaccatctcatcttgggaccatctcatcttgtgttcggcaatatgaaaaaggggtagcgcacgagacctaaaagtggatggatgcggagacaaaggattaagacaggttcaggccctctcaatgagaggtaataccctactcctgtttggggatttgaatccgtcgagtatgtatagatctgacgatctagttgtctcatgccccctagagggcttcctgcccaccttatataggatgggggcgggattacaagatagaaaccttaaccaatacggtatcggtttcctaaatctattttacaatattatcaaatcaggactttaggccgctccataatataaaaggaaacgtaatacccaagtcatgatcggttacatattccatagatataagctatcccctatgactaatcggataaccatgccgtgtgggtatggggtacccataatctccacagtagcccctgagaccttcacagtcgtaaagataatcttttcttgaactagattacttcaaagccgagtgcttcaatcatctccgccatgatctcccgagtgcttttaccaaatatgaagactgtggagggctaaaaaataaagtcaggtgcatcgaatagatgtacctaatagatgcaccaactgagtggttttgataattgtagtcaaccaagcgacttgatattaatatgtagcatatgcggtgtgaatccttgaacgacatgatccgagtgatataccgactgctttgtaaaatatgatgagtgtaacctaaagttggctacattattgaaaattcacatagcaaaacagctataaagaagcttgaatgccgtgaataaagaaatttccaaagtattgggcatacgccatgcgcacactgctttaacagatgtgcttaagtccctaaaagacacatggtttcaccacacccagaaatatacggcatatgtggtgtaaaatccgagtaaataaactcataaaggatttaccaaccacctagaaaatgaccaagatatataatcagcctaagccataatattggtcaataaaaatgcacacttacgtggcaaaaagcaacgatattgtatccaatcaattgcttgataaacccaaacagcgccatgactatataaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgtagacatattaggcctaggccaaaaaaatatgccttcgacaccctttaaaggatgacgcatataacatgctcccgagtagtaaatcttccgggtgatatagaccaagtgttgctcatatcaatagcttctgatatgagtgattatcccttatgagatactccaaaatagatataataattgaatcccgaccgccttatggggaataataaatagtccagtctttgagcatagaaaatagacccatgatcattaaattcatgttgcatgtatccgaaacaagtccaaattgaaggtatgatactggtgtttgaggtagtaagcccctgagtatatagcttgtccttttggagtagttgaaattatccatcggtgatagctgatgcaatcggcatggaagcgaagaaaccagtcagcagcagtcagatcaactaacagtgaagatgaatgcacccagcaatagcgacagagttttgtagccttggtgacgaaataatcagtcggagacgacgaggcggtcggtcggtgaagacgtagacgcccaacagacggcggcataataggccagccgtgtaggcggagacaccagtcggcggcggcgaaggcaagccggtcggtgaagacgtagacgcccaacagacggcggcataataggccagccgtgcaggcgaagacaccagtcggcggcagacgaggcggccggtcggtgaagacgtagacgcccaacagacggcggcataataggccagccgtgcaggcagagacaccagtcggcggcagacgaggcggccggtcggtgaagacgtagacgcccaacaacggcggcataataggccagccgtgcaggcggagacaccagtcggcggtagacgaggcggccggtcggtgaagacgtagacgcccaacagacggcgacataataggccagccgtgcaggcggagacaccagtcggcggcagatgaggcggccggtcggtgaagatgtagacgcccaacagacagcggcataataggccagccgtgcaggcggagacaccagccggcggcagacgaaggcaagccgatagtgatgttctgactgatccattcctgaagcgtaggagataagcttaaagccgtgaatcccttttatgcatatctggatctggatcctacagaacaaacagataggatgagtagtatctgatgtaaatataatactcgagaaaaatgcaagtattttaaaatatttataaatatgtatttcttctcttgtcaattttgatttctccgagcagatgactcattacgtttaaacactctgcccgactagtcatagccaccaagcaccgggagtcggcctaagcacttcccaaacatgcatatgagtgacatgagttcgtcattaatggaacaaagtttcatgggtcagagtttactactcgggtacttttgcaattattaagagcagaaaataaattatcttatctctatgcttttgatttattccgaataatgcttagcaccttgcgttattcggtccatccaacaagccctcgggtgctaggaatcggcccaaaggcaactatccattggcaaaccaaacggaaagcataggaagatggaactccataactcgataggcacttttgtactcagaataagtcgcaagcaatcaagataaatattatgaaaattgtttaaaaaatatgatataacatttgtagcccccgactcactagtcaacagcgaaccagttgatatagtgaggcaaaggaaaaggtaaaatatcatataaagaataaaacaaatgatgacttagctttgtcgtattccctcggtgacagcagaagtagccgatgtgggaatgaagcagtctatcagtggtgacaaaaacaccagtcggtgccagtggaaccaagccagtggtgtagataatgaagcccattaacggcggcgaagtccgccaaccgtataggcgaaaacaccagtcagtggcggcagaggcaggccggcggtgaagtcgtagacgcccaacagcggcggcataatagaccagccgtgcaggcggaaacaccagtcggcggcggtgaaggccagccggtcggtgaagacgtagacgcccatgtatggtggtgtgaccaaccaaccgtataggcgaggacaccagtcgacggacgcccaacaacggtagcatataataggccagccgtgcagacggaaacaccagtcggcagcggacgaggcagccggtcggtgaaaacatggacgcccatgaatggtggtgtgaccaaccaaccgtataggcgaggacaccggtcggtggcgacggaggcaggccggcggtgatgatggcggaggcaagccggcaacgatgaagtcagggaacggagaaacagcttcgcactccagccggtctatccatgtggtagcatgcgacgtctgcccagctcgttggtttgactctgtcgactcgtcctcctggcgacgtgcctctgtgcatttagatcaggcactcgtgtacagctcggacagaggtggattgatcgataccatccggtgattaaatcaagtagtagttgcatgaatcttaattactccatattagacaacgttgcctatgcatggcggcaaagtccaagctcccaaaacaaacaaatttgcctgggaataacgatagtatatatgctggtgcttcagtaattggagacacgtgctgcaaagtctgctaattataattccagataaatctgttgtcagtggattccgctatatgcatgtatattgtatacatggcgaaatcgcacacgattactattccgattggatagatgactgccttccgtcgttctgcgtctggctaatcgcagctgagttgaaatcaggccgaacggataattggcgtgggactcgtcctggcaatgatcggattccgacggcggcaaggcatgtatatatatggtatttgatcttgaactgaggtcttccaaggaggtattgacggcggcggaaattgaatccatcgaacatgtcgaggcggaaattgaatccatcgaacatgtcgagactgatcttcccggctagattggatccgagtcgaagagcaagagcatgttgaagtggtcggcgaaaaaaactcccgaagcgaagatgaattcggtgactcatgaagttgattccatcgcacttgtcgacaggtaactcgacgcaacccctacctggcgcgtcaactgtcgaaacaaattttcggcaatatgaaaagggggtagagcacgagacctaaaagtggatggatgtggagacaaaggatttagacaggttcaggccctctcgatgagaggtaataccctactcctgtttggggatttgaatccgccgggtgtatattgatctgacgatcagtttgtgtcatgtcccctagagggcttcctgcccaccttatataggatggggggcaagattacaagatagaaaccttaaccaatacggtatcggtttcctaaatctattttacaatattatcaaatcaggactttaggccgctccataatataaaaggaaacgtaatacccaagtcatgatcagttacatattccatagatataagctatcccctatgactagtcggataaccatgccgtgtgggtatggggtacccataatctccacagtagcccctgagaccttcacagtcggaaagataatcttctctcgaactagattactccaaagccgagtgcttcaatcatcttcgccatgatcttccgagtacttttaccaaatatgaagactgtggagggctgaaaaataaagtcaggtgcatcgaatagatgtacctaatagatgcaccaactgagtggttttgataattgtagtcaaccaagtgacttaatattaatatatagcatatgcggtgtgaatccctgaataacatgattcgagtgatataccgactgctttgacagatgtgcttgagtccctaaaagacacatggtttcaccacacctggaaatatatggcatatgtggtataaaatccgagtaaataaactcataaggatttatcaatcgtccggaaaatgaccaaaatatataatcagcctaagccataatattggtcaataaaaatgcacacttacgtggcaaaaagcaatgatgttgtatccaatcaattgcttgataaacccaaacagcgccatgactatataaaaaagttagcagggcagctatataaagctttattgtttgacaccttttaaaatgcattgtaccaactcctaaaaagttgagtaactgcggtataaaaggattttaaagtattgggcactagatcacgcgcactttggcctaaccaaaaagtgcctaagtccctaaaagaacgtgacaggccacacctgaaaatatgggctgcagacatattaggcctaggccaaaaaatataccttcgacaccctttaaaggatgacgcatataacatgctcccgagtagtaaatcttccgggtgatatagaccaagtgtagctcatatcaatagcttctaatctgagtgattatcccttatgggatactccaaaatagatataataattgaatcccgactggcgcaagtattcggttgatagcccttacggggaataatgagtagtccagtctttgagcatagaaaatagacccatgatcataaattcatgttgcatgtatccagagcaagtccaaattaaaggtatgatacttgtgtttgagctagtaagcccctgagcacatagtcacaattgttcattgatggtagctgacgcagttggcatagagacaagactaccaatatagaggcgaagaaaccagtcggcaacagtcaggtcagccagcaatgaatatgaaggcgcccagcgataaagttgtgtagccatggcagtgaaataatcagtcggtgatagacgatgcagctggtgaagaagatgaagatgcccattagtggcgacataataagccatccatgaaggcaaggataccggtcggtggtgacaaaagcaagccgacagtgaagatgtagacatgcatcaaaggcgatgacgaaatccaccaatcatgaagatgaagaaaaatagtcgacggcgacaaacacaaccgacatgatgaagatgatgatgtcagtgatccagtcaatagtagtattgcggccgatgataatgacgaagacgctcatcagtgtttgcatagtaggtcaaccatgacggtgaaataacaagctggcaatgatgaaagcaactggaggcgaagacgtagtcacccattagcaacggcagagatgtcaggaccgatgaagtaaaggtgctggtgatgatgtcagtgacaataatccatcaaactgttgagaagatatcaaagctcgagtagtttccttgatgcgagcgtgtgcataaagaagattgatgcaacgctccttgatttatgaagatggcagtagaacttggtgttatagctgttgcagatgcttcatttggaggaaaataaatgatgttgtccaactcgttgaatctgagttaattggttgataactccaaactcccgaacatgtagattaaatcttgaacttgatacttgagaattttggaatagattgtggcggcgtggagaagccaaaattgccggtgtaataattagagtcgctgaaattaaatgtcggctctgaagcaaagacgaagataataactcccagagttgactcgtcgattgattgattgcttcatcttgccataaagcttgtcgaattttgagagtcttgtatttgtgtagcccccgactctttggttagttgggaaacaactgaacatagagtcgagaattgtagcttcttgtcgtcgagtactcattgcttgagtaaagatgcatgttgaagatgtccgagtagaaatattgaagattggaacaccacttgttgtaataaaataacacggcatcatatttggtgacgcatgccgagatgtcgaagctcttgtagacgtcgtggttggtgaagtagcaaaacttgcgaagtagcggcaatagagtttgccggtgccgaagataatgaagatgaagtcgctccaccatgatgataaagttgcatagccatgatgaagtgaatacgagtcgacggcaacataaacaaaccagtagcaaaaacgcatagttatgaagataaaagcaccagtcggtggcggcataaccagtcggcgacggaagacgatgatgtccatcagtagtggtagcagtcggcagcagacgtaggcagcttgtgttgaagatgctgacgcctattagcggtgacggtgatgtaaccagccatgaagaagatagcatcagttagcgtcataacaggtcaaccgtgcaggtggtgacaccagtcggcggcggatgaggcagccggtcggtgaagcagccggtcggtgaagacgtagacgcccaacaacggcggcataataggccagccgtgcaggcggaaacaccagtcggcggcggacgaggcggccggtcagtaaagacgtagacgcccaacaaaggcggcataataggctagccgtacaggcggacacaccagtcggcggcggacgaggcggccggtcggtgaagacgtagacgcccaacaacggcggcataaaaggccagccgtgcagacggaaacaccaatcggtggtggacgaggcggccggtcggtgaagacgtagacacccaacaatggaggcataataggccagccgtgcaggcggaaacaccagtcggcggcggacgaggcggccggtcggtgaagacgtagacgcccaacaacggcggtataataggccagccgtgcaggcggaaacaccagtcggcggcggacgaggcaagccggtggtgatgttctgactgatccattcctggagcgtaagagataagcttaaagccataaatcccttttatgcatatctggatctggatcctgcagaacaaacatatgggatgagtagtatctgatataaatataatactcgagaaaaattcaagtattttaaaatgtttataaatatgtatttctcctcttgtcaattttgatttccccgagcagatgactccttacgtttacacgctctgccctactagtcatagcccccaagcactgggagtcggcctagtcacttcccaaacatgcatatgagtgacatgagttcgtcattaatagaacaaagtttcatggatcggagtttactactcaggtacttttgcaattgttaagagcagaaaataaatttatcttatctctatgcttttgatttgttccgaataatacttagcaccttgcgttattcggtccatccaacgagcccccgggtgctaggaatcggcccaaaggcaactatccattggcaaaccaaatggcaagcatagaaagatggaactccataactcgataggcacttttgtactcagattatgtcacgagcaatcgagataaatattatgaaaattgtttaaaaaatatgatataacatatatagcccccgactcagtagtcaacgtcgaaccagttgatgtagtgaggcagaggaaaaggaaaatatcatataaagaaaattaatgatgacttagctttgtaatattccccttggtgatggcagaggtggccaatgtgagaaaaaaagtcgtccatcaataacaatgaagacaccagtcggcggcgacgaaggcggttgatggtgaaagcgaagatgcccaccaacggcggcataataggccagccgtgtaggcggagacaccagtcaacggcggcgaaggcaagccgattggtgattagatgatgtcacccaggaacagtggcaaagtcatgttgccacgaaggcatatatgcacaaaaagagcaaaccaatctggttagtaccaacaaacagaatagttatagatatatagacaaatatatgctcctgttggcatgggcgattgtgttgatagcgccatgattagttgaggcgtgctgacatggattccggccgaaacaatcgctaggtgacattcatgtgacagcacaattaataactgtcacgcccagccacggacaaccggttgatcttggtcagcatatacatacatgcaaagaaaacgattagtagattaatctgttatcaagcataaaagcatgtatataagcatatgtatatatcaatgtatggctcagagctccttgtaatcggctgctcttatatgcccctggtaatcagcaatgcttctcgcgtgaagactgccggttaacctatgctggcgtgtagatcggtacagagcgcgaacggaattacatcagcaggacacatgaggtcgccgaccgagtggcagattaaaaccgttgaactcattgagatgaaggttgaaaccgtcgaactcattgagatcgatctcagcacatctccagaaattgattccatcgcacttctcgatggaaagctcaacgcaacccctacctgacgcgccaactgtcaaaacaaattttcggcaatatgaaaagggggtagcgcatgagacctaaaagtggatggatgcggagacaaaggatttagacaggttcaggccctctcgatgagaggtaataccctactcctgtttggggatttgaatccgccgggtgtatattgatctgacgatcagtttgtgtcatgccccctagagggcctcctgcccaccttatataggatggggggcaagattacaagatagaaaccttaaccaatacggtatcggtttcctaaatctattttacaatattatcaaatcaggactttaggccgctccataatataaaaggaaacgtaatacccaagtcatgatcggttacatattctatagatataagctatcccctatgactagtcggataaccatgccgtgtgggtatggggtacccataatctccacagtagccccctgcgacgtggagcagacttcgcgttctatatttttgtactccctctttgaggtgtaagatgtagaaccgctaaagatgtgtgagacgtggaggtcgtattctaggaatacggagtcagagtcggaagtggccgtctcaacaatcgtttcgacaacacgtactctctttcccctctcgattgctagttgtcgcgcgagctcctttttgaagacgcaacaatcttcaatggagtgactgttcgtcttgtgtatagggcaccattgtttccgtgagtcatcgttctgggcgtttgggcgcttgggtgggtccgtttgtgtaacaacccagcgcccggaaacggtattgggtcatctcatttagttggaccacacctaacactattaactcacttgcgtttttgtcctcgcttcacgcaaaaggttcgaaccggagttaacaacctccaggctcccatccttataagctgctgctgctctagctgaagtagcgaggtggtactaaactcggctgctacagtgccgcgagctactactgctgcacttctgcatgcacggacactattaactcacttgcattttcgtcctcgcttcatgcaaaaggttcaaaccggacttaacaggaccccatccttataagctgctgctgctctggctgaagtagcgaggtagtactaaactcgggtgctacagtgccgagtactgctacagtaccgcaagctgctactgctgctgtctgctgcgctgctgcatgcacggacggcccagcccagctgttgcttgctcacatgggccggacaaggcccaaggccagctagcttgctcttttttttagggtgttacagtttgctcagcagcgaggacctcttccgagggtttgcgcttcccacaattatgacttctcttcttgctcaactctggtgcgtctttattggctggtgtcacgcccggaaaatatctttcccgaacgctcatatattaatccccatcccaggaaaagccagggtacaccacacaaacatgatacaaaagacacatctttattaattatcacgataatatttacattattacaaaggcacataaggcctaacaatcaaagaaaaacagcagtgtactagcgggcctagggcttcatcttcacaggcgttcaactggggtataagccaagactccatctaaaacttcctcttcaagacgcttctctgactggagggggaaagattgagcaaggatgagtacaaccaccgtactcagcaagccacaccgggaaaatgcacttaatgcaagggagtacaaggattcatttataagggttattttgcagtaaacaagcacttcaaacatttagttatttaaaggcattttaataaaatcacatcctatctctagtcaaattactaccaagtcgtgctacaacgcaaacttacatgggccgcgcaacgatgcgaacccacttaaggcgcgctacgacccgaccttaccttaacccaacccacaggctccaaccatgtgttccaactctacagacagaaaccactaactttgggtcattgctccgcttgcccataaccaagggcgcggctattcgaataaatttaaccttggccagaggtgtacatctttacccacaagacacagtcttgactacacgtcaatcgtgcatcgtgatgccggaaaggtacccgaagagccaagatcaccacataacccatcgtttagtattgtcctaaacaaagaagaccgacataaacttccacggccagtagactctgggacaggtggatagtctatgcccctgggcgcaactgccaggaatgtccattgcaaactagacatgtggtactacggaatatgctttgcaatcatgccccgaagaccagtccttatgtcggctgaggtaggacaaacaaaaccatgcacctcgagcccagctgaaaatgagtttgggaattttgaaaggggagatccaacctgtctaggctaacaagcctctaatccatcattatcaagattatagagtcattcccaaagtctagattattataaaacaactaaaattttctaattaagcagggctaagcataatcctaaaatgtctagtaagcaccacatatagagttctcactagctggtttttgttacctagggttgtcaaaggtaaatacacaatattcaataagtaaagccataacatggaaatgtaggaatggctaattaaaacagttataacgcggtaaatttaataaagcgaatgcaataatttaattaaaatacttttcgcaaatgggattcaatatgctccaggagagcgtgacttgccttgctccgagaaaaggagggcttcggaagcttctgcgacaaactcgaacggcaccgcaggagactccaaaatgacaggaactacacgaacaacacaacaaggctacaacgctaagaaagaaacaagaacaatacataaaaacaacaaatacaggatctttaagttataacaaaaattagacaatttggacgggtcaatttggagatcgtatggccgagaaaggaccatccgaattttaggtgcaattaaagtggaaatttctgagttgtttaattattattaaaccattaaataatgtgttcttcaacatcgctcgaggaaacaaaggaccgaacgactggtagctaagacccactggtcagacggctagctcaccgtggaccgggttcacagagacgatccacgggaaggacgagtgagaccgtacgtgtcaaccaaagcaagtggccgacaagcggggactcacacgagtgccacacgggttgcacacgtgcgcaagcacgaggcggcaacacgggcacacgacgacaactaccacccgtgcacgtcaagaccacacaaacgatggccgatgccggcgcactggaccggagccgacaaaagcacgacgagcatggggcgacgtggggaggacgaggacggggcagcgaggagaggggtccttaccaccacgcacgaggcgaggaaacgatgacgatgaccgacgacgaacggaggagactggcggcgacgaacagggcgacgactcaaggaggatgacttcggtggcgacccttgcatggaggcgaggatgggcttggtgcagtgacgacgatcgaacgaccttgacgatgacggcggctttggcttggtgaagaggcggacgacgataggatcagcttgacaggaacggcagccgaagggggatgaagcaggaccgaggacgaagacgaggcaacggccagggaggaggacggcgatgtcgggcggcacaccggggaaggcgacggcgcagccggccatcacagcgggtcgacaagccggggacgacaatgccacggcgcacgggtgccgcggcaggggtgacgatggtgggggcacacttccggcttgcctcgggtgaaacagaggcgaggccgggggagaaggggtggcggatgagaggccgagggtggcagcggaagggtttggcgcggctccaatcggcggggaggtgcggccggggctcgccgacgcggtggagagagaaggccgagcggggagacggtggggagaggcttggcttgcggggtgaaggaaaaaggggaggaatgggaggggcggtgccattttgtaggccgggaggagggaggggaacggccgaagggagctcggccggccatccatggcggtggttcaaggaggcttaaatccggtgaattaataccgaattaggccttgttcggttacgcccggattcaatccgggccaggaatgacaagtattgatgaactacttgcagcaangcgcatcgaccgacacg

SEQ ID NO: 10088 - DNA, 20589 bp, Oryza sativa
ttctatcaaaaatttcttactataatttcattcccggcccagattgaatccgggcataaccgaacaaggccttaaagggggggaaagttgggggaattgatgaggaggaggagaggaacctattgagagggaacaactggggagggagatcaagaggtggcggcggtgcttctgttcatggccggggaaaggaacggccgagcaggaggacgaagacgactgacaggcggggcccacgcggggggcgtgcggtcaccttgcgtgcggcgcgcgtgagggcgcgggaggggagcggctcggcttgggctgggcgaagcagggcggcccagggaggaggggagggcggcctgggccaaggcaggccgagaggaagagaggagggagagaaaaagagagagggaaggagaggaggaccttggccacgggccaaagcagaaaagaggagggagactaccgatcggtcgcccgatccaaatcggcaaaaatcgggcactcatatcagcatgacgtcagcgccacgcatgcgtgcaaaactactttaaactaatttttctcttaaattatttattcaaatcataatccgattgcaccattaaattcgttgcaattaaatctttaaaacaagaccacacatggatatattccgatgaaaaaaaattagcttattattgaattatttttaaatgttgcacgatgttccaccaagtatatcggaattatttcactaagtggatcgaaaatgtttcaatcgtttaaatcaggcgttgtttcaccttatataaaaacaatgtttcagcaaatagtgaaagaatatttcagttcactacaacattagatctatacgaaatattgtgaatatactaggtgaaacatttttggtggaacaaaaaatgaaacaaattcccttaatagagggtttccaaaatatgtgggtgatttgttgcaaaagaatgtttcgttcactgcaacattagatctatacatagtgaaacattatgagtacactaggtgaaatattttttgtggaacaaaaaataaaatgaattcccttaatagagggtttcctcaatatgtgggtgatttgtcgcaatagagttaattgtgtagatacgtggtgggccagggggccaactgcacgcacgcggggggcggggggagcgcccaatttttgctcccccagccgatcgcgcgaggataagcatttttggggaaaagggggaggactttgggccgaaaataacccaaagagaagatgggattatttttaggttttctattttaattgactctgaaattggtttttgttgcttagaattatttcttgcgctctgaaaattcatgtaaatattgagggctcctttcataccaaggagaatttaagacaaatacccccaagccacattcgaatttttcttgtacgcattttaatgtttgccattttctatcgaattttaattaattatatcgttccattttagagaatgatttttaaaacgggatgaatttatcaggacgtgacagctggctttttctcctcgcccaccttactttttccttcctttcatcttagggcgtcatctgcatgagcgcatctgtcgataatttcaaatagcttgcgagcagatgtgatccgtcgtgtcactagttcctgggtggtgtatcgatctcggacgcctgacttaaacgcgtggatgacaaaagcgtcggagatttcagggatcgtattcctgcactcattaaagagtcggatatagtccctcaacgattcaactgggttgtgagttagagcgtgcacgtggcgcttatatcttccctggaaattggcgacgaactactgccataagtcttcccacgaagagattgagtggggtggccacgtcatcaggctctctttcccctcctctcccttccacctcctctctctctctcactcatctccttgggcaggctgactggcgatggggaggaggtcgccgggacgatgaggaccgacggccggccggtgacgcggcggcggcgacatgggagaaggggagggaggcggcggcaggagcacaggggagatcgagcacggcggcgggcagagtggggcgatggcgaggcggagcagcaccacaccccctttgcgcccggcgtcgtcatctggatcgcgtcgtccctcctcctcgcccccttcgtgccctcctccgccaacggcggtgacatctccattggtcgcgaggatcccctccccgagcaggaacccgtcccggatcccgcccccacctcttgcgcggtaggcaccacagctcaagctcgaactcgccgcccccgaagccctcagatggtgaagcacccagcgggtgagtcacagcggtgggagagaccgtgacagagtaatcagcctggtcctgcatacatttgaatgcctcaagatcttcctcttgattgtcacctttggctttgtcatctttgccggaactggtttctacgtcatccttgttcgacagaactaccttatatttctgaaccatggtgccggagcgagtcggtgcgaacgaatgcagaaatcggttttgcaagtcgtctttcatcttttcaaattctgccttctgctccggggtcagcttgtccatcgttattgggatgacgttctctgggtcaacctctcctttcttgaggcttgccatgaagaagattttacgaaagtcagtcccactaggtgtgccaagaggtgtgttgacgcgaaaaacacgcactggactgagagatttgcttaactctagtgcaggtccaaagaaattgtcttcgggttctgagcgtgccagggtttgatcctggaaccgaaaagaaagaaaaaggaaaaagttaaatccatcaacgatagccgatcagctggattgccgatgacgtatcattcagggccatgccgatgtgacttgcatcggaccggcaaggtcagaataaacgtaggatcattagatctactcgatcagctgtagatgtcaacgatacataatctatccattgaaacacacttagatcgggtgattgggatagatcgggcgttatgccgagacagtataaatcactcaacaactaagtgtgccccaaagtacagattatgtaggttcacagcatagccgatagagcaaacataacgtgtatcggctagtactccgatactactgtatactaggatatcagcgcagatgaaatatacaaaactaagatcaatctaacaagcagggtgaactagtagactgataggaagcttaatatactttaaacggatgagatcttaatataaagggtaggtttagacagtccagaaccaagtagggaaacaggacggctaaatcaagtaagatcggctgaaactccgatgctatatgtattagcattcaaaggaagagctagataagacgtttcaagacaatacttaacagatcgaacctaacggttgcaacattaagcataaaaagaaacataagatctaagtaaatcgatgaaaactcattcaagatggtagatacaccacatagtctagcttgacattgacgcctaaacctatcggccgtttcgatgatagaggctagccgatgaagtttaggtgacggaatcaatctagattatgcggtatatatgataactcagcaattcacgtagacaggattagagtgtcataaagatgtaagcacgaatcccgagaacgcaatccgccataacaagctttacctcttcgtcgaagatcaaacccgatgcaacccaactcgaaagcaaagactcgtaaaatagaaaagggtggtgatgcgcagaagtattattgaactgtcgtcccttgatttcaagatgtcaggtcttatttatatccgaagtacatagcttgtccttgctggacacgactcttatctctattacaatttaaaatacgaacaagcccattaggtggactcttaccaaacatatctttaaggaaactgaaaaaacatcctaattaataaatacaattgcccctttcttcggacctcgatccttgtgtggcaatggctatgaagtgctttgactaatcttgatgataaatgtgggaccgtatttttccccctggtcgtatcggcttcactccatcagatttggtgctagccgatatgtggcagctgataccacttgtagctgattcgtgcagcagccgatgctgctcgtagccaatgctgctcgtagccgatgtgtgctctgccttctcaaacataatttatccaaatcggccttgaccctagctctgaatccggcttatggtactaccaaatttggtcgtcaacaagcgccagcgcaaaatcgcccaccacgtcgcacatcgatggacctcctcctcccctccacctccctcccccatccgcatcgccggcgtcgtcctactgtagccgttctttagtggcgagagatgaattactctgtgaataaacagattttactagcccagggagatgagtgtgagagagagaggaggggagagagagcctgatgatgtggtgtcctgaaatgtggggcccacgtgggtcccacgctgactcgcccgccacgtaggataaaatcggggtcaaaaccactgaaggatgtaaagcgaatggttttataagttaagggatgatatatatctgattttacggttaggggtaatttgatgacaagttgagggaccttcggtgtactttttccttttctactcactcttctgggcctctagtaggccatatgggccccagttttagagtgatcggcccaaacatggaccgggccatattgccagcctgtctaaaaaagaaaaagttcactttgagatcactgatccatcgggcacattagatagcattgaggacggtttggtacctatggggtagttttgacttgctcttgttaggtgaggtggcatcttatatgggacccacgcaaaactctttcaatgaattggttttaaaaaaataacatgacccacctatcatcttctcctcccctcttctctctccctttattctcctccctcttctccttctctccatctcttcgatgagtttgtgggggacttgagggaagagaatgtcgccggcgtggatcaaactctaagtgctctacccgcatcaacctcgacagatggcgaaatgccaccaaggatgagaaggtcaacatcccgcttctgctccagccaacaccgctgagggcgtcaagccgctcgtcgcctccatgcacctgccgctccaagacatccgcaccgatactggtgtaggtggccgctcctcctgctcacacgctagcttccagtagctctagtggggagaaagaaaagttacgagaggaagcgcggcattggtggccacaatgagggggcttgaccgacacgacgcaacgattgagcgataacgcgaacggccctagagcggcagtcgagcgacctgtgtgcgatggcggccgcagcgtcgcgctagcttgcggcgtgaggctgattcgcgggctggggatgcgcatgtaggcgccctagttgatgttgccctcactctcgtgcgtggtggacaagtacaatgcgtcgctgaacaatgccatggcgccctcatgcaaccctgccgccgcgacatccgacgtcaacacgatgcttgtccttcacctccactttttccccttcgcatcacaatccgacctctccatgatgcggttcatcgtctctggctctctgccatgggcaggtacatccctatgccttcttccttcgtggcctgctccgtatcacttgacgaggacctagctattgcatacgtcttcaccttcaaatccctcatggcgctcaagacccacgaggctgttgtccccacgcgccttgtgcgaggccgtggcggcactatccattggtcgtcaccccttccagttcgtggtgtgatgtgaagaggcgtgcctccgccatcgccatcgagcatggcagacatcatttccttgtcctcgattgtttgcgcacctccaccacatttgctaccgcagagatcgaagatatgaggagagagataaggtagaatatttgtttcaatgatacgggggtcccgcatgttcttcttgtttctagtgccacgtcaaccaaaaacacgctcaacactgtattgggacccaatgtaatcccgttttataatattagagatatgtagtatttcaattcaggacgattttaaaatttgacgataagacgagggagctccagcgaactttttccgtctaaaaacaatcaatcatcaatctggatctggcccatccacatttacttttctttcttttttgaaaaaaaaaaagctgcatctccaaattctccgtcttcttctggagcgaggaagagggaaaaaaaagaaaagaaagaaaagaaaacggaaagtagtacgatacagtaatggtaagatgtgggggtggaaacccaaatggtattggggagggcaggggtcaggggggcgcagaggcctgcttcgttgctccgccgccgccgcctcctcctcctcggttcctcctcccatctcctccgatctcctcctctccaaaccctatcaaatccgatcccgatctcagagcaggtgcgcgtgcgcccgcctcctcctctagatttcgatctccaccaacaataagggatcccatcccatcccatgcccgcctccccatctccggcgccgcgagccatgaagcgcgagcttgccttcgcactccagtcgctctccgccatgtccacctcccccggccgcacccgctccggccgccccctctcctcctcctcctcctcctcctcctcctcctccgcccccgcccctgcccccaagaggcggaggagaccggacaagccccccgaccacgaccccgcccccgcccccgcccccgacaaggatcttctcgtctcccctcacacgcctcctatggacgccgaggcgcccaagcccatacacctcctcaacgacaaggacaaggacaaggagggggacgatggatctcaccaggatacacccacgctacagtcaccccctcgtggatctgatgctcatccaataccaacggagctcaatgtttctgctgctgtcgccaggcctccacaaccaccccatgcacaaccaacggagctcaatgctgttgccgccgccgcgtctgctctaccaatggagcttgatgctgctgctgctgctgctgtgcctgccgaatcaacggagctcaatgctgctgcaaccgctgtgcccgcacaaccgacagaggtcaatgctgctgctgagattgtcaaaccaattgggctcaatgctgtcgctgctgagactgcaaagccagacatggccatggaattgcaggaaccgcctactgtaactgcagccaatgggagggatgtttcccatgaatcatttgaacaaaacctgcaacaccaggtcctggacaatgccttaaccgatccttctttgcttgccgagagcactgcaacaccagcctctactgctggcctcaagcctgcgaggcgcttcacacgatcgctgctcaagaacaaaccagaggaagagcccacagctagcaaaagtcaagaccctgctgtctccatgatatcggaggacaacaacgaggcctctgttgatttggctcttgccccagggaagccacagaggaggttcacaaggtctcttctcaaggtaaaggttgaggcgcgctctaccaacaatttgcttcaatccaaggaggcaattgacagcacatcagactcttctcggtcagtgaagaagatggagatgaagatgtctaagaaggtcgcctgcctcacaaagcacccaagcaacattagagagttgctcaacactggcctgctcgagggaatgccagtcaggtacatcatccccagtagcaaggtacgtgaggataatacttatgttttatgacttttaccaacagcttttcattttcagtccattatagcgagttccttattaattattgtgatggccaccatgctagtttttattatactatcttgtaagtttttagccaagcaatgttaagattactcatggaactttatctttagtctactgtggtatttaggaattttgtctttgacgtgacagtacatgtatgcacttataatatgtttactcatcagctaggtcttatccatgaaaatagctttaatcacctattctgttataatcgggacctcccagggtcagctcccaatcgatcttgtgatatattctaagaacaattgccaggccaacacacacccttgatcttttgctttgcttttcatggtacacttcttgtggacatggtgtgctattatttgagttgcactaagccaggtagcccctaaaatgctactctctacgaatgatacatctagccaagaatattaaaactatatctgcgtcttttcttctttttttttggggggggggtgttattgatgggagtatctttgagtgattcactgtggattatgttctagcatacttttgtagctcaatgcaattaaattatattttgtttgcaagttgcagaaggctgtgctgaaaggagtgattacaggctgcaatatccgttgcttttgtttatcctgtaatggttccaaggttagtactccttaatcgataaatcgctacacattacaaattgtttacattatccacctaaatttcacaggatgtttgttcttatttctttgaacaacatgctgggagcaacaaaaaacatcctgctgaccacatatacttggggaacggtaatagtttgcgggatgtgctgcgtgcatgtgagagttctcccttggaatctctggagaaaacaatacgttcttccattgatccaattgcgaagagaagctatgttaattgcctaaactgcaatggtgagggtttcatgcgtttgttttttgactgatagttttccttggtacatttatttacgtcttctaatgctgcagaacatctttcttcatcacaaactgaaatctttggaagctttttgtgtcaacgttgccttgagccaaaacaacatcaagatcccccttccccatcttatgcttgtaagagcaattccaggtaagcagtccaagcaccataatatgttagatgtgttttgcctaataactatgagatattgatttgtttgaaaatgcaaaatctttcctttggttagataattttgttcaagatatatgacttacatccttaactcacaagagtaacaaactatttttattttgctgcccgggatgtttttaattgtatgcaaatttcattgttttgacttattcagatgttaacagttttgtaatgttcaaacttatgctgttgcatttataaatcatctttttttttttgctccatgttgttttgggggctttagcctgataccaagctccaaggattttttgttgaagaagacaccattaaatacaaaaggtggaagtgctggaaaagtaactacaaagttggtatttctgtactgttgttttttttttcttctttcttatcatgtgactatatgaggcatgaacacgaaattaattggtcatttcttggtactttcttcagggacaccgggctacacaaattggtctttaaagttctgcttgatggtactgaagtagcttactatgttgatggtcaggttgttatactcagagctgctcactggttatgttaactacaccattttgcaactttggttaataatttgcagttgcattatgcagaggaaagttgatgggtatatcaaggatcaaagaatctactgtaatcactgcaaccgagtggtgcgctcctttcttatttatgatatataatttacttctatcatactccatgaaataattaactttttgtatatgatgagtatccaggttagcccgtcagcatttgaggctcatgcgggtgagggaacaagacgcaagccgtaagtctttgttatttcctgtacttagcttgtgtgagcaacttctatttcggttgcccttattatactatgtttctaccaggtatgacaatatttttacatcaaatggagtatcattacatgagctgtcaatgaaaatatcaaaggacatggaattatctgaacgcgaaacagatgatttgtgcagagaatgtggtcaagggggagatattttcccttgcaaaatgtgcccaaggtcatttcacccaggtagagtctcccatattccagaattaattgcaaataatgtttaagaatggctatgttttacttgggtgatgttttttctttaacgatcagtccaacacttgaccttctttttgtaaaatctgcagcctgtgtagggctgtctggagtcccctcagagtggtattgtgataattgcagcaaccttgttcaaaaggaaaaggctttagcagaaaataaaaatgctaaagctgctggaaggcaagctggagttgattctattgaacagataatgaagagagctatacggattgtcccaatctctgatgaccttggtgggtgtgccctatgcaagtaagtattcttacttttctttttcttttaatattttttctcaattcatacttccattctgcagttatagctagaatacgttttaaacttgttgtaattcataatatgcaagcgtaattttgatcaataggctgtaaggagtaatgcagtattcgatggtattgaattaacaatctactagcaagtagtagtacatcactttttttttggtccatggagaatggtacccgagcagcatgaaaacagtgacagactacttatggactgggaaaatcttttggtaattttccagtggcataagcataagtatgactggagctgaaaactcattgggctaataagaagagcaaacaatggtctaaatgactctgaacaaatgctctgatctagacagcaaaattatactaagtaatgtacctacccatcttttggaggactgaaagatagctcaagtcaccttgggttgttggaggaatggatttgaactcactcatccatgttcatgaatacagctgcagttgaatctgatcccatgatgggaccaacagagtcaacactatgtgcatattggatttcttatttccttttaaaaattccaacgttaaaatcacgggcccaaccgaatggcacccaactaactaatgtaatgagtaaagtcaaaacaaatattataaaagctctttgtatctttcttgaagtttcttgttatccagtacaacacctcaaaattgctagctattttgtttctgatgtttatcttcttttcactttctacattgtacccccgtgatattattaatggtaagaatttgtttctgcaggcagaaagattttaacaattcagtatttgatgagcgcactgtgatactctgtgaccaagtatgccttatatgccatcttgatagttcctgtttaagttcctgatattaaagcttgcctttgttttttttattggatggtatttttattttaacacttttttaaaatatttggtgcccctgcatttattgaattattctaattcttcactaacatggtttttttcgtcactatccagtgtgagaaagagtatcatgttgggtgtttgcggagccagtggcaagttgacctgaaggttagcatgaaatcttttttgtttgatcacccttgttcttcatgtgtgaaaagctaacattgcctgttttcttttctacaggaattaccagaaggggagtggttctgttgtaatagttgctcagagattcgttcttccttggacaagataatctctgatggagctttgattttggctgagtcagatattgatatcataaggaagaaacatgagatgaaagggttaagcatggacactaatacagatctgagatggcgattacttgctggtagaaaggcttctgaagatggtgacttattgctctctgctgcagtcccaattattcatgtaagtaattcatgtttttctcatatgtgtagacatgaagttccatgtctacagtctgaacatttgctagccagtttatgaagtggatttggggtggggttaggtcctcagtagttacaagcacgtaccagccatgtctattaaccaatgacttgctcggtatgatccactgagttttttgttttttaaaaaaaaacctttgtaagtcttaagaatttttgccaacattgatgagccttcaagtccagtccatgcataatttctagcaaggttttatattgagtttttgcaactggtggttcttctcaccaagtatctatctattgcagcaatcttttgatccaatcattgaagttcagagcgggagggatctaattcctgagatggtcaatgggtaagagaactatccttccatatttctcccaatgcattgtccctctgtctatgtgtaagaaatttcccatttcctctaatctcccaggaggagacccaaggatggaatgcctggccaagattatagtggaatgtactgtgcagtgttaactttagggtaagaattctttatgatgattaagatttggccaaaacttttgtgttcattgttgttgatacaaacttgaatgttgcagcacttctgttgtgtcagctgcattgttgcgagtcatgggaggtgaagtggccgaactgccactagttgctacaagtaaagaccttcaaggactggtgagttgtctaaatttgttctttatattatgcttcattcttgtgttattatctggcaacgaatgcacttgtgtaaagaagaaatatgctctttttgttccatgtttctttctaataatttgttgctccaaacagggctacttccaagctttgttctcgtgcatagagaggatgcttatttctctgaagatcaaacacttcatgcttccagccgcccaggaagctgaaggcatctggatgaacaaatttggcttcactaaaattcctcaggaacaggtttgtgttaatctgcacagtttttagtgatgacgagaaatttaaatctaattttaactctccacctggttgcagtcggatgcttatcttaatggggcacacctgactatattccatggaacgtcaaatctgtacaaggctattccttcgtcataatattggtttgaagccttgtgctgtgcatgtatgcagtcagacagatttgtgttttgaagctctgctgacaactgtacataagatgatgaagcatgggctaaaggatgatgatagcacacagaagaaagggggagaaaagatgaaagataaaagtaactcgaggcggcatgatattggtcgaccaaaattcttatccttcagtttggagatatgctggatgatggaggcaatgcattttgcttaattttgtttatctttttttaaaaaaaaaattggctttcagcattttcagtgtggctgctatgccgctgagaaatgcagctatttttgatgtacagacctcaaacatcagaaactgcaggtttaatgcagtgctgaccctgttctgtttggagttagacttttggtctgtttcttgggttggcattattgcaagatttggaagggcctgtttgatgtggctgtcaagttttgatgggaaagagcatattgtatttgtggatatacatgctagcttaagtaaaagttttgaaggaatgcagtaagtagtggtattgacatggaattcgggagaagtcatctcttgagtgtaaaatattacagagcttgctcctgttagtttatttcataggcaaaattgaatgtcgtgccggcgcgtgttgcttgctattggggtcttacttaacaggaagaagatagggcaggcaggccggcccatcttaaagcccatcccgtctcgatctcacgccaacagcaacaacaggtacaagtccgtccgccgccgccgccgagagcgagagatggagatggatccccctcggctgggcatgggcgcgtactccggccccgtccgcccggtcggggacggggacggcggcgccgcgggcgagacgatgctgctctgggccctcggccagccggcagcgcagcgccacaacgccttcgtccgccacggggcgcactccctcaccctagacgcctgcggccgccgtctctccctgctccagtccccgtcctccatgtccacgcccggcgtcaccggcgccgttgtgtgggacagcggcgtcgtcctcgccaagttcctcgagcacgccgtcgactcgggcctccttaccctccgggccgcgcgggcgctcgagctgggagcgggctgcggccttgctggctgcgtcgccgcgctcctcggagcccacgtgctgctcaccgacctccctgaccgcctcaagctcctcaggaagaatatcgacctcaacgtcggggacgacgcaaggggctctgctcgggtcgcccaactcgtctgggctgatgatcctcacccggacttgctcaacccacctctagattacggtcattcttccttacttttgtattactatcttctcactaataattgatagaaattaattactggagtactccagttagttagtagtaagaagaaatgaattggaatttcagtgcttgggtcggacgtgatctacagcgaggaggcagtggatgatctgctgctcaccctcaagcacctctcagcccctcacaccaccatcatcctcgcagcagaactccgcaatggtacattcagattcttaatatccaacctagtacaagtggaatccacttgacaatttaatttcgcatccagatgctgtactggagtgcttcttggaggcagcaatggcggacttccaagtcggctgcatcgagcaacagcaatggcacccagatttccgctctacacgtgttgccttgttcatcttgctcaagaaaccaccttcccaaccggacgtgctgctctagctccaaattttgggcgtccctcatcgaaagctgaattgtagcggagtaccagcatttactccatcctttgttctggactctggagtttaattttacaccttttgcatgtatggaattagggggtcaaaactgtacgcttttgttttctcctattgattacgtgcacttcggaaatgaaattgaaaattgtagagacaccatttaatcggtctactccttttatatatataggatttttaagacaaaatatatcatatagttccgacgattcattagaatgaaacaaatataaattctactaacaaatattagagtgaatcaacttgtgatgtaagataaaccataccgtttttgagaaaacaaattggctaggaaaatttcccatcctcgtgtcatgctccttcaatttagacggcccttttcttttctaataattggattaaataaacactctttactagctcctaaaagatatgatttttacaaactatatgtgaatatcttataatacttttttcaatatatgtttcaatttcataatagtataaagattaggtcatatgtacactcaaataattccactattcaaccattcaaacagttgagcatacattctgggcctctttggttcacaggatttccaaatcatataaataggaaaaacacagaaatattatagaaatgcacgtgcaaaataaaagattggaccacaggaatttttcatacactgagctgaacataagagaatggagtggaagttttcattcttatggaattaatacatttttgaggattggcgtagaaaactttcctttaaatcctataaaccgaatgtatgaatagtgtttatttcaaaggaattgagactttctttaggaacaaggcctcaaactagtagtgtttcatatcgtgctattttagaagggaaaaagtacactgaaggtccctcaacttgtcctcgtgttataaaatcatcccccaaccgtaaaaccggatacaacgtatcccctaacttacaaaaccagtgtaaactagatccctcagcggttttgaccccggtttgtctgatgtggcgactgagtcagcgtaggacccacgtgggccccatacgtcaggatgccacgtcagcgaccagcctctcccttcctctcctttcctcccttctctctctcccactcttctctctggattgggcaggccgcccggcggtggggaggtcgttgccggggcgaggaggtccgacggccggccgcgacgtggcggcggcggccgggacgaggacgttcttcttcacgggcatcctcctaaagctcccgacccagcgcaaggtccccgatttgcgcgcacgccgagaacgccgcggcggcggcgacggtgtcgatgcacacgccgctatcatccgccatggccgtacaagaaacgacgtcccggccagccggcggggaatccgtcgaagagcgcccacgtggaggcgagctcgacgcgcgcgaggtagagctcgacgagcccatcgcggacggcgaggcggtggtcgaggccgagcttggccgcgtgtgcgtgcacggccggcgcggcctcgccgtggtcggcgatcaagcccttgataagggccctgaggcaaagcggcggcagtggcgctccggcgagctcctcgccggtgcccttctgcgagctgcggtagctgtactagattaacttcttgcatttttttttgcctaattgtgatttgccagtagaatgacactgattttctatggcctcttagttggatgagataagaagagatgagtatgacgagatggcatttgtagcacgagattaatttcttgcctgtttctgctggatgctaaatttgcaagctttgattcccgatttaatggctgcgatggctgtagataaatcccagctggtggatcccttgatgtgtctcgatcgagttccgggaggcagcagcagcagcagcaatgtccggcaccgccaacgcgacctcgccggccgctggcgctggcacgccgcggtcgcggctgccgccgtggacgcggcacaagacgctggtgttgcttgccggccgccggcgctggcacgccgttgtggacgcggcacaagacgctggtgttgctcctccgtgctcccgccgcccgccgcccttcccttctgggtcgccgccccctcatcgccggccggccgtcggacctccatgccccggcgacctcctccccaccgccggccgtccagagccccacagaggagtgagagagagagagagaggaggaagtgagagaagagaggaaatagagaagaggctgacgtggcatgctgacatgtggggttcacgtgggtcccacgctgattcagccgccaacaaaacctggataaaaaccgcctagggatctatcgtaaccggttttgattagttaagagacgtcggatatctggttttgcagtttgaggacgtttttgtaactcgatgacaagttcagggaccttcggtgtactttttccttttagaagggaggaggaagacggtgaaaagaagacaaacagttgggcctaattgggcctggggaaaacttacttgggcggggcttgtggggggtgggaggttcgagagccttctgggagaaggagagagcgcttgcctgacactgcagtggccccacttgtcagtcacagtaggtggacccgtacacgtacacgcctctttcctttactcttcttcttctttcttcttctcctcgagtcgagtcgagaattgttagatttaggtctcccccatatccccattcccatctctctctctcgagtctcgacggcggctgctgctgcggcgtcgcctgcggtgcgatgtcgtcgtctccggcgcatgctcagcgcttctactgccaccagtgcgaccgcaccgtccccatcccgccgcccaccttccccgacgccgacgtcctctgcccgttctgcggtggaggcttcgtcgaggagcttggggaggacatcaaccccaaccccaaccccaaccctagccccttcctgccacaccaccccttcttccccttcgcctccccatccttcgacctccgcaaccctagcgacctcgcggccttcttcgggcccccctccccctccccctccccctccccagccgccaggcacttcgacccctccaacttcctccatgatcacttcaccggcctcctctctggcggcgccaccatccagatcgtcctcgagggctcctccgcctccctccccctcgggggcgccgccgccgggcccggggggatcagcctcggcgactacttcgtcggctctggcctcgagcagctcatccagcagctcgccgagaacgaccccaaccgctacggcacccctcctgccgccaagtccgccgtcgccgcgctccctgacgtcgccgtctccgccgacatgatggccgccgatggaggggcccagtgcgccgtctgcatggacgacttccacctcggagctgccgccaagcagctcccctgcaaacacgtcttccacaaggattgcatcctcccctggctcgaccttcacagctcctgccccgtttgccgcttcgagcttcccaccgatgaccctcaccacgcccacccaacccttggatctcaccgccccgccgcacccgcctctgcctctgcctctccctctccagctccaccacctaggctggctgagagaaggttcaggatatcgctgccatggcctctccgtgctgcgtttggcggccaggcggagagcagcaatcctaccaatcaggatcctgttggtggttctactgatgcttccggttctggcaacaacaatgcaactggaggtcatcgtggctacgatgatcttgactgaagagcatcggacaaagaggggatgaggaggtataagttactctatagcttttatatttttttttgtaagatgattacgctaatgttgatacttttacatgctctaccaacagccatattagttttcgagatataaccattcattttagtgttctaatattactacatggattgaaaaagaagggacccttcttttaaccttaagtcatccatttctgatatctgttcaatgacagtttggtgtgctcgatttagattagaggttttcgcgatctataacattcttcgtttatgtgctaaacatccgtgggttgagagttgggaacttgcgcctagggaatgcgtcatgccatgcggtgggagtcagtcttgtgaataaatctgtggctatgcgagtcggctggtaggaaaatgcttcagtaaggcccacatgtatcctcatttatttcagtcgattggccaaacatacacttaattggtggttaatgcttacatgtatttggtatgccacaagatgattggttgcatgtttaaactatcaatagttgattggcagtagtgtgtaatgagacacgtagtatgtgcttaaactggttaatcaagaaatctgagttcttttcatgtattccgatctaatggttcatattatctttcttggtttggtcaatcttaaattctgtatcgtgctagacaagcttgaaaaggaatgtattgttgaccgatggttcatattatctttcttggtttggtcaaactaaaattctgtattgtgctagacaagcttgaaaaggaatgcactgttgaccgatgatttcgaaaggagtttgtgctctgtaggctacagtagtttgatatacttctgccagctttttattggaccacgtggtgcagtaattttttcgatgtgggaggaacatacgtgctcttgatccgtctggatagatctgtacgtcttgatccgtctggatagatccgtacgtcacgctgctgaaaaagggaaaaaggaagaagcaatacgggttcacacacaggctggcatctagctgggccttagattgcttgggccttgctggctggtgaatggtggtcacacacgtaagagtaagggtgcaagcgggcaggaaaaaaacctatctcgattccatgaccggaaggcaaagttatcaaggttttaatttgcacagaattcttcatctgcattccacagtgtcgcacccgccagcctaacttaacggcgcggttagtcgacgtgcttgacaccgacatcgtctaagctatccaccctaatgtcctattgccatctctatactaaccacctcgttgaaaaccagttgtggaccctcagatattcgacgtttcgccgaaacaaccgctgcttcgtggcctatggtaagtaatttctagaaaaatctctgggggtccaactctccaaatccagtctctcttctgtcaggcccgtggttctgaagccgtcaaaaaaaacctagcttgattccatgaccagaaagcaaagttatcaaggttttaatttgcacagaattcttcatctgcattccatactgtcgcgcccgccagcctaacttaacggcgcggatagtcgatgcgcttaacaccgacatcgtgtgagcattcaccctaacatcctatgtgccatccctatactaaccaaccttgtggaaaacaagtgtgggactttagaaaatcgacgtttcggcgaaacaaaccgctgtttggtggccatgggaaagtaatttctagaaaaaatctcttgggggtccaactcttccaaatccagtcttttctatgggtgaggggccgggatatctgtcaaccgtaaaa

SEQ ID NO: 10089 - DNA, 4721 bp, Oryza sativa
  unsure (1)..(4721): unsure at all n locations
caagtgaggcctaaaggagtatgtgggcgggatcttcgggatcggcaaccaggcgggaattgggcgacaaacctctccgtggcgcttcaaaaattatgaaggtgggcctcccgtgggtctaggtcgcttgtcaggtgcaaatcctccgacgaacgtccaggattctcatgttgttctcgaccatgccancgggcagcatntgatggaactcgatacgagccgagtcgtacgcctccaccacgcgcgccaggtgcatcatggtagcgtcatcctccgagctagcatcccagaaggtggagtagtcgcgggttcgtccgaacagagggtggtagcggtagttgtaatatacttanttttntgggcatgcccgcttggtaggagtaggcagataaagaagaaaagagaagtagaaaaaataaaataaagaggtacaaatagttttctgaaattatgagtatgatatactacaggttaagctgtagattgaagcaagtacggtaactacacagacatcctgtatgtctataaaatacgcctaaaaacaaaaaatagaaaaattaaatgtcttcgatcgaacttcttaagcctcggaaatctttttcagaacttatattccactaatactacaaatttggaaggtttatttgcaaaatttttgtgtcttatgaattcgctgcagttttgagaaaacatatctttgtttctccctaatggcatataatcatttgccaaagttaaacacacatccataactcaacaaaattattcacaaatataaattactatgctactttgatccatctcaacattgcaaaaatatttaaaatacattataaggtcttgtggaaattaaactttttctatattatgtacgggctataaataaccggcacgcctaaaggtgcgctgattttctaagacattaagaattaggtcaatatttattgattatataccatcaacctttgctgtattgcatgatcagtgtgtggatgggctttgcgctttggctattgttatttatggttaagtgctaaaatatcctttgtttgaccaaataaccaagttgctaggtttatgcactctacatctactgtggatagaagtaagtgtctgaaaaagtttgatctttgtttttgtagctttatttgattagccagctttaccattttgttattatcaggatacgtttcataatgtcattctagtttctgttgcttcctatctttggttgtgataagcattcaggccccgtttggctaatgggaaagggaaatcatttcccacccactaaaagacatctttaaatcctaaccattcattctccctcttccatttaatcctaaccctttattcatttcccaatcccaatctcaccccagggttaagatatcttattttccctgcatcagatactcaaattaaagcattatttttagtgggtaaccatgtttttcagaaccactcgctctgatgacaatttgttactgctatccacgctcatttttcatatcaagttcagaaactgaaacttccgccccatatagcctgctgccttttccactctattgattatttaatgtattatacaaaacaacctaatcgttgagggatctaattagtctgatgtgttttgcaccctcttgaagtatggtgaatgactgctaatttttgtgacacaagaaatgggaaaatacatgctaagtggactagtttaggagtctgggcggctgggcctgatgaaagttctgtgcgtctcctttgcagaacttagaatctattccgcgagaacactatattttcaaacggagtattaattttggtacaagggctggctaacaatgcagggagagggagcacgtgcatcagtatacacagatgaatgtgcctctgattttagctttcttgctataagttgccctcctgttgtaaattgggcataagtaaattttttctattttgttttgcaaaactattatagtaagcttaagcaccccaatccctttcctgatgcagtgttgatggttttgcttgcaggggcgagggacattgtttggagaagaggtgcgccgcggcaatgaagctagcctattccgttctattcacctatcaatgacgagaagaaatgttggattttttcccccttccttaattgtggcatggatttactattgctggttttggggtcctctggtggtgtagagaattttctatgggggcccttttcttggtgacatggacatagactggtggtgaaaaaaaagaaaggatggtggtggggatgttatacattttaagtactatatgttacttgtcatatatacatatctgggagatctgaaagctttcctctgattgctggcgttggcgagctaaacaaccagtgcacgatgagcgtcctcttttttaatagcgatcggatcgcgtacgtgctctcttcgacgcatcaacttttgtactggtagttctctcaatttggtctaagctcccgtcggagggctcatacaacttggattcggggtttgggtaatggggataagaccttggacgctgatttggttatactcagaaaaccattctctcgtccttggcgctagtttggcatggagcgctggaatcaatcaagaaagaagtcgatctttggccaagtccaagtgcagcgagcgttcatttgctcattcgttttagtgccttggtttgatgcaatgtggactttacaaaaattaacgggcctttacaattgaatgaacctttttacatgtttctaattttaaagaatgaatcaatgttaaatggattataatgtgtttagtatttaatttcaaaatatgaacttgtataaagaaattaaaaatgacagtggattatttagatgatgaatgataatggatttgaatttatgtttcacttgtaagttactttgatttaactaaaaaggcaatttattttaaaagaggtagaacgtattttatttataaaagatctgtcattatctttttagctgaactaatttttcgatgtgctataatttcttttatgaacatgtaattttaacgttgctactcctttcatcccataaaaaactaatctaatactggatgtgacatatctagtactataaatctggacatacctttgtctagattcattgtactataatgtgtcacatctagttttagattcgtttttttttggacggagagagtactagctagtgattgtggggctggctggcccaagcattggggcgcacaaataaatagcgccatggtgcgagagagagaacgacaagggtatatctatactttctatatagttggtacccactaaattattagaagctaaagcttaacatgcaagcatgccacatcatcacccactagcaattactattctagcctattttaatcccatgcaagcatgatacatcatctacaatattatattatagagatcaacaagtatatgtcaaatcatcttcctcacattattttctcaacatttcaactatcatcatttctacaatatttaacatatatttatccgtgaatcccgcagcaaagcgcggggtatcacctagttatacaaaaatcaaacccgatcgagtctcgctttctcctcgcgtccgatgtttctccgtctccagtcatatatatttgaagggaaggggccgaacaactcttccttggtttttgtctttagtttttttttctccgtagatattcggaatttatttgcgaagttagggatgccacgtgctcctggcctaacgggcagctttagaaaagtattctatatatttcatattacttaaaaaactgcccatgcctggcaacgatgagagctattttaatcctattattgttactagaaaaatgcccatgcgttgcaacggacgaagtctattttaatcttattattcttatatgatttagttaagatgaaattcactgtgagagttcgcttggatatatatatatttttagaaaatcataagctgcagttaggagtccaatcgtcttaagttagcatgcgagtttttttaaagagatttcttatatgatttcttctgtattaccaaaagtgaacaatcttaaaaaccgactcaaaaacggatatgtatttccaaaagcaaacgaacttaaaaaccaactcatacacggatgacgtaccaaaataccggcaaaaacatcttcaatgtttataatactagagataagtcgttgtttttttcataatcaagtttatagggtttaatatttcaaccaaaataaatatattatcatatatatatatatatatatatatatatatatatatatatatatatatatatatatatatatatatttaatgctaggtttaataaaattaattctataaactcgagtcataatacaatttgaataattagtagcattctttaacaagacggggtgtagctcatatggtagagcgctcgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccctgtataatgaaataacgcccctttggcggcccggtatt

SEQ ID NO: 10090 - DNA, 994 bp, Oryza sativa
atgcagaattctgtgcaaattaaacccttgatactattgccttccggtcatggaatcgagctaggttttttttgatggctgtaaaatcacgggcctcaccgaagagagactggatttggagagttggacccccagagatttttctagcaattacttaccataggccacgaagcagcggttgtttgggcgaaacgtcgaatatctgagggtccacaactggttttcaacgaggtgtttagtattcggatggcacataggacgttagggtggatagcttagacgatgtcggtgtcaagcgcgtcgactaaccgcgccgttaagttaggctggcgggcgcgacactgtggaatgcagatggagaattctttgcaaattaaaacgttgataactatgccttccggtcatggaatcgagctaggttttttttgatggcttcagacccacgggcctcaccatggagagactggatttggagagttggacccccagagatttttctagaaattacttacaataggacacgaagcagcggttgtttcggcgaaacgtcgaatatctgagggtccacaactggttttcaacgaggtgtttagtattgggatggcacataggacgttagggtgtatagcttagacgatgtcggtgtcaagcgcgtcgactaaccgcgccgttaaggtaggctggcgggcgcgacactgtggaatgcagatggagaattctgtgtttttcctatttatatgatttggaaatcctgtgaaccaaagaggcccagaatgtatgctcaactgtttgaatggttgaatagtggaattatttgagtgtacatatgacctaatctttatactattatgaaattgaaacatatattgaaaaaagtattataagatattcacatatagtttgtaaaaatcatatcttttaggagctagtaaagagtgtttatttaatccaattattagaaaagtgatgaactacttgcagtgagcggaaatcg

SEQ ID NO: 10091 - DNA, 2967 bp, Oryza sativa
  unsure (1)..(2967): unsure at all n locations
caaggtatataatttgcacagaattctccatctgcaatccacagtgtcgcgccgccaagcctaccttaacggcgcggttagtcgacgcgcttgacaccgacatcgtctatgctatccaccctaacgtcctatgtgccatctctatactaaccacctcgttgaaaacccgttgtggaccctcagatattcgacgtttcgccgaataaaccgctgcttcctggcctatggtaagtaatttctagaaaaatctctgggggtccaactctccaaatccagtctctctagggtgaggcccgtgggtctgaagccatcaaaaaaaacctagctcgattccatgaccggaaggcacagttatcaacgttttaatttgcaaagaattctccatctgcattccacagtgtcgcgcccgccagcctaacttaacggcgcggttagtcgacgcgcttgacaccgacatcgtctaagctatccaccctaacgtcctatgtgccatccctatactaaccacctcgttgaaaacaagttgtagaccctcagatattcgacgtttcgccgaaacaaccgctgcttcgtggcctatggtaagtaatttcaagaaaaatctctgggggtccaactctcgaaatccagtctctcttgggtgaggcccgtgattctgaagccgtcagaaaaaacctagctcgattccatgaccggaaggcaaagttatcaaggttttaatttgcacagaattctccatctgcattccacagtgtcgcacccgccagcctaacttaacggcgcggttagtcgacgtgcttgacaccgacatcgtctaagctatccaccctaacgtcctatgtgccatctctatactaaccaccgcgttgaaaaccagtcgtggaccctcagatattcgacgtttcgccgaataaacagctgcttcctggcctatggtaagtaatttttagaaaaatctctgggggtccaactctcaaaatctagtctctcttgggtgaggcccgtgattctgcggccatcaaaaaaaacctagctcgattcaatgaccggaaggcaaagttatcaaggttttaatttgcacagaattctccatctgcattccacagtgtcgcgcccgccagcataccttaacggcgcggttagtcgacgcgcttgacaccgacatcgtctaacctatacaccctaacgtcctatgtgccatccctatactaaccacctcgttgaaaaccagttgtggaccgtcagatattcaatgtttcgtcgtaccgaccgctgcttcgtggcctatggtaagtcatttctagaaaaatctctgggggtccacctctccaaatacagtctctcaagggtgaagcccgtgattctgcagccgtaaaaaaaaacctagctcgattcaatgaccggaaggcaaagttatcaaggttttaatttgcacagaattctccatctgcattccacagtgtcgcgcccgccagcctaccttaacggcgcggttagtcgacgcgcttgacaacgacatcgtctatgctatccaccctaacgtcctatgtgccatctctatactaaccacctcgttgaaaacccgttgtggaccctcagatattcgacgtttcgccgaataagtcgctgcttcctggcctatggtaagtaatttctagaaaaaactctgggggtccaactctcaaaatctagtctctctagggtgaggcccattattaagcagccgtcaaaaaaaacctagctcgattccatgaccggaaggcaaagttatcaaggttttaatttgcacagaattctccatctgcattccagtgtcgcgcccgccagcctaccataacggcgcggttagtcgacgcgcttgacaccgacatcgtctaagctatccaccttaacgtcctatgtgccttccctatactaaccacctcgttgaaaaccagttgtggaccctcagatattcgacgtttcgccgaaacaaccgctgcttcgtggcctatggtaagtaatttctagaaaaatctctaggggtccaactctccaaatccagtctctctatggtgaggcccgtgattctgcagccgtcaaaaaaaacctagctcgattcaatgaccggaaggcaaagttatcaaggttttaatttgcacagaattctccatctgcattccacagtgtcgcgcccgccagcctaccttaacggcgcggttagtcgacgcgcttgacaccgacatcgtctatgctatccaccctaacgtcctatgtgccatccctatactaaccacctcgttgaaaaccagttgtggaccctcagatattcgacgtttcgccgaaacaaccgctgcttcgtggcctatggtaagtaatttctagaaaaatctctgggggtccaactctccaaatctagtatctctagggtgaggcccgtgattctgcagccgtcaaaaaaaacaaagctcgattccatgaccggaaggcaaagttatcaaggttttaatttgcacagaattctccatctgcattccacagtgtcgtgcccgccaggctaccttaacgacgcggttagtcgacgcgcttgacaccgacatcgtctatgctatccaccctaatgtcctatgtgccatccctatactaaccacctcgttgaaaaccagttgtggaccctcagatattcgacgtttcgccgaaacaaccgctgcttcatggcctatggtaagtaatttctagaaaaatctctggggttccaactctccaaatctagtctctctagggtgaggcccgtgattctgcagccataaaaaaaaacctagctcgatttcatgaccggaaggcaaagttatcaaggtttttatttggcacagaattcttcatctgcattccacagtgttgggcgcgtcagcctaccttaacgggcgggttgtcgacgggcttgacacccacatcggnttaagttttcaccctaacgtgctatgtgcg

SEQ ID NO: 10092 - DNA, 7483 bp, Oryza sativa
aaccttaacgggcgcggttagtcaacgcgcttgccaccgacatcgtttaacctatacaccctaacgtcttatgtgccatcccctatactaaccacctcgttgaaaaccagttgtggaccctcagatattcgacgtttcgccgaaacaaccgctgcttcgtggcctatggtaagtaatttcaagaaaaatctctgggggtccaactctccaaatccagtctctctatggtgaggcccgtgattctgcagccgtcaaaaaaaaacctagctcgattcaatgaccggaaggcaaagttatcaaggttttaatttgcacagaattctccatctgcattccatagtgtcgcgcccgccagcctaccttaacagcacggttagtcgacgcgcttgacaccgacatcgtctaagctatccaccctaacgtcctatgtgccatccctatactaatcacctcgttgaaaaccagttgtggaccctcagatattcgacgtttcgtcgaaacaaccgctgcttcgtggcctatggtaagtaatttatagaaaaatctctgggggtccaactctcaaaatctagtctctctagggtgaggcccgtgaatctgcagccgtcaaaaaaaacctagctcgattacatgaccggaaggcaaagttatcaaggttttaatttgcacagaattctccatctgcattccacagtgtcgcgcccgccagcctaccttaacggcgcggttagtcgacgcgcttgacaacgacatcgtctatgctatccaccctaacgtcctatgtgccatctctatactaaccacctcgttgaaaacccgttgtggaccctcatatattcgacgtttcgccgaataaaccgctgcttcctggcctatggtaagtaatttctagaaaaatctctaggggtccaactctcaaaatctagtctctctagggtgaggcccgtgaatctgcagccgtaaaaaaaaacctagctcgattacatgaccggatgacggaaggcaaagttatcaaggttttaatttgcacagaattctccatctgcattccacagtgtcgcgcccgccagcctaccttaacggcgcggttagtcgacgcgcttgacaccgacatcgtctatgctatccaccctaacgtcctatgtgccatctctatactaaccacctcgttgaaaacccgttgtggaccctcagatattcgacgtttcgccgaataaaccgctgcttcctggcctatggtaagtaatttctagaaaaatctctgggggtccaactctccaaatccagtctctctagggtgaggcccgtgggtctgaagccatcaaaaaaaacctagctcgattccatgaccggaaggcacagttatcaaggttttaatttgcacagaattctccatctgcattccacactgtcgcgcccgccagcctaccttaacggcgcggttagtcgacgcgcttgacactgacatcgtctaagctatacaccctaacgtcctatgtgccttccctatactaaccacctcgttgaaaaccagttgtcgaccctcagatattcgacgtttcgccgaaacaaccgctgctgcgtgtcctatggtaagtaatttctagaaaaatctctgggggtccaactctccaaatccagtctctcttctgtgaggcccgtgattctgcagccgtcaaaaaaaacctagcttgataccatgaccggaaggcaaagttatcaaggttttaattttcacagaattctccatctgcattccacagtgtcgcgcccgccagcctaccttaacggcgcggatagtcgacgcgcttgacaccgacatcttctaagctatccaccctaacgtcctatgtgccatccctatactaaccacctcgttgaaaaccggttgtggacccttagatattcgacgtttcgccgaaacaaccgctgcttcgtggcctatggtaagtaatttctagaaaaatctctgggggtccaattgtcacgccctgataaattcatcccgaaataaaaatcattttctaaaaggaataatagagttaattaaaattcgaaaagaaattggcaaacactaaaatacgtacaagaaaaattcaaatgtggcccggagaatttttgttaaattctccttgttctaaaaggagccctcaaaatttacttgaattttcagagcaccgaaaatatttattaaacaacaacaacaattaacaaagtttattaaaaagaaaaagctaaaaataaatcctccttcctcctttgggccaagcccagcaaaagtctccctctcctccctctctttccctcctctcccgggcctgtcctcctcctcccggcccactcttcccctccccctctcggcccactccctcctcctccctctccctcccgggctgcctctccctcctctcctcctgggccgcctcggcttcgcccggcccaagccgagccgcgcctcccacccatgccgcgcacgtgcgcgtgcgtgcgcgccgttgccgcgcgttgaccgcgcgcctgcgtggggcccacgcgccaggtcgtcgttctcctcccgcccggcctcctcctctctcctccgtgaaccctagccatttcctccctcaaatccgcttgattcatttggctaattccaaaattgattagggggttttaatccccattgattcctcttcaattccccccaatttcccccttgattcgtgcccccaatcgtcgggaacagacgcgtcttccccagccgctttccatggccgccggccgccaattccgccaccgttccccgctcctcccgtgctcggctcccttccctccgctataaaacggaatccactcgctccgttctatcgttttagccccctcccgcgatctcccgtggtccctagccacctccccgccgtcgtcccctctcccgtgccgccggccgtcttcagccgcccctgccgccgcgttagcacgccggccagctgtgccgtcgcctcctccagcgtcgcagccgcctcctctccgccggccttccctctgtttcccgcgaagacctccggaagtgcatccccgccggcaacagtggcgttgccaccactgttccgcctccggccgcctctgccgcgtcccctgtgcgccggccgacgtcgccaccacctctcccggcaccggaacgccatcctcttccccggccaagccacggcatcgcccgtatttcgccggaacgccgttgcgcgcgccgcctctccctcggtctcgtcggcacccactccggcagccccttttgccgtgccagtgcgccggccgacgtcgccgtctccacctccggcatcgcagcggcaaggtcgccctcggcctcgtctccccttcgaccgaacccctccgcggtccatcctcgtcatctctattcgttctcgtcgtcgacgtcccgtcggtcgcccggctcgtcgtctcgcggcgccgcctccgtcgtcggcatcgcagtggcgtgttccacgccatcctcgtcttcgtgcagccgctgtaggctgcccacgtcgcctcctcgccggccccggtcgtcgtcgtcgtcgccctctcgtcgttcccggttgtcgtggcgttcgtccctccgtcaagccattctcgttcgtcgtcctcgcttcgtcaagtgccgcagccccatcatcgtcttcgtcctcgcctccgcgtcgtcaagcctcgtgccggccgtgtctcgccttcgttcaaggatcgccgctgaagtcgttcccttgccatccgtctccgccgcgcccgttcgtcgttgtctttcccacgcctcgtcgcgtggtggtaaggatctctcctctcgctgccccgtcctcgtcctttcggtgtcgccccgtacccgttgtgcggttgtcgaccccggtacccgtgtaccggtgtcggtagtcgttcacgtgtgcgggtggtgaccgtgtagtgtccgtgttagtgtgtccgctcagtagccgcgtggtttccacgtgtgcagcccgtgtggtgtctagtggagtccgtttgtcggccactcgcctcggttgacacacggggtccgcttccgtcgacccgtggaccgtctccgtgtactcggtctaccgcggtcctttaggttgacatgtggggtccgcatgtcaacagcgcagccttcctgtcttttccaggctagcgcttccacatgttttatagttgcaaagcttaattataataatccgcaaatctccatataacagcattaaacttcggatgatcatatcttggtcatacgagctccgaatcgacctgttcaagtctcttaatgtttgttataacctaaagaaccgtgtgctttctttttatatattgttattgcttctttataggcttgtagctttgcttgtgtgcttcgcgtagcttctgtcgttccggaggttcccgaagcgtggttcgcggccgtcgccgaaggttcggaaggccgttctctctgagcaaggcaagtcacatcatccttgaacatattgaatcccagtttataaaattattctgatttaaattattgcattatcgctttatttaaatccccgcgttatcactgttttatctagccatgcctatttacctttgttatgaccttattattgttgttattgttattattaccttgttcaccctaggataaacaaaaccccaactagtgggtactctattcatggttccactagtatgaatttaggtagatgcttcgctgattaattaggcaatattaggtggttttataactttagactttgggaattctcatatcatttggacactatagaatagttggcttatgttggaattggacacacacctccccctctattcaaaacccccaaaatggttttaggctgggctcgaggtgcgtggttgggtttggttagtcgtacctcgggtactataaggattaagctcgggcctctgttgcaaagcactaccgtacttccatatgtctagtgggtaaggcttagtttgtggctcagtctggttataaacaaaagtacacggatggagatggacgaagtcgggggtcgatggacatctctaggacaaatgaaggctacatgagctgtggctcggtagtcgagatgtcatggcacagggctggtgtcctgctgctaggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttttgggtaaagatgtacacctctgatcagagtataatctattcgaatagccgcgccctcggttatgggcaagcctagcaatgtacccaagttagtgttttagttcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtctttataaaatggctttgggcaactaagtgacttttaaatgctgttttctacaaaacttaacccctatattattaccccttgtacccccttgcattaatcatgcatccaccggtgtggcttgctgagtactgtggttgtactcattcttgctcaatctttccccccccccttcagtaagagaagctttggagaagaagtcttaggtggagtcctggcttataccccagttgagcgcctgtgaagatggagccgtatgcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaatgtatttttctcggtcgcgacaccaactctccaaatccaatctctttagggtgaggcccgtgattctgcagccgtcaaaaaaaacctagctcgattccatgaccggaaggcaaagttatcaaggttttaatttgcacagaattctccatctgcattccatagtgtcgcgcccgccagcctaccttaacggcgcggttagtcgacacgcttgacaccgacatcatctaagctatccaccctaacgtcctatgtgccatcccaatactaaccacctcgttgaaaaccagttgtggaccctcagatattcgacgtttcgccgaaacaaccgctgcttcgtggcctatggtaagtaatttctagaaaaatctctgggggtccaactctccaaatccggtctctcttcggtgaggcccgtgattctgaagccatcaaaaaaaacctagctcgattccatgaccggaaggcaaagttatcatggttttaatttgcacataattctccatctgcattccacagtgtcgcgcccgccagcctaacttaacggcgcggttagtcgacgcgcttgacaccgacattgtctaagctatccaccctaacgtcctatgtgccatccctatactaaccacctcgttgaaaaccagttgtggaccctcagatattcgacgtttcgccgaaacaaccgctgcttcgtggcctatggtatgtaatttctagaaaaatctctgggggtccaactctccaaatccagtgtctctagggtgaggcccgtgattatgcagccgtcaaaagaaacctagctcgattccatgaccggaaggcaaagttatcaaggttttaatttgcacagaattctccatctgcattccagtgtcgcgcccgccagcctaccttaacggcacggttagtcgacgcgtttgacaccgacatcgtctaagctatccaccctaacgtcctatgttccatccctgtactaaccacctcgttgaaaaccagttgtggaccctcatatattcacatcattcactcaggtttacatctcaacgttttttttgcaactaatgtggcatctgaaaattgagtttctttgcatctaaattttagagtagtttagaaatttatattgtatcctctctgttttatttacaaaaatgagtagtttttggtttttagagcagaaatctagctgcaatgttcacaaaaatgtaaagagagattaaaggggaacacaaccaacttccgggatccgcaacagcacgcgcgttgcgatgattgtgcctgcagtcaggtccctaatccgccgaccttagctatgtgattcatttttgtgttgctgtcatcagtgtttcacttgttctgtaggccgctcgcgaagtacacactggagttgtgtgtgtctacgccgccgccggtggccgctgcggccatgaaggagtgtgtgcttgatgagtacgccaccaagcacaggatcttcatcgataggtttctccagcttaggat

SEQ ID NO: 10093 - DNA, 5792 bp, Oryza sativa
  unsure (1)..(5792): unsure at all n locations
agtatggtgctttccgtttgactgcaagtcgttcatcatcgacgacggcgagcgacggaggacgatggcgacggcgggacgagctccggaacctcctaacgaacaaaaggagaggggttagagggagagaggagagtgcgagagggcgagggcgccggccgaaggcggcggccatggcgtcactcaccggcgcacgacggggatggggctccggcggcgaacctcgacggaggaggggtggacgaggtggacctcggccgcgcgaacccaacggcggcgacggcgcggtgcggcggcgagtgtagcggcggctagaggcgaccggagtagcgggagaggcggcggcggatgggcgcacggcgcgggagcaatggagggcacgggagagagcggtggaaaaagaaaaaaggtggaggggagtgcgggcatgctttataggggctcgggagagacggacgtgtccgaggcgagcccgatttcgccggcgacgtgggaggttgaaggtgggggagagagagagagcggcgtgattcaaatttgaatcccggccatctcggttgagggcgcggcgagacagagagggggagtgggtccggaaggcgcggcgcacgcacgggcgtggccgacgtggaccggagaaggcggggtgcggcggtttcggcagcggtggcaacgtgggcggccggccggaggttgggaaagggcccgacaggtgggccccacctgtcggcgaccctggggagaggagggaggcggccggcctggctgggcctcggcttgcggcccgcccagcagggaggagggggaggaaggagagaatgggccggcggcccattcgaaaaaagaagaaaaagggaggaaaaagaaaaggaaaaaggaaaaaggattttccctggaattaaaatattgcttgctcaattttaattggttaaaattatttctagagctctgaaaattccactaaaaatcctgttagtgaatttcgacatgtagaactcaagaaaaattccacatgcccattccgattattatttgcattactttcttagggttttctcttgattgcacctgcatttttttggggtcgtttataaactaaattttaggcttgggaggagaacttcggggtgtgacaccaagccgcccctccctctctccccgggacgccgacaggtgggccccacctgtcggacccgtccccttcctctagccggcgccgccgcgcccgaaaccgccgccgcagcgcccccgcctccgcctcctccgggccacgtcgcccacacccgcgtgtgcgctgcgtcccccgcgcccactcccctctctctcccgcccgcgcccgcgcccgagatggccgggattcgattttcgaatcccgcctctctctcctcccccactccccacgttggccggcgaaatctcgcctctcccggccatgtccggccctcccctcccctatttaggcttccccgtcgccccctttcgctttttccccatctcgccgaactccctcgtgctccccatcactcccgcgccgtgcaaccacccgccgccgccgtttccgctactccggccgccgctagccgccgctagggtcgccgccgcactgcgccgtcgccgccgtcaggttcacgaggctaagctccaccccggccaccccttgcccgtcgagtttcgtcgccagaatttgcatcccctcgcgctccggtgagttcaacccctaccgccgccttcggccatacgcgccggtcgccgtggttcatctccctccctctaatctctctcttctccttccttagggcaccccgaatcccttccgccggtggccgtcgtcctcccgtggctcgccatcgccgttcgccatcgtcttcctccgcgccggccaccctcggtgaggcatcctctcccttctattcccctccctctccctcttagccgccgctttagcgccgccgcccattagccgtcgctttagcaccaccgcccgtcggcgccgcctttgcgccgccgtctccgccgccggttgccgtcgccggcaacgcgtgtgcgcgcgccgtcgccgtcgccgtggccgcttggccggtcttgagccgagctgggtcgccaccgcccgtccgatcggccccgagggcgatctgggccttcggtcccgtggactggcggtggaccacccgcgtggtcccggtccacggtgaaccgccctcccccttgtgccgctgaccggtggggcccgcttgccggcgccgcccccccccccctttgatgacgtcagcaaccatctttttctttggaaaaataaataataattgcgtcataattcgttaataattctagaaattcatttaaatggctcaaaacttctaaaattcatatctaattcattcgaactccgaattgagccattcaacttgtaaattcatctaaaattgagctctacatgtttgtttagtttttatgtactgtttccttggtttttattagagtttttcctcgttttgcgtgccagcgtgtagaatccgtcgtttcggaagatcgcggtcgcaaggataagagttcggaagatcaaagtgaagaagcaaggtaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagttgatgggataattacagtattagaccttttaatatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagaggggattatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatacactgtagttcaggtgggttggttgggcctgttcaatgtggtgtagcgttgatcaatggagattcaatattactttaattactcaacagttttactgttttgctcaataaaatgttttacaacctcctttatgcaaatagccacaaaccatccttgtatccccttgcacatctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttatgtttggaactgtatattacttgtcgttttgtgtaccctggctggtcctggacagggatttaatacgcaaaatagtctggaaatttgggttaaatttctgggcgtggcaaagtggtatcagagccaacttgactgtaggttgagccaaatggtcaaaccctaaggacaagttttctgaaaaccctatttgcaaattgtctcctctcgcccttcggcatttctttgtcaaacggttttcaaaattctcctcccaatctctccaattcttttagttgtcacacctagaggaccagccgtcagcttcatgtctgttcagaagtcaagtcaagtcaaatctcaagcttcgcgcagaaggagcaagaagatcagcccagagtcgtcgtcccgcgaagatcaagtgaagtttccccggagctgacccaaacccaatccttcccagaagagtagttccgttagctttctagatcgtgtgttgtttgcttgtgtgtaggggtatggtttgcatcattggtggggatgcgaccatactaggttgtttgcttaaacaacttgaatcataaaatccattcaccacagatcaataggcaagtggtttagtacctcatctttagtaacccctctcatctccccctccctctcttgtgcccgcagcaattggtcagcatgagggacaatttcaacggatcaggatcccatcagtttcatggatcaactcagctcaattctaatagtattccacgtcagcctcttgaagatcagcctcaaccccaagtcatggctaatcaaactcagatagtggaagagttgttacaacagatgcgacgtcggtaccaaatataccagatgcaacagatgcaacgacaatgtcaggagtcacgtcaatgtcacccaccgcaggtgcgagatcagatgccagcccggaacccgaatcagagtcagagtcaggagttcccaatatcagcaccgaagacccctgtcaaaatgcagtccagatccccgaagataacgacagccaagtcaacgtcagaccaaaggacagtaagtgctacctgttatgactgtggtgagcaaggtcattatgtaaggaactgtccatggaaggtgttcgccaggtcacctgaaaaagacgagaagtagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacaatgacgacaacgatgatgataatgatgacaatgatgatgcgacccttgactgtttcagggaaagagagtgaagttcaaagcatgtgctagatgtgggatagtcggacacactgctagctattgcctccccacatgccgctgtggtgaatatacccattactcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactactgtaccagtgtgaggcgattnnnnngcacac

SEQ ID NO: 10094 - DNA, 1170 bp, Oryza sativa
  unsure (1)..(1170): unsure at all n locations
tcgatttccgacgcgggcaaggcatgtataaatatggtattttgatcttgaactgaggtcctccaaggaggtattgacggcggcggaaattgaatccatcgaacatgtcgaggcggaaattgaatccatcgaacatgtcgagactgatcttcccggctagattggatccgagtcgaagagcaagagcatgttgaagtggtcggcgaaaaaaactcccgaagcgaagatgaattcggtgactcatgaagttgattccatcgcacttgtcgacaggtaactcgacgcaacccctacctggcgcgtcaactgtcgaaacaaattttcggcaatatgaaaagggggtagagcacgagacctaaaagtggatggatgtggagacaaaggatttagacaggttcaggccctctcgatgagaggtaataccctactcctgtttggggatttgaatccgccgggtgtatattgatctgacgatcagtttgtgtcatgtcccctagagggcttcctgcccaccttatataggatggggggcaagattacaagatagaaaccttaaccaatacggtatcggtttcctaaatctattttacaatattatcaaatcaggactttaggccgctccataatataaaaggaaacgtaatacccaagtcatgatcagttacatattccatagatataagctatcccctatgactaatcggataaccatgccgtgtgggtatggggtacccataatctccacagtagcccctgagaccttcacagtcgtaaagataatcttttcttgaactagattacttcaaagccgagtgcttcaatcatctccgccatgatctcccgagtgcttttaccaaatatgaagactgtggagggctaaaaaataaagtcaggtgcatcgaatagatgtacctaatagatgcaccaactgagtggttttgataattgtagtcaaccaagcgacttgatattaatatgtagcatatgcggtgtgaatccttgaacgacatgatccgagtgatataccgactgctttgtaaaatatgatgagtgtaacctaaagttggctacattattgaaaattcacatagcaaaacagctataaagaagcttgaatgccgtgaatatgatgagctncttgcagagngcgccagtcaatcaaggggcgcg

SEQ ID NO: 10095 - DNA, 739 bp, Oryza sativa
catggcggagatgattgaagcactcggctttgaagtaatctagttcaagaaaagattatctttacgactgtgaaggtctcaggggctactgtgagattatgggtaccccatacccacacggcatggttatccgattagtcataggggatagcttatatctatggaatatgtaaccgatcatgacttgggtattacgtttccttttatattatggagcggcctaaagtcctgatttgataatattgtaaaatagatttaggaaaccgataccgtattggttaaggtttctatcttgtaatcccgcccccatcctatataaggtgggcaggaagccctctagggggcatgagacaactagatcgtcagatctatacatactcgacggattcaaatccccaaacaggagtagggtattacctctcattgagagggcctgaacctgtcttaatcctttgtctccgcatccatccacttttaggtctcgtgcgctacccctttttaagacttacggcttgcgtcttgttccctcacccgcatgagcctcaaatgctgacgggctaacctggatactcatcatatacaaaaagttaattatttcatggagtatgatagaagtaaattatatatcataaataagaaaggagcgcaccactcggttgcagtgattacagtagattctttgatccttgatatacccatcaactttcctctgtgatgaactactgcaggaacgcacacc

SEQ ID NO: 10096 - DNA, 744 bp, Oryza sativa
atgtagtaccgctctactgcaagtagttcatcagataaatattatgaaaattgtttaaaaaatatgatataacatttgtagcccccgactcactagtcaacagcgaaccagttgatatagtgaggcaaaggaaaaggtaaaatatcatataaagaataaaacaaatgatgacttagctttgtcgtattccctcggtgacagcagaagtagccgatgtgggaatgaagcagtctatcagtggtgacaaaaacaccagtcggtgccagtggaaccaagccagtggtgtagataatgaagcccattaacggcggcgaagtccgccaaccgtataggcgaaaacaccagtcagtggcggcagaggcaggccggcggtgaagtcgtagacgcccaacagcggcggcataatagaccagccgtgcaggcggaaacaccagtcggcggcggtgaaggccagccggtcggtgaagacgtagacgcccatgtatggtggtgtgaccaaccaaccgtataggcgaggacaccagtcgacggacgcccaacaacggtagcatataataggccagccgtgcagacggaaacaccagtcggcagcggacgaggcagccggtcggtgaaaacatggacgcccatgaatggtggtctatgtgccatccctatactaaccacctcgttaaaaaaccaggtgtggaccctcagatattcgacgtttcgccgaaacaaccggtgcatggtgcctatggtaag

SEQ ID NO: 10097 - DNA, 869 bp, Oryza sativa
  unsure (1)..(869): unsure at all n locations
tcgtctgtatgtagggagtattcagattattgggttgtttnctatcacctcctatcactccgacctttcttatattagtgagatttcgcggactcttatataaatccnntnttccnnnnnnnnnnaagagttagattttgcattgcagtaccacntctcactataccgcgaattcgagctcggtacccaaatagtacttgcggtaaataataccgcgctgcgtgcacataacacaaggttgttgttctgtctatattggctgattgcataaagaaacataaatctggctgaggtgaataattgatcattcggagccctctatatttattgatattgaagccacaaccatctaataactggctggtataggtgaagattatcgcctggaatgtatatttacatagggaatcacatatacccagataacaggttaggacctaatattggcataacatctaattgctttagtcttttatcctgaaaattgaacacttgttcttactgaaaacagaactttgatggatgtctttattgcagaacacttgctcgaccaagttcctccacgaagccagaagaagctctgcatggatgacaggctaagtgaccttcctgatacaattctacaccatattatgtctctcttatcagcacaggaggttgcacgtacgtgtatcctgtccaagagaaggaaagaaccttttgcctcagcaccatgccttgatatctgggtacataaacttggaatggacagggtgcggttcagggagtttgcagcacaattggctgctattccgggctcctaaatcacttaatacatttcgtcattactttttttaaaatcaaccatgcccactcttggatcaaccgtg

SEQ ID NO: 10098 - DNA, 5158 bp, Oryza sativa
  unsure (1)..(5158): unsure at all n locations
cccccagttgagcgcctgtgaagatggagccgtaggcccgctagtccgctgctgtttatttttattgtcaggcctgaggcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacagcatgcggcagcggcgcaagacggcggccgacggcgaccgaccggcggcggagagcggcggcgtcgcggcgaagcggcagctacgcggctaagcggcggcgcgacggctaaacagtgcgggagagagagagaaagaggaggagagacctcaccgacaacgatcgacgacggcgagcgacggagaacgatggcgacggtgggacgagctccggaacctcctaacgaacaaaaggagaggggttagagggagagaggagagtgcgagagggcgagggcgccggcgcacgacggggatggggctccggcggcgaacattgacggaggaggggtggacgaggtggacctcggccgcgcgaacccaacggcggcgacggcgcggtgcggcggcgagtgtaacggcggctagaggcggccggagtagcgggagaggcggcggcggatgggcgcacggcgcgggagcaatggagggcacgggagagagcggtggaaaaagaaaaaaggtggaggggagtgcgggcatgctttataggggctcgggagagacggacgtggccgaggcgagcccgatttcgccggcaacgtgggaggttggaggtgggggagagagagaaagagcggcgggattcaaaatttgaatcccggccatctcggttgagggcgcggcaagagaaaaagggggagtgggtgcggaaggcncggcgcacgcacgggcatggccgacgtggaccggaggaggcggggtgcggcggtttcagcggcgatggcgacgtgggcgggcggccggaggttggggaagggcccgacaggtgggccccacctgtcggcgaccccggggagaggagggaggcggccggcctggctgggcctcggcctgcggccggcccagcagggaggaaggggaggaaggagagaatgggccggcggcccattcgaaaaaaggaggaaaaaagggaggaaaaagaaaaagaaaaaggaaaaaggattttccctggaattaaaatattgcttgctcaattttaaatggttaaaattatttctagagctctgaaaattccactaaaaatcctgttaatgaatttcgacatgtagaactcaagaaaaattccacatgtcaaatccgattattatttgcattactttcttagggttttctcttgattgcacctgcattttcttggggtcgtttataaattaaattttaggcttgggaggagaacttcggggtgtgacagccgggccccacaacaatcgcgaaagatcccgtgcgtagccgatagaactagcaccgggcttctccttcccctccggacagcgcgtggcccatctccgggttgactgcgcgcgcatgtcgacgttcggccgccgatcatgctttcctcttccgtggtcacctggtctgtggctcctctccactccgctcaaccttcgcgattgattcttggatttctcaatcggtccgtggaggtcatgcccgatccctatcaattcggagaacaactcgcggtttcctttttggcgtaaatctagtcgaagtcagcctctgatttgtttgaattggacgacgacgtgaggtgcctcgctgagtagtggtcatcgatcgctgctgcagctgcgagcacgagcagtgccgttgctgccgcggagagcgccatgagcaccacctcccaatgtgctccctcggccaggtccgagcaagtcagcctcctcaggatctacacatagaacaaacaaaatgcaagtgccttggcaagcttggcgttggaaagcttttgtgtgtcacagactgggaagaaaatttggtaagactgaagtcttacgctcctgcaaaagacttaatcccttgtgcaacacgtgtcccgtcacaatctcaaagcacagaactccctcaaaccctcttaactatgcatcctgacgtcgttagcacgtgagaagacgaacggacgcggcgcacgttgctgtggggagatggacgagcgcggcgcaggagatgaaccggtgctcctgcgtgaggtgcggcaagtgggcgaatcaaaccctgaagccggcgaagcaagccaaggtgagaagatgcttgtttttactatccatctgctgttgattcttccatatggctaatagattgatgacttaaacacgatttttgtttcaatttgattccatctagtgttggtagtaaccggttttatgttcaactctattggccatcatgctatgggtgaaagctcggattgcaatcttgagggtcataatgtagagttcagatcagattgtgagaaatttgaacaatttgctcaatcaaatataaaggtaagatgctctttttataacaaattgaccacatccgtgtagaagtcatctataaactcattcaagaaaatattcgatttaatatatgcttccattgtacttataggctaccaatcagaatgctccttgcgagcaagtgccaaaggttggcatgacctttcaatctgaggatgatgcatacaatttctacaattcatatgctagaagagtgggctttagtgtaagaaagtgccattgggctttagtgtaagaaagtgccatgttaactacagagcagatggtactttatcatccaagtacatggtttgtagtaatgaaggtcacaagaacagtaatccaacacaccagcctaagaaagaacgtgcttgtacaagaatagattgcaaggttcgtgttcagttctttatttcccgggaaggtatttggaaggtgcagaaagttgaattggcacacaatcacccttttgtaagtcctgacaaggcacacatgcttagatcacaacggcgtatgtcaaatgccgatgaacatataattagcatgatgcaacaagcaggagttaagccagctgagatatttgaattttttcaacggtggtcagatggagatgaaaatgtgccattcttacaaatggattgcaataactttattggttgagagcgcaaaaaatatttggaaacacaagatgcacaaacattattggagtacttggataacaaacaagcagaagacccttctttcttttattctttgcaattggacaaagaggatggtcgaatttgtagtttcttctggacagatggtcaggccattgtagattatgcttgttttggggatgttctctccattgacacaacatttcaaacaaacaattctaaaatgccatttgctcctattattggaacaattcatcacaggcaaactattctttttggagctacattattattcgatgaaagtgctgattcatttgtttggctatttagaaactttctgaaagcaatgtctggaaagcaacctgaaacaattttcacagatcagtgtgctgcaatggcaaaggcgattaggattgtattcctaagctcaagtcaccgtctttgcctatggcatatcactacagaaaagtaatctttagttaccgtatattttgttaccaacgaatttggtagctacatgtgtatcaatagttaccagtatctaattccctggtgactaaaagatctacaggaattcacaccaacttgtccttcacaaaattgataaacgtgataaccatgggccttctagggccttttgtcaccgaggctaaggccttttctcttcagacctaaacctagcaagcacaaaaaaacccgaggtggaggaggcggctgcgncggccgcgcgaggtggtggcggcggctgcggtgcgtgcgcgaggtgaagaaggcggctccggcggccgcgcgaggtgaaggcggcggctccggcggccccgcgaggtgtaggagacggctccgtcggccacgcgaggtgtaggagacggctccggtggcccatccggctgcatcaggaccagcatcgtgagtccagtgagatccattggtagtggttgcggctagttcggagatccatctgcagcggctgcagcaagctcaggcaaggagaagcatcctgtttcacagctacatcgacgggttcacgatcccttttctaggtttgtgattcaaattacatacattaattttattattaactgaactgattttgagcaccatagaaatgctttgaactgatatttgaatggttgttttactcttgcacgtttgatttcctaagtactatggttttgtggattgattttgttgtaatcatgttgaagaaattggtgctgctatgtctaatgagagccttgaactacaatagtttggcaaatgcctcagtttaggtgctcacttgccccaatttttggtttgggtgtgatatgattgaatttgttgtgtgatgagtggttactgattattggcccactactcaccatacgcctaacagtaataattagtggtgacaaatttctagtccgaatttaattaaagccattcactgcttccatgccctgttttgatttggttgtgagaaatgttttcctagtagatgacactagaataagagaatatactacagaccaatatagacctatatatggtcttgcaatatttaatacttgtgttagttcagctatgtataacataagaaaattgcttggtctacttacaaatatatattaattagtgacatatatatgatattatatttcagtccacaaattaatgatagctagggtgcttgtgcaggactttaggatatggataagagttggatgaatttgcctgataggttctcacaaggttatatagccggtgtgaatgcatttaccgaattttcctgtcagcaaaatagagacaaggatgcactgctttgtccttgcgaaaggtgtatgaatataagccaaaaacctatcaatgaagtccgaactcatctagtattatatggcatacaagtttcatacaagcattgggtttttcatggtgaacaagtggacctagatattgatccagttgatgagcctatcaatgatgaagatgatgaggattn

SEQ ID NO: 10099 - DNA, 733 bp, Oryza sativa
  unsure (1)..(733): unsure at all n locations
cggtttgatgattgacaaccgacctcggnacccttatgttcatggattttcgaattttaacatcattgatcaataacacgagcttcttttactgttcagagtagatctggaaagtgattgcttcttcccttatttttgtcttgttttagataatactaggaagaattcattgaagaaaaatgatgatgcccttcctggtcataaaggttttgtgcattacttctctacactggctatagattacctcagtattgtattgccagttcttctgattttcacagtaagtattctttcataggacttggagattacattgtagcagtgttcaactatagaaatcataaaatatgtagagaaccaagcattggaacacaatgcataaacttttaaccaactattgttatttgcttattgcaaatgttataatgaggtttaacacttcttagagaaaaaaagttaaatagcaatcttttgattattccttggtttgttacaggttttagctgaatgggcttgtgcttgtgcactttctcttgtaatgctgatatctatcctcaccatgtttaagaggtaccatatctgagttcttacacctgtttttcttgccacattctctctaatttctattacaattctagtcgaccaccctatttcctttatgcaacaaaatccatgnnnnnnnnnnnnnnnnnnnnnnnnnnnnnnnnnnnnnnnnnnnnnnnnnnnnnnnnnn

SEQ ID NO: 10100 - DNA, 2524 bp, Oryza sativa
  unsure (1)..(2524): unsure at all n locations
cgcggatgatgacaaacctatagcnnnnnnnnnnnnnnnnnnnnnnnnnnnnnnnnntattaaaaacacaatgaagaaaagaaaataataatagagcaaccggatctagctagctaggctagctctatcttaccaaccgggactaaaaaggctctatctttagtcccagttggtaacaccaaccgggactaaagatgtatttttactcccggttttttcacccgggactaaagatagtgatctttagtcccggattggttgtcccggtttgaaaaccgggactataggggggttacgaaccgggagtaaagcccctttctccaccagtgtcatcacccactagcaataattgcatgcaagcatacaccatcatctacaatatatttaattctacaaatcaacatacaagcatatcaaatcaccaccctcacatcatttacacaatattttaacaaatctatctatcatttttatagtatttaacataaatttatcaacatgttgaaaaaatatagtcagaattacttagtaatctcacagcaaagcgcggggaatcacctagctaactaatagatgggtacctgcgcgttgcggccaagccctgctcgatgttggcatatatggtgccgtggggttttggcaccagtggctggaaggtgtcggcccaatcaatctccttaacttgcttctagaaaaaaaaaatctatactaccaatcatgtatatactatgacagcacacgtgcttttgtttcacatcctatcgaataattaaatgttagcttgtttgagttgtggcttataaattgaaatcagttttgaatggtagaacataattttaggattagcttagggattttcttttgtcactgtgtcttattattttctatgttaaaagtagatctagaaaatgtaaaattttaccctaaaattattttgaattccaccagtcacatgtttttagctcataaaccgtacggggaaaaaacatccagctagaccctagatcgtcctagacctgccgaatatatatagctagcatccccgacaaatatttccattttatatcaacaagctatttatatatgtatatattttaataacatattagcgagatgtatgataaaataattatgtatgaataaaaacagtacaagaatattacagttgacttgtctacaaaatttactagagaaattttacacagtgtagttctaggaaaagcatttctcacggagagagtgtgcgcttctatacgcacaattgcacgagtcgcaagtcgcaacacgatttttttctgttattatacctgccaagtaacaagccaccttttcaatcttagaacacataaattttataagttctttatagggattagttcgatttccctaaaaattcttcacggtttctccatttcaaaggaggctggttccctgaagtgtagtgtgactgcaacataagcaatcacaggctacaactattcgatttgaatttaagggtaaggatttgctatagatgagctattatagcgcaatagatctgaattcttcgtgcaaaaaaatggatggacaagatcaactgcagttacgactgtagctgatctcaatccatgggagctcctgtgacaccaaaataatctaatggcatgggagctcctgcgtcacattggaggcccccagttggtgtggtgttctctgtggcgatgttccaaccagaccggcttcaatggttagagcgatggcaagatctaggcgaatgactgaattacgtcccagttaatctgcaacgttatctttctttgtggttcttatggtcaatgatgtgagtgagattcaatctgtaatgatcatctcatgtttttagagattatgtttctttgtttgagaagatcataattaaatataacttgcaagctattgggaaacaacggttatatacacagattctcaatagcagttttacctctgtctttaggttgatagttcaagcagttttctcgttttaatttaagttgtgattttgtaattcatagttatttgaccagtaatctgtgtaataataattggctatatatatatatatatatatatatatatatatatatatatatatatatagtttagagcaagactagaatcaattcaatctctgctattataaaaattaaagatgtttttgccgatattttggtacgtcatccgtgtatgagtcggtttttaagttcgtttgattttagaaatacatatccgtatttgagtcggttttaagatcattcacttttggtaatacagaaggaatcatataagaaatctgtataaaaaaaaactcgcatgcttacttaaaacgaatcgacttctaactgcagctcattattttccaaaaaaatatatatcccaagcgagcttccacagtgaactttcatcttactaaaccatataacaggnataaggataaaatagacctcaccccgtgcaacgcactggcatttttatagtatttaaaaaaacaagatgggtgcaccatagg

SEQ ID NO: 10101 - DNA, 3048 bp, Oryza sativa
  unsure (1)..(3048): unsure at all n locations
catcacggcatcgccccttcccgcacgaggcaaatctgacgcctccaccaccactcatcccaccctttcgccgctatcggatccggttaccaaccgtcgaggagaggagataaagggaggagaggccgaaaggaggataggtgaagtaatagggaggatggaaaaggaattaacgcatgggaggagagaaaaggagagggagcgggactacgaaaataaaccatgtaggtaggttttttattgggccccctcctattttttctacattttacatactagtaagcatgcacgtgaaatccacgtgactaaatatttaataaattatcataactcaaagattgacaacaattgcatgtacaggttcagaagcaacaaatatcccctttactgatcaatacatatcctcaaatttgacaagcaaaatatgattgttaaagatcatattatgaaattcacatagcacatgccaaaatcaggagataatatagcaaatcttgagactttggatgctcaaacacagccaatgtaagatgcttgtttggttcagaaaattagactacaaacactaatgtgcagaatgacaggactaggccatcttgtaaacaactcttctaactcgaacacctcaacataattcaggaagaacacaagaaatagggcaaccaatttagattacaatgctccaatccaacaggattgagccgccgccgccatcgccaccaagttgcccgttctgagttttaattcagttcattacattgcttatgtctgaatctcacccactcactcgttctttcccctcacacacgccaattcacacagctttcaacagcacacttacatggcccaatcaggcccataattacgaggattcgccttggcctgtctagccggacgccgagtctgaattgggtccttcaggctggacggcctcccctgtagcccatccgatacgcctccttgttcagcagtatcatccccttctggtacatcatcagtgctcctggcacatctgcagtttggtaataagctcataaacatcccactacttgaactcacattatgttcatatcaatttgaaacatctttggggatacaataactgacgggtctgcactttaaagttctgaaagaaaacttgatccaagacagaagacatggagatatgtcagtgttaacctgttggtaagatctgtgtagggaagagacctgaaagatggaaaaagacctgaaaggaagtgaattgaagtggcctgtatacaattcgctggtgttttttgcagggataatgcttaccaggctgtgcaaaggcagacgatggtgcaggtccaatggaaggcatgagcgtgggtcagtcggcggcaggagcgcggttgccagcctaggaaaaggcaaggggtcagtcggcggcagcgttcaggcagggcaatggcgaggagaggcgacgccggcgggagcgcgcgcggttgccggtggagagaaggcgaggggtcagtcgatggcagcggtgttcaggcgaagtgatcgcgatggcgagataggctgggtgcaggcggagtgcggttaccggtcgaggtcaagggaaggcggaggcacggagggcaggcgtgttatcgatcgagaggtgaggcggaggcggagcacgtgggctaggggtcgtgggactgaaggaggattgcgtgtttccttcggaaaatccaagacttaatcccgtgcgttaattcgagtggatcggacggataggaaagacctgtggggggtagtccaagttgctccattgtagtatagacggttctttttaaccttgccaaaaaactgagggtgtatgaaaaatcatttctttacattgtgctaactctctactcatgccaacgtaaatcaaatacagcctctacagttcatgagccaacgttgttatcctcataaaaaaaactgataaatggggacaaattaatgctataatctgaaaatctccacaacgcataaattaaactctatcctgtttaggagtccatctgacaacaaaaccgccaccaaattcacaacctatgcatgcaatgctccaaaaatacatccaaacctatggggatgctctactagctaaattaattaattatgaatctcggctcttaattcgctatagctagcacacagatagctagagagatcacgaacataatcacatgccaacaaacccaagtgaaaaagatctcacgaacataaaaactgcattgccaacccagagatcgagagaattaatttgccccccggaatataatcgacacgggattttgtttccttactatagccgcatgcatatctcgacagtatccatggcggcgcccccccctgccgaatttgggatcccgttcgttcgttcgcaggagacaacaagaagttaatgacggaaatgcaagctcaccacacgcgtatctgatcattcatgtttgccgatcaatgccgagatcgatacagctcggttaattagtttccccatcgagcagatcgatcgctctccctcttcttttttaaccgcgcagtgaagtagccgatcgatcggttgacgatcgacgcgcgcgtgctcggcggcgtttggtttgtgtgatcgatcgatgtggcgatccatggagaacggcggcggcggaggtggaggtggagggatcgccgggaagaagaggaaggcggttggtggcggcggcggcggcggaggaggaggcgggtccggctacggcgagagggcggcggcggcggcggtgatgaggagggagccgcggcgagggctcggggtggcggagctggagaggatcagagtgcagctcgaggcggcgcagagcctcttcatgatcccgccgtcgctgctgccctcgtcgtcgtcgtcatcgtcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10102 - DNA, 2668 bp, Oryza sativa
  unsure (1)..(2668): unsure at all n locations
nggagggggtagaagaaaaaaagggggaggaaagaggagaaaagggggaggaggaagagaaaggaagnnggagaagaagagggggaaaaaaagggggaaaggaaaggccaaaagaggaaaaaaggagaganaaaangaggagngagagaaaagagagagggnagaggaaaaaaggaanaaaagggggagggaaaaaggagngganaaagnaagggaaaaaaaaaagggggagggaggaggnaagggggaagaagaaaagggngaaaaannnaaaagaaaaaaanaaaagaaaaagaaaaaanagaaaaaaanaaaaaaaagnnnaanaanannnccgccgctgctgccgtctcacgtggccggcgtgcgctacggccaccaacaacaacaacaacaacaacaatacgtacgtgaaaatcaaggaattttttcttacatcatccaatcaaaaccctagctgacgatgatattggtatttatatgtgcaggttggaaatggagcagcagcgcgaacaagagatcaccatttcactccgtattattacggctcatcgccactgcagaagcagcagcattacactactactcctaatgatgctttgaccaggcacgtgcctagcttaattttgccttttgatactgacaaagtcagagcaaaatcttacttcctactcgtcctgacctagcctccattttaccctctgctaatcactaaattttcttaattctgcgtgtttaattgtgttattagcaggctattacttgcatcaaacagcagcagcagcagcagccaagcttatttccaacgtcagatcaatcaggatgcttcaggcaagtgcgtcgtgaacgcgtcccctctcctaagacagcaacagggttcatctgatcaggtatatatatgtgtacttgtgcaattgcgcgagaaattctgctagttaattagttactagatagtagcaatataatataatagttaatttgctgctacagttgttacatatatactgtagcagtatataacgtaaaagttacagttttgtaataatttttcacactattgctgaagcaaactaaaacatatcgctaaaattgcagtaaacgaatagtttttttaaattgcagttttctgaaatttactctataatataattgacactgctctaatgatatatatgcaggagctatacaggatgcagctgcaggattatcgccgccgtcgagcgcagccgcagatggagctgcacggcgagacgactgcggcggcgagtagatctcagagtattattccgtttgtgaacctcgtcgacgacgacgacgacgaggaggctgctgccggcgacggcgccgggaaagaattggacttggagctcaggctctagacaaccacgcgatcaaatcaaccatttgtggatccgcacattgctgtcagattgttgagatttaaactgaaacgaacagattctttgttctttgcatagaaagttcagttgtactagcatttgggggtaacttattaccccggagacgccctctttcttcaatatatatattccaaaatttccaattcagtggtataaatttgcaactcaaaagattggaacgttgagttcagtagtaatttatttatactctgaattcatagtcgctcagaattcagaaacacttctgatttctcatttctgtattgaaaaactctaagcttacgtaattacgtttcggtttaaagtttacgtaaagttggagggcgcctccacccccgccgtccaagtgccagcctgtactataaaaacgcccctccctggaaatttaaaaatccattaataattaataaaaaataaagctcgtcgtcgtcgccgtcttcctcgccgccgacgagtcaaagaggcggcggcggtgccggtaccggccgggcgcgccccggccgtgtccccgccatgcccgacctcaccaaaccccctttccctcgcccccgccgccgccgctgccgcctttgcggcatctgcctcggcaccgcgctcctcgccctcctcgtntnctccctcgcccaccttttctccccgccgcagccgcagccgcagctgcagccgccggggccctccccctcctccttgccaccgggctttgcggtcatcatcgacggggggagcaccggcagccgggcgcacgtcttcgccacggggcccggcgggcggccggatctggcgcggtcggccgtgatgcgcgtcaccccggggctctcctcgttcgccgacgagcccgcgcgggccggggattcgctgcggccgctgattgatttcgccagggagaaggtcgggggcgccgcggcggaagtgcggctcatggccaccgccgggctgcggctgcaggaggggcgcctccaggaggccatcctgtcgtcctgcagggacgtgctcagggcttccggattccggttcgaggactcttgggccgaggtgatcccaggtagtgtcgatttcttcccagttcgtaatgctcaagtgatatagctggttgccttatagatgggggactgggaattcgatttaggtgagacgttagaatttgaatctggtgatgaatctgacatattccatggaaatgctaaggtgtcannnnnnnnnnnnnnnnnnnnnnnnnnnnnnnnnnnnnnnnngttatacaaggcgcg

SEQ ID NO: 10103 - DNA, 12829 bp, Oryza sativa
  unsure (1)..(12829): unsure at all n locations
agggtggtnntttaatatactattgctgcacgcctgcangtcgactctagaggatcccctttctgaaaaatgtgtagtggatattaccgttgtttcttctctaagctgtatcgttgcgggttgaagtgtagtactcctgagaaatacggcctcaattcggtttatattctggtttagtgagaggcatcaagaaactgaatccggctattcgaaagggaaagcggtgtataaagtaatttgggtagtgaatcagtaaagggaaaatccattggatggtggatacagatggtttttcatcattagctgaaatattgtcagtatggatgctcattttttggctggttcatttcttataggctctgatgagggtatctatgcttgggttgcggcaaactatgctcttggcacacttggaggggatccacacaaaaccattggaataattgaacttgggggcgcctcagcacaggttctctgataaagacagataaattctttgattcctttcctttcctttgattttgagccatgaatcctctttaaattaaaatccatgctaataagatggtactaataagtaataaagttaagttatttaatctgaaaagactcacttacctgagatggtgttatctagaaccaagctccacatttgaatatcaatgttaacacggtgcttaatgctttggttatattaatgattttctgccaatctaattattgcttattgtttcagctgacatttgtttctgatgaagtacttcctccggaactgtcaagaaatttcacttttggtggaacaacatatactctctatagcaacagctttctaaactttggacaagtgagctatttgtatacattgaatcacccaccacttatgttatggacaatcttgtaatatgatacgatatgctgaccatatgattcaatttcttttgcagaatgctgcacaagaatccttccgtgaaatactgcggtcaaaaggtatctttttacttattctttcaatgtaaaggatagcaaaaaaaatagacatttggcatcccttacaatggtagctaggttgacaagggaacactaagttcccagaaatgagaatatcagaatattattcacagctaacaaatatgatgtgctgatgttagccaatagaacatcaataattagtatactaactatggctattctacttctgatgtgctacagtgacacaaatatgtcaggactatagttcaaagcaacagttgtacattttaagtttgatgagtgctgggttgaatatcaaagctgttatgtacttgcatccatcattgtattgttattcttttatgcattttatgctctgaatgaaaccaatatgaatacacaaattctattttattttcgttaattagcttttagaggaacttggctgcatgtactgaagttcaaagcagtgccttatcatgactcatgtggttgcagactccaaaaatggtacacttgttgatccatgtgctcctaaaggatattctcgcatcaaagaagtaatatcaagaccaagcagtgcttcaaaatcaaaattagagaatcaatttgctgatagtggggatggagactttacagtgtgcagatcttcttctttggcactgctgaaaaaaggcaacggtaggaaatgaatgtgccatgttttttgttaatccctaaaaggctttatttacctggttacttagttgctaacagatttctttcttttactttcactgtttgtgtgcttaagaataccatgaaaatgatctgaagaaaagttttatatgtgatcattagctaaaatatcataccagtaagatgaagataaacaaggttataatggttaaatatcaggttatccttcaattgttcaacatcaacaaagatgggaggttctttgatttcatagacttaatatcttctgtagcttgaatactttgttggagttttttctttgttctgacccaaggtcaatttagcatgatgtgtcagttcattaccacttttatcttctgaaattttatgtcctaagtgcagaagagtgccgatatcaacaatgccaacttggaccaacttttgtacctgagcttcgtggacatttcttagcaactgaaaatttctattttacatcaaaggtcctcaactctacatcctccttgttttccttgtacatgttttccatttcttaggacacctactcacataattatgtgccagttctttggactgaagcaatcttcatcactgtctgattttgtgcttgctggagaacaattttgcaacaaggacttgtctactcttaggaaaatgtatcctaatcggtcagatgatgatttttcacgttattgcttctcatccgcatatattgtagctctactgcacgacagtcttggtgtaccactggatgacaagaggcaagaataccatggcacatcaatcttccgctgaaattcactcttcagcgatcttatatgcttacctacttttaaatttaaatgttcttatatccgcaggattgagtattcaaatcaggttggagacactcaagttgaatgggccctgggggctttcatctcaaacataaaaggcgtaattgtagagccatcagcaactggtagatcagcccatagaagtagaccattgcttgctgtgctgctgggggtgtttcttctaggtggagcactttgcttggcaagatggaggaagcccaagacgaagatcatatacgacttggagaaaggccggtacataatcacacgcatcagctgacgctgacctttgtgcagaggaatcacatatatatacgacaggaatagatgtttgttatgtgtaccatagtgtacgagttcaattctttgtattctttctcctttttaagagctgggtgggagccttagaggagagatcaaggatagcatgtgtgtatgtacaggacttgtagagcattttgccatttacttattctatttatttgatgatggaataacctagctttgctcatgtacgtgatatgtctcagatccacttgttatgcatgcctcccctaattgtgaagcatgcaagaaaatcgttggaaaatggtaatcctcctaagatgtttgaggtgttatattgtcaatgttctgcaagctagtaagagtcaagatggccgagttggtctaaggcgccagtttcaggtactggtccgaaagggcatgggttcgaatcccattcttgacaatttattttttatttttacatccagagtttaactgccattctgataatttgtttttttgggtttatacggagttttaagtggtgtaaggtatttctgccaacatcggtggacaaccttattaacacacacaatttcggttcacttttgttgacaaattattagatccctttttcatgaatttagtgaggaatgttcttcccttttaatttggaaattttatctaagcatagaactagccaataatatgcaaacatttccctcttgcagcgatctggacaaccttataagcacacaatttcggttcactttgttggcaaattatcagatccgttttccatgaatttagtgaggaatgttcttcccttttaatttggaaaattatctaagcatagtactggcctattatacgcaaacatttccctcttacagcgataaaattttccgtatgtgttgtgttgtaaaaggggaaactctctcccttcattactactccgttccatattgtaataagttgtttttgtattgtcataagtcaaacttctttaatttcgattaaatttgagtaaattttacaaaactattagagtaattttttaaaaactgtttgtgtcgacgtttgatgtcgcgattccggtatttgcatagtatggggatcgttggtactaggatatatgcgagacttaggtaaaagagacggggacaaggatttttatacaggttcgggccccttatcttacaggtaatagccctacatcctgtttgccgaagccggtgttgctctttattcaccataatcacaccagtacaatatgtggggtagtctatctaactgttgtcgacttggcggtctgaagtgctgactcgtagtcgacaacagggtagccttcctccttgaatctgcatccagcgaggtcaaagatagtgctatgtctctcctgacagtatccgtagacaccgtaggggactagccatgcttatctctgaagtcgatatccggcgtcttgttttgatgcatgttggcttgtatgttgatctattgttccgtgtcccctctcctcctagggggccttgtatttatacccacagatatccccttgtccaagtagaactagagaaactaatatggatacaatccgagtagttcttgtcgtttccatgtagaactctattcatccttccttatgcggaacttctcctatattcgaaggttgtttccgtataagacatggtatgtggtgggtcctgtctagatttagtcaactactattaggtatgtggtatccataaccctgacagtttgatcgtttgatactttgctcaaactgttgaaaaactatagtaacattttttataacacaactagaatatttataactcaaaaataataataccgtcatgatctaaactgcaaattttggttttatgataacttcactactattgtaatttcatgatactctgctttaaatatgtagtctcatccatgataaagtaggtgctaaaactatattttggtaataaacgtcttaaattggtagctttacgatggtttggtcaagtatttttagttttgcaaatgtacttaaacttttcatgtcaatataattttaaccatttgtaggttttgtcttcaaaggtgattttgtaattccataacttttcttttgaaatacaattcatttcgagtagccacagcatgagcatttcacatatattttggtttgatttttcttaaaatagtattttttttaccagcttgagaaatgacttcttttacttcgatttgattttcattcttaatttacaaaccagttagaaatacgagtattcccccaaacttttagagctacacaaatttaggacttgttttggtttattgcaattcttagccttgccaaattggccattgttaatattttctccatgaattgggaaggacttcaatgccaaaattacattttgacattgaactaaaccaaataatttgacgtgccaatttctctataaacaaaacacacaactgatatttatagagtaaattacattttgggccacatatttttatcaaaattttactttaatctatcctcaaagtgtttttttttactttgggcgtattattgccaaatgttgcactttaaactggttgacccacatatcaatgagactaattacctttattgtacataattcacttatataggccaccctatctaaagggtaacatgtggaaacaataactagttcaaaatgaaaaaaaatactataagaataatataaagtgaaactttagtcagaagtgcaatttacctatatttatatttgagtaaattgcacgattagtacttaaatttccttaaatttgaaaaagaggtttcacctatgtccacaaatttgcaaacgcgtatcgatgtctctaaacttgatttattatatcacttcgattcacagtcttgtttgacaatgatcttgcatacgtggcatgccacgtgaacttacatggtatatttttattagagtaaattttactttgggtcatatatatttacctgattggcacattggaccagggataaacttatattttcacttgacaacatctttctttaccatgctttgtaggttggaccagggcttatcccttgggccaccaggaaagcctcctcggcccagtccacgtgaagcgcttgtttgtgtggagggggcgagtccaggcgtgtgtatgcgtcgacgcttggtggggagcagcgacggcgtgagatctcctcgatagcgctgctgcctacaggctacagcttccgccccttaaccaagggcatttctgtcgactggtgatcatcggcaaggtggatcccaacgtcatcctgtacaggagcgtaaccaatgttggggccaagggccacgacttccacgccgaatcgccgatgccgtggtgttctgttcatgcatatgacccctgatccacttagaagttgaaaaacttttgctaacatgattaggtcaatagattttgaaatcatatcagacctaaatattggcttccagattatgtgaagcaataagggcccaactattccatttggcattaattaagaaccaaactttctttttaaagttatgttataccaattgaactcaggagtaaggaacacaaattgattactcacaaggtacacaggaataaaatcccgcaagccccaaaacacacctgagttgcagactttaacatcgttttgatttttctctatgatacattccaagaccgaataacagactaatatagcatatatagactgcctccaccaagccaagtagcgatccgggcggttccacagcttctgcccttcggagtccggatgccattgtatgtgatggcgtcgatgtccaccagaatggtccttggctttgacgccaacaacatggtcggaagacgcgccccgccgaacatgatgaggcctttgaagagtctgaagagacgtcgataacagccgatgtctacgtgccgaggccaagctcacgatgcggctttagtggacatggaggggttgacacagagaagcgaagaggttccatacaagcaaacgcttcacatggactagcccgaagctgtcctgatggcccagatgctaaactctggtccaacctgtaaagtatggtaaagaaatgtggtgttaagtgaaaacatacgtttagccctggtccaatgcgccaatctgataaatatacatggccaaagtgaaatttactctttttattatctactctcttccttcttttttctccttagtcctccctccagcaagcggcgccaccattggaggcagcgggcaacgatgataccagtggtggcggcccctttaatgattcctttggcctgccatcgctatcaccattacccgtcgtggtcgtcagtgtcgctgcttatcggagagaggaagaaagaagaaaaaaaagggaaaaaaattaaaaagtgtcacatcatcattcacatggcaataaactaattttaagaatatcgatgcacgttctacaagtttgtagatctagataaaacctcattacaagcttatacgaacaactagtacaatttactttttatattttgagagtgccatttttcttcctttctgctccggcttggcccgtgcgccacaccttctcctccttcggtttctcttctcggcttctcgccttcttttccgccgtcgcgcgcgatccagttcagttcagatccccccccctctccctctcccccggcgcagttgcgctgcttcccctctcctccactccgccgccgccgccgcgaggcgaccaccgcccctcgagcaggcgccaccaatggacgacgagcccatcaacgcgcacaagctcctcaaggagcagtgagtcccaaaatgtcccccaaaccccccctgaaaacctctcgctggtacgcctcctaagaaccgtcctcttcgcctcgcgcaggttcgtcagcaacttgacggggtcttccctgctggagatcgccgcgctctccaccgtggttccggtgagttgcttagttacccccgctgaagtaggttagttggtgctgtggtttgacccctttttttttgggttgtgcaggctgtggtcgttctgaggaaatggagctgcggaggtcagttcgctacagattttgtggaatttttgacccgtttgatctattagtgcgattgtttagctgatcgatttgtacaagaaatagacgagcgagttgttgatatcatttagaagtgtggtataagattaccagtatgctgcattcttgcacatttagcatttggttcagatatgccattgcgagattgaaccagaaagttgacaggttgaattttttgcgtaatctcagcatgtagttttgataaatttaactcgattatgtgaaattttaccatgctctactccagtttttgattatgctgtggtgcccccatctgatgttatggatgttatgttcatggattttcgaattttaacatcattgatcaataacacgagcttcttttactgttcagagtagatctggaaagtgattgcttcttcccttatttttgtcttgttttagataatactaggaagaattcattgaagaaaaatgatgatgcccttcctggtcataaaggttttgtgcattacttctctacactggctataaattacctcagtattgtattgccagttcttctgattttcacagtaagtattctttcataggacttggagattacattgtagcagtgttcaactatagaaatcataaaatatgtagagaaccaagcattggaacacaatgcataaacttttaaccaactattgttatttgcttattgcaaatgttataatgaggtttaacacttcttagagaaaaaaagttaaatagcaatcttttgattattccttggtttgttacaggttttagctgaatgggcttgtgcttgtgcactttctcttgtaatgctgatatctatcctcaccatgtttaagaggtaccatatctgagttcttacacctgtttttcttgccacattctctctaatttctattacaattctagtcgaccaccctatttcctttatgcaacaaaatccatgctgattagaaactaatgcattccctatattctaaggtctcgatctcatctcaaagctggaccaaatgagctgcctttgctccgagcagatatatcatcatacagagtatctgtggtacgtaaaagttgattaattggaaaaatactactcatttaattacttctcagtactatatatccaacagaactattgaagttaatggtgatggggtgttttgaaggttctagtaacatgcctgtgcatattagcagtggacttcaaaatcttccctagacgttatgccaaggctgaaacatatggttgtggcatcgtaagttgtatctttcatctttttcattggttgtattttagttctttactgtctcaaagcatttttaatgaatcatgaacttgtttttgcaaaagtagacactggctgcaaattgtgcatccactctgttacctattctgcatgcttgtgatttggattatttgtgtttcccatcatgtttgaaacttaaaaagtttctgtgttttcttccccattcaatgacatgatactaaggtatctgcctcattgtccaacagatggatctcggagtagggtcttttgtagtggctaatgcactggtatctagacaagcacgaaactttactgcaatgtaagtccttaactacatatgatctcatatggctaagaaatctagggttttggttttcatcacagtgactttcagttctgaagttggccaaatataggcggagaaagtagattccatgtcttacgacagataatcttactcttctttggttataatattaggcaggttagagattgttgtttgttaggaactgtaggtaaaaaggaatatcatggtttagatatatcacatgttatataaatgatataaagaacatatatttattccgctggctttatctattgaaagtaggaacttctagtttagaaacctagaaggtacaggtacaaagcaagtcaacttcaccagttcgagctatctataaaaaaattagcttggtctgctgagttagttcagaattggcacactgaagataaattatgctgatctccacaattcttatatttgtatatctggagacaagtcagaaaagtaataacgtcaagttgaagctaagattgacttgatcacttttcacccacaaaagctttattatccatcaaatttctgcacctgctctgttttattgtaggacgatatcttttttaaatccttcccatttatttctctctccaaataataaaccatcctgagaaagtgacatgttgacaattcatcccacctttgtctaatataatcactaaaaccttatttagactctattttaatgtttgactttcgcagacatcattgtttgaatatttgaattttctctggatagtaagagtatattctgattgagaggtctgcaaatagtcactagtatgctgtgtcttacaatgcaacttcatgtgtgtccttaggacttggaataaagcactgatgtctataagccctctaatatttcttggttttgctcgtctcatatcgacatcaggtgttgattatcaggtatttttattcataaccatgtcaattacctaaattatgccttcgccacaatttgccatatgcattgacattaaatttacttcgtaattatgcacaatcctcaaactttgctttccttatccagcattttcaattaccatgtgattattttctcttgttgacttgttctagataccgtatatgtactgcacaaaacaaaaatgtactgctgtcttcctaaagatgcatattctatttctcattttctaggttcatgtaggagaatatggcgtgcactggaacttctttttcacccttgcagcaatttcgatccttacgtccgttatcaggatccatcctaagtattgtggattagctggtctgcttgtgcttacaggtactaaagattcatttgaatagtttattttcaaatgtgctacagcctccttttcatgtaccagatatttcatttgttttcaggattccaaacgtggctctcttttgggttgaatgagtatctcatttctaatgaaagaaacggtggtatcatcagtcagaataaggaaggtgtttatagcatatttggtaagtatactaatgcaacaaaacctctttcgtattaccaggaacactcacctctaatgtaacacttaaacaacccaattgtactactcacatcaacttgagttcacaaaattttccaatgctatttgtcatgaaaagttttgatgtcagtctgttatttatctgttatttctttgcttaaggtgccaataaataatcagcctccaacttgttggtggataattcaggcatacatgaaggtgtctgcacagcatatttctagccctttttctttgtttctattcacttatggatttcttaatatccatgcttattatatacatcttttgtattgccttgctgacctttatatgctgattgcatgtaactttttgatcctttttatacccgaatgtcataaatttgcatgcacctgattcttttttgaaaaagttgtggtgatgtgatgcaatctgattgattcatcccttttaacaggttactggggtatgtacctgattggtgtttccttgggttacaatctattcttcgacaatagttcaaaaggcaagagtaggagcagtcaagtggtaaaagtttgggttcttgctgcatctttttggtaagaaacaattttttcatgcattattcccagttataacctttcttcatttttaacaattcctcccatgccatgttacaggattatggcaatcattcttgacagctatgttgaaagagtttctcgacgaatggtaggatattaattgattacatgctttcttaagaaacaaaaaatctagactagcattagattgacaaatataagaaaccagatagttgtgcattttaatagtagtttatagtatattgagcagagttttattctattgaactgagtacccttgttatgatagttaaagagtatgctgtgatgaaatggaccagcatagcttagaaaattaaccgcatctaaagtgcatagttcctgatccgattactttgctgaccctgaggcaaatacctgacctctttggttcattggttcatactggtgaaccaaactaaatatgggtagttccaacggaaatttcctgttgttttgtttgcctccattatctgggagcagctacaaaaatttggtagcaccaaccaaatctaacataatacttccttcgtcccaaaatataggcctttttgaggtaggcaccgatattaagaaagtaggtagagatgattggagtgttgtgattggtggagaagagaaaataagtgaaaagaatggttgtgattggttgagaggagagggtaggtgaagaaatagcttcattttggaacaagttactgtgctagaaataactacattttgggacggaggtagatgtggttatttaaggctgaggaaatctcttgccaaaatattggttctgatacatttcaaacattctttttaacaaattctggccttgtccaggttgtttgttccccttatatattcaatataacttgatcctagaagccttgacacctgtgtacaaatgtggttcctttcaaaaaaaatgaaagggaaaacataccgttacttagatagtaatgcatatgatgtactacattgaaacattatgtgaattatgttggatgataatttaacatgtttgtatttgaaaaggtcttaaattataaaaactataaagatatagcatgtttgcatgatgtttaaatgtgatgatttgtagtggatgatgatgtggcatcttgttaattaagtggatgatgatgtggcatctttgtaattaagggnatgatgatgtggcatctttgtaagtggatgatgatgtggcatcttttgcttgttaacttaaaggagt

SEQ ID NO: 10104 - DNA, 12799 bp, Oryza sativa
  unsure (1)..(12799): unsure at all n locations
gcctgtggttttgatgacaatcctgaatgcgcgcacgtggactctagaggatccccgtccttagatttgaatttaacttgtacatttcattttgcagtgcaactttgcttatgttatgcttgtatttggacagaattttcaggtattgttcttcgcctttcttgattttatttaatttgcatacattgccagatttaggtatccatatttctcaattagcctctctaccattgggagaattagttacttgtactatttccagcaatggttaatagtaacacactagtacagtagtattacatgagtcaaggatataaataaaactatgcacttgaaatcttaaactgattgtgcatcggagttaacctacactgtgcatctttttttgtctgcatgctttaatattatcaaatgagaatgaaataatttaactcagtctaatgtatagaatatggttgaaaatttcttagtctgttgtattcattgtttcactagctggtttcattctttgatgattgggggctacattttatgtattgtcagaaccatgaaatttggcgaggttcacgaatttgactgacataattctgttacttatggtttagcaaccatatagcctgttagagttttctgattgtatctttgctagatatagccatgttaaaattttctgtccagatttcactgatggcggtggctattttaaaaacaggttatatctattctcacactagctgggtttatttcatatgaaaagaacctggttcttgaagatgcattcaatcaaaatatgcttggttcattccttctggtaagacagtttggtcacaattttagaaaataattttcccaaaacagaaatgttccaactaatagatcctcaatttgagtttctagtatatttggaacttatttttggtaagtctgtatggagtaacatttaacttcatcttacaggcaaacatcctaactggtgtagtaaatctctcagttgacacactctctgcctcttccggcaccgccttcatgattttgttagtatactcctttactctatgcatgattgctgctttagctcagttttgcggtattaggatgaaattttggtgaattcaagagttatctaatacgatgtatgtatattaattactttctcagcaagctttcttggaataaagccaattgttaaaccaattagtctttcctgtcatctattctgcctgttttctgtatcttagacctagatctagatgattgctctagttccgtcccatatgaaaccttcaacgttctgagaagctgcaatagctaagccaataggttatcgtgccgtgtactttaagaagacatatatcacagatatgttggctaaattacgatctatgaacagctcattgttccattaattaggcagtactcaagaatttgacaaaactacctgcttagcattcaacgacccaaccttaatttctttcagaggaatccaacagataaatggtactcattccgatattttttgatgtttagcacaaaaacttataaaacttaatcaccactcatttctcaaataattagttttgggaccacctatacatttgttgacaaattttctcctaaaaatttgaatttgacaggtgtaattatagtacaatcatagtgtaattacactgtaacttgtatgtaattacactgtaacttgcatataactaccgtgaaacttgtatgtaagttccacataattttgaatcgttagatctattacaagatttgttctggtgaggaagaaagaaaataacagtacacacatgtgtgaaaggatttgttcccacagcctcattttaccgaaataagatgttatggagagatttttgaaagttacatacaagttacattatagttagtgtaattacatgcaagttacagtgtaattacactacgattgtactgtaattgtatctgtcaaatttttgggagaaaatttgtcgacaaatatatagcaaaattgttaatttttttagaaactatttagaaattaataagccgaaaatagggccagcttcaattgggccagaatcagacacacatcccgaataggaataagtccactttgactcccttaaaaattgacccgaatctaatccgtgaccctcaaccgtaaaaccggataggatgactccccgaactattcaaactagtgcaatttgactccatcagtggttctggatggcggttttgctgacgtggcgatgttgacctgatctgtgttgttgatgtggcacttatatggcattaaaataaaaaattatatgggctccattcgtcattcaaatgaaaaaaaattgcgaggcccacatgtcatcctttatctatcctccttccccccttcctttctcccttctctgtatgtttctcttcctccagattcggtgcggaatctggagtggcggcggcggcggcagggtgagggccggcacggaggaaggaacttgagcgggtcgttcggcggcgacggcctcagctcgccggagaaggcgggggcgttcggctggtggcctcccccacgatggtgccgcgccaggctgggacgaacgagagggctaatgtagacggcgaagcctgagacgccgctggccccagccgtgcctcttggtctgcgccggcagggggtgccgcctctgtttctttctgcccgaagaacatgcatgtgcatagcgttgcctagcagatgcaagtgcagcgccggtgtggggtagcaaggcgcggccgccatggaatccagtcgaattttggcaggaccagtagctgcaggacgaatccgtcctaccagcgtggtccacctgagtcctgcagatcttgaggtcgtggactggtctgattttattctttgtggtcactgtttgcaaggtcttcaggtcgtagacaatagctacttcattaccgaggacaacgtcggcatgttgaagctcgccaaggaggctaacagcatcttggttcgtcgatcagcgcattgactcatgttaccaattcgcctatgaaaattgctaacatctaaccgtgacatcctgtgattaattggtacaagcagtttgactgccgtatcccgcgccggagacggtgggttgcgcagtggtgcactcaaacggccacaccgcggcggccatgtccatgggcgggctgatgaacaagatgaccgggcgcatcggcaaggccatcatacgctccacgctggcgcgcgacgtcgccgccgtgatgaagtaaggggcgccgggctgcaggaggccatcgactactgcgtcaaggaacggctggacaaagggttcatcgggctcatcgcggtgttcggcaccggcgaggtggcgcacgggttcaactgcaccggcatgttcagcgagtgcggctgcaggagaaaagagagagaagggagggagaggggggaggaataagggttggagagagaaaggatgacatgtgagtcccacaatatattttgtgtgcaaatgacagacgggccctacaaaatatttttaattgtaatgccacataagcgccacgtgggatgaagaccgggtcaacaccgccatgtcagcgccacgtcagcaaaaccgccatccaaaaccgctgagggagtcaaattgcactagtttgaatagttcggggagtcatcatatccggttttacggttgagggtcacggattagattcgggtgacttttaagggagtcaaaatggactttttcctcccgaataaacaggctggaactaccctcctgccatctttaatgggctgtaattagcccacgatacccgtttaatggactgaaactaaatacttggcccactaccttattatctcaaatgtttggcccaccagttacaataaaagggctcaaacagtttttaggccctgggtgatcttaaacaggccaggacaaattaggcctatatatgattttggtaaggcggaattaggagcggaacaaacataaacaggccaggacaaaatttaggcacacaacagtttttggaagagcgaattttgacccataaacacgtaataatcaggctgaattttgtcgatttgtaagtctatatatccaataggcttcgctagcagctgttttctagcctcatcgtttgccctgaaaaaaattagcagctaccaaaaattaaattataaaatttaattttggagttaactttagggtattcaatatagttttgttttcagcattggattttaagtcatcaagtacatgcatataagagctttacctacaaattatttttggtcatgttttgtcatgtactacctccgttttttaatagatgacatcgtcgactttttctcacaggtttgaccattcgtcttattcaaaaattttaagcaaatgtataagatataaatcacacaaagtattatgagtgataaaacaactcataacaaaataaattataattacgtaaattttttgaataagacgaatggtcaaacatgtgaaaaaaagtcaatggcgtcatctattaaaaaatggagggagtaatcaacagtcaaccttggccaaccgatgaatggagagcaaagttttcatatcgacagaaaaccatgaaagtttgtcagttcacaaatttcacaagtacatacttatgtactactactacttccgtatcaaaatataacaatttttagctatgaatatggaaacatgttagatatataattataaatgtttatgagcctgttcaatttgatgccattttcaaccatatcattttttttaaagttaccaaaaaatatctacgtctagtttgttcacaaatttagtcaatacataagaaatcctgccaaaattttgataatattgccatcttgctaaaattttggcattgccaaaacatggtatggtttattttggttacaatttgaataggccctatattttaggataaagggaatataggataaagggagtacttacttaaatactcttacttcataaggttttggcaacaaattggtcagcaagttttcttgaaatgtagccaagttgctaaaccaattggtccatcttgtcatcaattctgcctattttctgctcgagtttctctatgttctatcccatttgaaagcctcctaacgttctaaacagatcgcaactggtcaatcttattaaaactgccgtttacttttgagttttgacgttgaaaaagactctattacagatcagctgaccgaattgaatacaacatgtgaagagctcattgttacattaatttggcgttattgtcagaatttcacattcagtatcacatactgctctccagttctcgcctgtcacgatagggtttaaccatcaaatcagtatgaaaatggcacctcccttgattgttactttctgcaattgctgtcttaagatttttaaactcgatcgatgtcataattttaacctgctacagctaagaataaataaacatgatatataaactcgattcttttagatcgtccctctcaaaataataataataggtggggtcgctatctgtatctggacggtgatttctatgagactgaccaaatattaatctccctgtaattaggtcaacttaagtcaaatatttgctattttactgattcccggtgtaatatcaatttacgccatctttattttgtttcccttttagttaaaagtacatataatttcccagagccgtccccaaaaatcttggggaacaagaccttatgtacttggtgaaaccccgtgcattgttgcgggaatttagtatgataaaaaaaaataaagtgtaatatagctagataacatcagattaagtaaattaacgtggtttatgataatttaaacttgaattgtagaatggcgattcaaacgtaaaaagtaaggtggtatgactttatggaagaagaaaaatagggagatagtttggacagtagattaatcatctaaaggttaaaaacaattaatgtgatacgacttaattagaggaaaaaaaagagaaagataatttggaccatagattaattatttaagcactaactaagtgaggatgaactatataaatatataggatattataaaacataataaagatatatattgaaacattatgtgaattatattggatgataatttaacatgtttgtatttgaaaagctcttaaattataaaaactataaagatatagcatgtttgcatgatgtttaaatgtgggcatcttgttaattagtggatgatgatgtgtcatcttgttagtggatgatgatgggcatctttgcatgttaagcttaaggagttagtgggagataactttatttacagtgagataggataccgtggcgacaactgctataccaaagaacattcacctacttaagtaatggcgatctgatgaagcagaaaaaaaaatcattgcaccaattcagttttgctgactaataggtgcaaaaatggaatccttattgcttggaatgcaggttcacatcatgatgtacatttctttaagataactatgatatcgtcatcgaatatttaccggagccgacgaaaagatctcgttctggtctaatataacggagcagaaagatagaaaataaaaaaaaaggagtgcagaaatcctaaacacatcagaacgtatgggtatggattaaaacatgtacttctggggggcctaaatttttggaggccatgtacggtcgctcatcttgcatgtgtctatggacgggcctgtaaatgccgacctctgcaccgactctttaattatttaacaataattaataatataagttttagtctgtgcatcaagtaaggttacacacatctatatatttatggaatattgatgtacatgagatttacccttttatagggtttgcgtcatgcatgcacccacaactctgtcaacccaccaatggtgcatctctaattaagagaatgaaatataatggccaagggacaagggttacgtgacaatgggagctgatagtacatggtggcaaaagtacgatagagctaagcacggcctaattatcatctaatatctctccttctcaagtcctaaattggccaggcaattaattaatcaaaggacggtcctccgtttcaccaaagtatgccaatattttcttatacttgctataattaatggtatggctaaaaatttgaccaccttatttttattgataaaacattcatagtaaagtgtggctgacaactaaacaaccccttaatattcagatagaaaaaaaattaaagaactataattagcggtggtaactaatgggtaaagaccaatgcatgggttctttcacaattctacctagcccttctatatttttagattaaaaatacataaaattttaatccacactattttagattcagccctcaaattttgtatgctaaaaacttgttggatcatttaaaatcccttgctatagtatttgcagtgataactgggcttacaatgttgatgaagattagttgaaaaatgattttaattacaattctttttctctgggttctttagctcgtcacttcattttaaaatataagcatttattgctataaatcaaaatataagtatattcatacccatcacttatatttttgaatccgagaaagtgccatattttctaatgtaaatatggtcttgtatatatatatctcgaatattttggccatgccaatgcaaatattgggtatttggatgcattgaatcctcggcaactgtacgtaggacaagtccatcgttttgccggtagttattaggcatttaggctacaactgcaaggatcagacgcgtcaattaatagtaagaaggaagccaatcacgcaaacaacgaaattaaatttgaaaatatactgtgattcgtttttttcttagaaatattcatgatgtaatttttttagcagaaatataccgtcgatcttgcgcaatcgttgcgcgaaagtgacgagagcgtgacgatgcacgcggtgtcgcgcgagaccgcgtggtatcgcgagataaaacagcgagagcgaacggtcccgcacaaggaatcagcgagaccgaacgtcttgtccatcagtgctgcttaattagtgattaattactctaattaactattaattatcctaattagcgattaattaatattaattaattgctaattaggataatcaatcactactctctccgtttcgcaatgtaagttattctagcatttcctatatcatattggtgttaaagaatctagacatatatatctatctaaattcattaacattaatatgaatatgaaaaatactagaataacttgtattgtgaaacggagaaagtaactaacaattttcaaccgttgctatcgctcattgggtgagcgagattgctcggtctcgcggtttggccgtgcgagaccgcgtggtctgacgccgccaccacacacgtcctcgatttcgccgttcggtgtcgtagtttcatcgtgcgagaccgtgcggtctcacgctaccaccacgtgacatcgtgcggtctcgcgctgtcattgtgcgagaccgtttgcgtcgtcacatccacgtcactttcgcggaactgttgtgcgagatcgacgatatatttatgctaataaatttacattccaaatatttgtgagaaaaaaacgagtcaacaacagtgtattttcaaatttatttccaaacaacgcggaacgctctatatatcttcatattcgtgatgcctttaatttggcttaaatttgaaggaatgtaaacaagacaacaactatatatatagctttggattctttaatttgcatgtcattaattatagctacagctagtagctactagcttagtttgtgacacgttttaatacattttttatatgattaattgtcggtcatgattgataaattacatacgtaactcttggcgagattaggaattgaagctggccacagcttatatgattaaatgtcggtcatgcttttatttctgcttaccgtttcggcgtaactggaatatatccgggaagaaattgaatggtcttcttcttggctgtttctcaaacgcatgcaagaataagcctcaatataattactatcttttacttcatgccactgttgttagtctattactgccattattgtctaacaattaataattgatgaataatttttacggttgtccctactactaattgaaatgatagtgatctagagcttcctgaaaacattgctttgttattgcaggttagccgatttgtgtgaaccgatttggtttctcagcgatttgattaaaaatgctgaattgcacataaatcagtccattttctccgtgtagattaagatcaacagaacgtttttcaccattctaaatagggccttgattaactcttttgtatttttctactgtttctcgtctcataatagtgattgccggtgcatgctcctgcttgtctatattaattattgatggttgtgttagtgtgctgttcaggacatctagttgcacacttgcactgcatatttaattgctaggacgatgaacaagtacaactacaaggctgcttcttttttttttcagcctaggaaaatgtacgtgtacaaccacttactgtcgtgtcactagttatcaatgacacttataatactctctccgtttctaaatatttaacgccgttaacttttttaaatatgtttgaccgttcgtcttattcaaaaaatttaagtaatttttaattcttttcctatcatttaattcattgttaaatatacttatacgtatacatatagttttacatatttcacaaaagtttttgaataagacgaacggtcaaacatgtaataaaaaatcaacgatgtcaaatatttagaaacagagtgagtattataatattagaacatatgatcaactacctcttttcatttatgcttacaattaagctaaaatttcaattctaaaatttaattttgaaggtgactttatgatatttttcatcgtagtttattttacagtattttattttaaatcgttaaaaatatgtatataaaaattttattcataaattatttattggttctactaataaaccataattaaggataagtataagcaaaatgatggagctggttagtagtgagtactgagtagctcatttattttctcagtttgcttgtaggaatgaggctagtgcagtgtggagattttttttccatgattttgtaaaattggctgtgagctaagactgtgctgctatttcctaattaataaagcactccccttaaaaaatatatgaaagacttatatgtcagtggtaattaccggcttaccgcagacaatacctagctgcatgataattctctttgatttgatgtaagggataagtggaccaatctaaaaacctatataccgggttatccatctatttatattataaaataagtgggttcgtgagccggttcgtttgcatgatgggctaatcttcaatatcctgcacatatatttctcgagccaaattgatggatgtcagatctgtgatggcatacaccgcattgaatggtgtacgtggatggggagagctcatcggctgctagcaaagcatgcagctgactcggtcctcttttttcttcttcagactggttggtaggattgtgatcaggaggaagattagcttagctagcttttaatttctttctctcttgctgcatttagggcttcgattgaccacttgccgcccaatctgattgaacaagtcagccatctctggcgcaaggaacgcatgcgcctacacattttcttttattataatccaaatttaaatttttaaaattaatttaattttatagtttattaggttctttttatcttaatctattttctagctttggctctcaatagctagtaatgcaaatataaaggttttattcataaattatttttggttgcttcgtttttttcttatcagtcgtagtccaacacccttgagtgtttagtattcccttcgctccaaaatatgaggggttctaatgcgcgcacgctgacagattaagttgtgtgcccctttctctcaccttatccattctattcccttctctctctcaccttatccatttcttcccctcccttcctctcccctcccctcctctcattctttctctacgccaacagtgagcgacgagtctccagcgattgtgacggacctccagtgagccctctccttttccctcccgcgaactgctctaacggagaagaggacacgcagtcgagcaatgacagcggcgacggcaagcggagcaggttagggcgacagacaaagccctttggtgagctccctcctccctccggctcatcctccttctcccatccgcctcgccaacgctcaagttcactgccaacgtagtagcaaggaaggcggcagcaaggtttggattcatcacgacggcagctatcgcgatgtggctgaccgttgcggcggggtgaagggtgagctccaggttgcagcgttgcatggcgtatgcaacgtggcggtggcccttgcggtgcggttgcggcatcctcatcgctgcagctatccgttgttgcacggcaggaatgattgtggtggtggcgcggtgccatgacatcatcatgcacttacctctagcgaaagtcccgaagtatgcttgtcctcagatccatgtcataggtgttgatgacaggtgcggctgcggccacttctagttggagggccagctggatttgcccgagagtcgaaggcagccgcggaccaccaagccagaggctgcttatcggtgctggttgtagtgccgacggaggcgacgcatggcttaggtggcgatgtaggctgacggcagtgttcaacatcgatgatgcctgtggactccacacaccttcctgaaggcgatgtcgcaatgctctagctcatcttcatgctttcgagtagatacttcaggtttgcccataatagcgatgacgacaccatagatgccacgaccttcttagaggcgtcgtgttagaggtccctgttggtaggggtgaaaacggtacggaaactttccggattccaggcctgttttcggaaacggaatcagccggtcagaattttttcggaatttctcggaaacggaatcgaaaacggaaatattttcttggaaacggaattgaatatgataatagcagtttccgtcgaaactcggaatcggtcggaaaaattctggaaaatttgtcggaatttccgaagttaaaaagacccatagaatcaatagtctataactcatccctaagtttccagcccaacccaaatagtggctaaccctagagaggagagagacaggcacacgacttcgcgagaccgtgagccggcggcggagcatcgcgctccgcgcaccgccagcgcccaccgcccggtgcccgcgccaccgcttctctgccgtcctcggctcctcgcgacctcgcccccaccgttttcgccgtctcataccgccactatcttgcggcgctgtcccgccgtttcgcggccgtctcgcagccacggcgccatcccgctgtttcgccgccgctacaaccactgacgacgacgccacagccacaccgacgagccgacgacgcctcgcctcagcagtcccagcagcctagcgacgagccgacgagcctaaatcgatttgatttcttttgtgctgcagatttacgatggatcgaatcatcaaatgcaagtagctgttttgtgattgaactaagtcgtgtgctgctgaacttatgtgtggtgctgagctgttttcaaaggtncaagggggttctaagaacagcgt

SEQ ID NO: 10105 - DNA, 1483 bp, Oryza sativa
  unsure (1)..(1483): unsure at all n locations
gcgtgatatctcacnnnnnnnnnnnnnnnnnnnnnnnnnnnnnnnnnnnagttcaagcagttttctcgttttaatttaagttgtgattttgtaattcatagttatttgaccagtaatctgtgtaataataattggctatatatatatatatatatatatatatagtttagagcaagactagaatcaattcaatctctgctattataaaaattaaagatgtttttgccgatattttggtacgtcatccgtgtatgagtcggtttttaagttcgtttgattttagaaatacatatccgtatttgagtcggttttaagatcattcacttttggtaatacagaaggaatcatataagaaatctgtataaaaaaaaactcgcatgctaacttaaaacgatcggactcctaactgcagctcattattttccaaaaaaatatatatccaagcgaactcccacagtgaacttcatcttaactaaaccatataacagtaataagattaaaatagacttcacccgttgcaacgcactggcattttttatagttatttaaaaaaaacaagatggtatgcaccatagggagtagtattaatatagacacgtatgcatgatactaataaatataaaaaataattttacattttgataagtattatttttctacctgctccactgactcttgctaatccatgtaacagatcagtgtatattcatgtgtgtactgttgtacggatccagagcactagtagcaagagtaaacagtaaaatccagcaacaactagtagtagtaaccactggctcgctagctaggctaaaagctaagcaattaactcgaattaattcttaatcaagtcgtgtggctctagtaccagtacttgcattgattggtagtaattaattaattaattaattagaaagcgtaattacggagagctacgtccagcagctgctcgtccagtgccagctgcggctctccgctgtcgtcgagcagcagccacgactcgatcgccgacagcggcgccaccccggccgccgtcgccgtcgcgtcgccgtcgtcgcacgcgaggagcatggacgacggcaggcagttggacgcgctggagtcgccgccgccggagcagcagtcggcggtgagctccaacgacgtcccggccgtggacgcgctctccgcggcggcgccaccgggcgtcgtcgtcgccgccgccgggttgcaggctgacaatcctttcctggccggaggcggcgccgcccagccgttcagcatcacggagatgttgcgctcgctcagggcgtacgccggcgccgtcgtcggcgcgggcggcccgctgctgatcatcgccggggaagcggcgtcttcgactgaaaggggcgcncggaaggcgcccctggcgaagtctaaggcggtctgcaaattgggcctccactgccccctggcgaacaaacggggtcttcggctttagccgccaagaagaagaagaggttagggt

SEQ ID NO: 10106 - DNA, 3765 bp, Oryza sativa
  unsure (1)..(3765): unsure at all n locations
ttcttcttaaggtggtggttccagaagttcttaacgtcgttgtcggtccggtggggaaggtagaagccgatgccggcccagcggttgccgaggagggcctggaggtggaggataaggcgctcctcgtggtgggagaagccgccgcggcggatgcccgggcggaggtagttggtccagcgnaggcggcagctcttgctgcagcggaggaggcccgtcctggcgggcacggcgcgccagttgcccggnccgtgctcctgcacgtacgacgccagcaccatgtcctcctccggcgtccatggccccttcttcaccccctccttctcgcaacacggcggccgccccatcgatcgatcgatccgtggtccaacacttgctatagctataccagatggaaggaagcttgagcttagctttatatatatatacacacagagacagagagagggagaaaaatgtgaaagtgactgtagcccggtggttataagatcgttagtagtacttttgggagtgaattttccataatttaacggctttgtgcttttagtgataagcgacgtacgtacccgttgacagcgaagcgtctggggtgatttcatcaatctccaggatttgctagcccgttcttcgaaggttctcaatagggtaaggtttgcgtgcgtgcgtttatagaggtgagtgtgcgtgtcttgtaagggtctgtgttgtactgtgtaattaaaaaaaacagggagaatgcccaggcaagcatgtgtgtgtatgcacatatagcctagagctgactagctggatcgtcataattgtttcaacagtggtatccatattagatttagtttttgtatggtgacccagaattatttatttaggagaatggattttaaactatccacgtgttgtctctttatttcttgtatgacattcaaatagttatgaattttttttaaaaaaaagagagaagatagattaattaatacatgatcgattacactgcattttacaaagatataagttaaaattcgacatccataagttgtagaaataataaattaaactttagcttagttaacatatatttacatgcaaatttgtttttaatgttgtagaagtaatatttaaaacttgcatgtgtacggagcaatatatcacatattatctatgttatcgaaatattttaattttttgcacaaccctttatatgacttgtaaggaactggcgaatatattcgcatcagtttagaatcgtttcagttatttagatttaaagtaacagtaagtactctctatgttcataaatacttatcgccgatttaatgagtaaatttcacaaagctacatcagatttaagatttatgagtaaattttacaaaaaatatggatactttgaccaaattatcacaaaattataggtatataataaatttattacaaaactatatgtttaaagctaaatatctaaaactacagatgatataataaaattatgataaaattatagattttagagtttaaagttttaatattatgtttgagttataaatattcaaattttatgattaattaacttgacgttagacttgtagttttatgataactttattattacatatgtagtagttttgtgatatatcattttaaatctatacttttatacttctatgaggtaatgtcaattaataatacttaaaattgtgttacctttcaaacgtaaaatcacttcattaaaattagattctttcgagtcaaaatcgtaactttggattcttccttaattaatcaaagtccagaaagagattttaaggcaacggtacgtgaacggtgtgaatggtgacggacggacggatgcggtgttaagttgatgatagtatcgccgcgtgcgtgcatttatattataaaatattgtataatgacgtacatatagtaatttattaaacttcaatgtggtacaacaatatcggtcaatacctttaatgctatatatgagccaaatacaaatggactaggaaatataattgacaaatttaacatagtacttataatattattattagataatggaattcattccggcctttgctttaaagaagctaaaaccaattattacaaagattatagctcaaaagactataaatgacaaaatcatagcttgattaaaaaacaaagaaaactatttagactacaacctaaagaccaggataagccaatggcttataagttgtacgtatagtctttgtcttcctaagctatgaagcagaatatccaaaaacaattactgatcattaccgattgaaacgcgcatatcatcgatgtcaacacagcgaaagataatgtcggagagcaactaagatgtaaaacaatcctacgcagtggcgaatctagaaaatcgattcattggtgtcataacgtgtctatcggtgtcatagtatactaattatacttaaatcatagtataataatacatggataagcagttttgttataggttttgccgaaagtcgttggtgtcacctgacaccggccctattattgtagctccgcccctgatcctacgctcaaatcttaccaccagcctaaccatcgaaaacggcaacagggatgtacactgcaccaacgggcaggggtgaaaatggtacggaaacagacggaaacaacttttatcgttttcgttttcatattttttccggaatcggaatcggaatcggaaaccccggaaacgaaaacggaaacgaatattatcgaaaccgaaaacggagcgaaaacgaaccggcgcggatacggtaacaaaaattattagaatacaaaaaccccttaaactaagcttcaaacttttgtcaagtccaattctcaactctcaacagtccacaattcatcataaaacacaattatatgaaatcgtctcaacaacaaaatatattcctctataacttcatataatttgcataacaaatattctaaaaaaattacagcaaaaaaccatggtacaaggtatacaatatacactattattcagtgctatactgctaatctgctatgagctatcactccatcatcagtacatagttcatcaatcatcattcatcagtcatcacagaacagcaacacacatcagtccatcagtacagtacttagttcaatcacaaaacagctacttgcatttgatgattcgatccatcgtaaatctgcagcacaaaagaaatcaaatcgatttaggctcgtcggctcgtcgctaggctgctgggactgctgaggcgaggcgtcgtcggctcgtcggtgtggctgtggcgtcgtcgtcagtggttgtagcggcggcgaaacagcgggatggcgccgtggctgcgagacggccgcgaaacggcgggacagcgccgcaagatagtggcggtatgagacggcgaaaacggtgggggcgaggtcgcgaggagccgaggacggcagagaagcggtggcgcgggcaccgggcggtgggcgctggcggtgcgcggagcgcgatgctccgccgccggctcacggtctcgcgaagtcgtgtgcctgtctctctcctctctagggttagccactatttgggttgggctggaaacttagggatgagttatagactattgattctatgggtctttttaacttcggaaattccgacaaattttccagaatttttccgaccgattccgagtttcgacggaaactgctattatcatattcaattnnnnnnnnnnnnnnnnnnnnnnnnnnnnnnnnnnnnnnnnnnnnnnnnnnnnnnnnnnnnnnnnnnng

SEQ ID NO: 10107 - DNA, 4540 bp, Oryza sativa
  unsure (1)..(4540): unsure at all n locations
cgatggttatcnaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacataatcccatatcagcatcttccaaaagaatcctcatagaacttgtttttattacacatgtcttccttagtacacgaatacaaggccctgccttaaacaaaaagggaaggtgcttaacatcggtacattgcatcctcaacatgaatcttccataaacataacaagctcattgtttaaaatcatgaatatatttatttattacatgattgctgcaaactttcgattacacaatgataagtagcaaacggaaaaccacaaacgtggctactcattttgattctggagagatatagctggtattgttctagtgactgcatcctggattggttctgtgatgatgtgttattactgcatattgctatcattcacaggagaagcttccttctgattgctagttgaagcggataatggtcttctgcttcgtatcgccctcctgaggttgattgccctttgctcggcctagagtaggtcggggagagacacaacttcttccatcaacgacaattctttgctgaggctgtcggtgcagagaatggttggtgctgaaggtattattgctatgatttattgcagagtcaggtgcagcaggaggagcattggtgttgtggatgatatcgtcgatgttgctgttggagctgactagctgatgagacaaccgtagagttgttcgttggatttctgcggtcttggtcaacaacacactaagttggcaatccttgggcacatggtttgtaccttcgcacagaaaacatgtgaccttgcgggtgggacactcccctggtggatggtcttcttcacaatgagggcagagtgtgagacacatgctagcaatgtgtccaatttctccgcaacgggtgcatgcctttgattccatctcttcctcgccgacatgtcggggagactcatcttcatcatccgaggagacttgatctgacccttcactatcagatactctgccaccatggcttagaaggtgctgggtcaactgtcgggcacctcgaaaggtatttcctctttgacgtctaggaatagttatccctgctggaggccattcggtgctggtaatagtcatcttacgtacttcttcttcagttcgcatcggtgcttttctcttctgattcttactcttcttgactttggcttgcttagtacgtgaccccacgtgatacgaaaggctaggaggaaagcatttcccgggattccatggattctctccattgggctctctactttgcacactaggctgcaagcttgacttggtgtgaggaggctggtttagcgatgtctgccctgctaaaccaaaggaaggggcttctttgacatatacccatggacaattcagggcatagtgtccttgttctctacaatcatgacaaaaggggacatcctcttctggcattggaagctcattgacctgggtggcaaatgttcgatcaaacacatactgattttggtcttgacttccaaccaatggtagctgtgaaccaagcagcatgctcggaatggaccaagggtgtgcccttgttaactctcttgaggccagtggtggattgagttgaaaacttgagttacttgaggcatacccgctgacattctttcctttttctctgttaaacatctgttacagggattgaggtgagagaggaaacaagctaggaaagaatagaccagaactagagacaggaccttaaaggaactaactctttttgttgttgtgttgtttgtttcacttattctgcaagttgattaagcaaacaacctagcatggttacatcacaacccaccgatgcaaaccacacactacacacacaagcaaggaaacacacgacaaacgaaacactagagggtggcttatgttctgcgacgggttcccaagatcttcactccttcacagctggcttcactgcttcctccacttcgctagcggaccctgcggtcttccggaccttcggcgaacaattggcgacatcttcttcttcgcaaaactaaccaactagtactagttgaaatttgaagaaggaagaaaagggtataccttttgcaaatagcattaggggaaggagaaaaagaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcagacaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccaatttggggattttgaatagaaggagcggtgtgaagccaaatccacaataaccaaaccattccatagtgtccaggtgatatgaatattcccaaagtctagagttgtaaaaccacctaatgttacctaattaaattgcgaagcatctacctaaaattaaactagtggtgccatgagtagagtgtccactagttggggttttgtttactctagggtgaacaaggaaataataacaataacaataataaggtcataacaaaggtaaataggcatggctagataaaacagtgataacgcaggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccgacggaaaagaaaaggcttttactctactaaaccccatataacaagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaatttaaaatcggatttattgcgtcagccgaggggaggggcgcgcggaccgggtccacgggagtggggcccacgcggcagcctctcggtccacggtggaccgggcgcacgcggcttgcgctggccggcgccgtgggtcccacgcgtcagccgcacccgagggcgcgggcggctgacggccgggccccacatggcagacgcggggcgcgcccgaaggcggcctcgccggcacggccgacgggaggcggtgcgcccgcgccccgattgtcgccggcggcgaacttcggcgcgactgagcggcgccccagagaggggagggaaagaggaaacgagatggcggtcctcggctcaccccgggttgacggcgacgaccgaaaccgcgaccgaagccgaaaaaggcgcggtcctgttcggtn

SEQ ID NO: 10108 - DNA, 1510 bp, Oryza sativa
  unsure (1)..(1510): unsure at all n locations
gcggaaggaggcgatgcgaaagcgggaggaggaccggggcgacgacggcggcggaccgaagcttggcggcgacggcggagagagaggacgacggcgcgagctcgattccgacggggagagcgagcggcgaacggcggaaacggaggagggaggcacggggagcgattatatagtgttgggagtgagagagggcggccggaggggaaggaaaccggcgcggcgatctcgggctccatcaatgacgctggcgaagtttgcgggagtgattccaaacgaatccgagggagagagagagggaaaaatagggggaaagggagaggggatcacggggaataattccccccactttaatgcgcgcggggacggcgggaggtggcgggattcgcggcggcggcggcgctagggcacgggcgaggcagcgggagcggcgggaggacagggatgacaggtgggccccacccgtcagcgagggtggcaggcgggcccgcccgtcagcggcgcgcgcgcggggagaaggccgatgggccgcgggggagaggagagggagggagggagctgggccgagtcggcccaagagggggaaggggggaaaaaggactttttagggcttttctttttataaaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttggaaaatgatttttaattcgggatgaatttatcaggacgtgacacatgcgcgccgcgccgtcgcgcgccatggccgccgggccggtttgcgccgtgcccgcgcgcaccggccgcgagctcccgccgccgtccgatctacccttgggtagatcggggccatcggttcggccgtcgcgtggccgccgcgtggtgcgccgctcctccccggtccgtggacccgatccgccgtggaccgccctccccgagtcactgccatgcgggtcccgcttgccggcgccgcgccccgccttgatgacgtcagccctggaatatattgcgcaataaatgatttaaggtttttcttgtatagtaataaacacagtgaatcttctaaaattcataactaattcatccgagctccgtttaagcccattcaagtctcagtaaatctagaaaaatgtgtagaatccattaaaaatggttttgttctctgtttcagtagtcttatagcctttttgcaatgtttgccttgtatgtcgctagattccggttcctccgacgctccggtgtacttcgaaatagtcgtcaaggttcctccagcagcagagcaaggcaagtcatgcttgtcacttgaacatgttgatnnnnnnnnnnnnnnnnnnnnnnnnnnnnnnnnnntgctaggggttattcagnnatcagtnttcaaaccccttc

SEQ ID NO: 10109 - DNA, 2374 bp, Oryza sativa
  unsure (1)..(2374): unsure at all n locations
aggaagaganttttgaatacctcattcnnnnnnnnnnnnnnnnnnnnnnnnnnnnnnnnntgaggattcttttggaagatgctgatatgggattatgtgtataattgtttgctggcaaaggagacctagggtctcatttcagaggaactatgttccaacctcgagttaataaccaacctgttgatggaaaagaaaaccaattaaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgagcatgatgaagtaagcaagacgacctaggtaaaagtgtttctttgaaggcaaggaatgaaatctttaactcggtatcagatgctacacggagtgaaaagtgcaagcaccggttaccaggcaatgccatgtcttgggagatgatccaataggaaagaacacatcaaggataaaggtgtaaaggaatacgttgaatgctaactgaggacaacctgaagataatagtgggaaataaactgaatgtaaagaaagtgaatccgagctgcttgttcgtgggagctattcccagttatgaaccaagtgatatgttcgaagatagtctactgaggtcagacaacgaagcttcagatttggcaggataacgatcaaacaataagaagtccagcagtaaagccgtttgggaagacgtcaaagcatgtcaagtgggataagttggttcggttgagaaacataattcaaaggcaaagttatcgaccctcgcatggaatagcagaagtagctagcacccggagagcaggaaagctaatatgatgcagttagtgacaagttgtcaaacatggtatgctggataagcgtgatatcatagtccaaagcattcagtggtaagttagaagtaaatgacaagcatgatattctcatgatgacaagcatggtatcctagtaatgacgagctgatctcgacgcatgacatgaagtgggtaatttgtatgaggttgactccgaagatatgaatcatgagaagttctggaacggaagcatcattaaactaccgcaacctagtctgagtcagctaaaaggtgcaccctggttcaagtcaggtgaatagaagattccatccgcaacaggaggtcaagccaagcagttccgagtcgtgaagttttgctgaaagtttgtgaagacggagcggaagaagtcaaacaagaagagaagaccacccaacctatcttcttgctagcctcctcgaatctcggggacgagattcttgtaaggggggtggatttgtcacgtcctgataaattcatcccgaattaaaaatcattttccaaaaggaataatagaattaattaaaattcgaaaagaaattggcaaacactaaaatacgtacaagaaaaattcaaatgtggcccggagaatttttgtaaaagtcttcttgggctaaaaagagccctcaaatttagtggaatttttagagcccaaataataattatttaataaacaccaagttaaaaagggtttattaaaagaaaagccctaaaaagtcctttttcccccctttccgctcttgggacgggtcggtccaaatctctccctaactctgctgtaacacaggggccatatgacttgttctcgaacaccggcccataaaggcgggccctaatagcgccctgttatgcgggtggggacaacctggtattctgacatcccggaattaacggcggcttatctggctctaccgatcacgccgtcggaaaatacaccactttcttcagtcccctcgcgataagatggcggtaaatatcccgcaacccg

SEQ ID NO: 10110 - DNA, 748 bp, Oryza sativa
  unsure (1)..(748): unsure at all n locations
cgctccatgtttgtactccagctcggtacccatacgcctccttgttcagcagtatcatccccttctggtacatcatcagtgctcctggcacatctgcagtttggtaataagctcataaacatcccactacttgaactcacattatgttcatatcaatttgaaacatctttggggatacaataactgacgggtctgcactttaaagttctgaaagaaaacttgatccaagacagaagacatggagatatgtcagtgttaacctgttggtaagatctgtgtagggaagagacctgaaagatggaaaaagacctgaaaggaagtgaattgaagtggcctgtatacaattcgctggtgttttttgcagggataatgcttaccaggctgtgcaaaggcagacgatggtgcaggtccaatggaaggcatgagcgtgggtcagttattgtatccccaaagatgtttcaaattgatatataaacacattgatcccttaaccacttcatcattaatcaccaaaaaccactagggggataaatgcactttcaattctggaagagaaatatttgtgaacaaacaaaaagtaacaaagaataaagtatgaaactatagtgacagcattttggatgtaaatatataatccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10111 - DNA, 4942 bp, Oryza sativa
  unsure (1)..(4942): unsure at all n locations
aaagttgatagaacctgatnnnnnnnnnnnnnnnnnnnnnnnnnnnnnnnnnnnntcataaaacagtgtgcgattgaggtcaaaagaatcatctctgcagttagtacgatcaagcttcgaagcaaccacctcaagcgacttgaattaggagcccaacactatatccacatatgtgttccactccaactccccattcaaatctagcatgtacttgtgtgaaatgggtcttgctccaacatcatatctaccttgtatagctatagactgattgctccaccccagcacatcctttgtacgacaaactaactcctcaaaactaggttttccaccaaatataagttgcttaacactcatcccttcgaaattgctaccactgttactttgctctaccaccgaaccaccatagtgcaatcgtactaatctatccatctacaacattaaccgacatattagcatattgcatttcttaaaaacttgaatttgcaataagaaaaaatctaacctacaactatgtcccccaacgaaattgtccataaatatctaaacatacacaatcttccatttgtaacgatccattctaaatttgaactctcgccttgtgataaaaattttaaaaaaaagaagtgttcttcactaatttgggggaaaaattagggttcttccctaagggccaaaaatctccactaaaaattagggttctatgagcatctaaccattgcatcaccaataacaactacaaccacagagtagagaaccaactaatttgggaaaataacctcaaatcacgattctagggttcatccatcaatgagcaaatccaagcaaaaaattgcgaaatgacgagaggattcggaggagaataccttgccactatgtcctccaacaatttcccctccaaaatgcgacgatttagtggagattttttcgattttttggaggggaggagagagatggttcggcgccgctgcgcctcagccgagagccactgaggaggaagaaagaagggccgggctgctgggcgcggctcggccaagggatgtaggacctcagcgccagacccgatggcgctgaggtcctgaaacacagcgccaatgcggtcggcgctgacattgtgccgttccgtccatcctcgtcttagggccgttacgtactcagcgctgatgcggtcggtgctgaggtgttcaagctcagcgccatcgaccatggcgctgaggtcggggtacgtccaaatctagtgatagtttttgccagggaccaaatttgcaaatagttttcaaaaagggccaaattgtcaaattttcggcaaattagtcgcctgctttcatctctctctcctcaattctctttttttcacgtaagaaaagaatgttgtggatctttttggagcctgccgagtcatcttattgtacctgctctaaactggttcattaattcactactgaatacgtggacagatttactcggtacacaccactgaattcacacgttcatcggacgatgaactttaaatcaaatcaagtattgagaaaggattcaaggaattagacaacaattttagagtaaggataatccctccgctgacgttgcctttgtcgccctacgtcgctccgtcatcttctgccggcgttgcctccgtcgttcgcaacagcgattcgtacaaggtacaaactgattgataaagcattcgtccgtcattgaaccctaaaaatcctcaccatcgctttgagaatactacgttttaccatcctgcatgtcaactctgcagggtatccgtgcagaaaaagaactaaaaaatttcggcaactagcacagacacccatctggcacaaactcactagcaaaaaaattagaatgttttggccaaagtgtgtatttcctcctgccttcatattccacttttgaagtagatccgatctaaccttcaatttctcggttgaggattctctaccataatgtcactatcattacagtcactggtacgtgggtctcacccttttattgccccacatatttatgtctatagtgatagtgccattatgatagagaatgtgaaaccccaatttctcatacccttcggcccggaattgcttccattattcagattgttgaattcttgctttgcttggatacttggagttggaggttgtctgaagattccttctgatgctcatcatcagttcgtcactttgtcatcagaagcctcgatcccatcgtacgttcctaacatgaagaattctattgtttgaagagtgataagacaacgcaaccaaatcggagattgagatagataggatggtttatctggaagcgttcccacgaatcgatcgagtgctcgccggagcttggcggcttcctcgatcgtcgtcatgctgtcatctggcaaaggaccccggaggtcgacgacaggagaggcgacgcgggacgacgaaggcaacggcggcgacggacgatgggtgcggttgagccgactccggtccgcctgggagccgagccgagaacgctcaagccgttggattatttgggtgaacacgtgccgcgtatcgggcacaggtatgcacaagagcccatttggagccgatcgatcggggccctctccattggactccgacgcgtccgtgtcgtttcgtgtaatccgactccgacgctgtctcgtcatccggccgccctatatcttgcgccgcgtgtagtgcatctctcccgcctggtcgatctcctcttctagctcgctcggcaatcagcctcaaatccatcacccaagcccaccttaataagataagccttcgtatttacttaatgataaatcaagctacaataaaaaaaacatatttactttatttttttaataaaacaaatggtcaaacatgaataaaaatcaacaacatcatatattaaaaaattaaggtacaatatatactctcatttaatttgttttcgacagtacaacaaacttgcatagttgcatgagacatgaatagttgaatactccatccgtttcatattataaattatttgactttttttctagtcaaccaaatttatagaaaaacttagcaacatgtaaaatatgaaattagtttcattaaatctaatattgaatatatattttaataatatgtttgttttctattgaaaatactattatattttttctataaacttggacaaactgaaataagtttgattaggaaaagagacaaacaacttataatataaaacggaggggaatactttacatatataaattgttactccctccgtccctaaatatttgacaccgttgattttttttaaacatgtttgaccgttcttcttattcaaaaacttttgtaaaacatgtaaaactatatgtatacataaaagtatatttaataataaatcaaatgatagaaaaataattaataattacttaaattttttaaataagacaaacggtcaaacatgtttaaaaaagtctacggtgtcaaatatttagggacgaatggagtattacgttgtaatagttcataacacaaatatgtcacattcaataccacctgtcaaatttgcctaaccttagacatggcaaactgtggcaaagtgtggcttgcaaccaaacacacccctagtatgcctgtagttcacaacaacgaagaagtggagacatcgtaggagtatttgttgcacatgtgatgcgtggggtgaggatgacacattgagaccggcaattcttcatggcacagtttaatttgaataatggtcatcgatcaatgtcgtcgttgatgctcccgacggcagcctcctccttttcggcgccgccgtcgtcactgtacctcgatgcatgacatcaccatcaatgtcttcgtcatcatcacctcatcagtttcgtcgtcgccgacctccttgtcatgcgggtgggcgcgggcgcggaagacaacgcgtcgaacaggtcaccagcgcccgcgctggtgatcatcttcatcaggctgcactgcagcatgtccagagccgacatggccgagtgcgcggcgatgtcgccgtacgtctgctgccagctgacgtgacattattttgactgataaataagatccatttaatattttttcttttcctttttcttcttttcttctcgtattttattttttttcttttcttattctttctctgtgaactaagcagaagaaaggaaaaaaaaaaaagaatgagtcgttgtgcttccggcgcgttcgtgggtgacgcgcgcgtgcggacgacgaatcctgtttgatctcggcacggcacattttactcatcgaggactctggttggtatcgtcccttgaactactacgagacgaacgatacataaagcgcagccatggaaggaaacaaccgaagaagtacgcgacatgcacacgtcgagatgatcaccgccgccgccgccgcggagcagcatctgccggacgacctgctccgggacatcctgctccgcctgccgccgcgcagcgccacccgctgcctcgccgtgtgcaagggctggcgctccctcgtctccgacccgagcttccgccgcgcccacgccgagcgccccgccggcatcgccgaggccgaccacacgttttgcctccgacaagacggcgactggaccttccagcaaaggctccgcgaggtcgtgctcttcgactcgttccgcagcagatggtgccgcggcgacgtccgcaaggcgccgccgctcgacctcacgctgatcccctcgccctacgccccggcggcgaccatggtcctcggctcctgagacggcgtgctctgagtcgagcgcggcgctcctccgctccggagactccgctggcgcttgttcggctggccagacgacgaaagcgggcgcaggggctacgtgctgtggcatccgttcgacatggcgtgcgccacagtatatccaccgaccggccgcggcggggtaccagctngaatatcaacaattttttctt

SEQ ID NO: 10112 - DNA, 13018 bp, Oryza sativa
  unsure (1)..(13018): unsure at all n locations
cttatgaagagggtcagcctggttatgtgggacggggacggncggcgcgacctgtcgaggacgttcacgtcggagacccaggtgaagncggtgcacggcgaggtggagggcgaggaggtgatcgtccgcaacggcggcgaggtcgacgcgtacagcctccggcgcggagcgtggttgtgggtgcgcggcatctccagctcgggtggtcctgtactggatgtggcgctgctggcgcaccgggacagcgtcgtacaccacgacgtgagcttcggcgaggcgtcgcggcctcttcgataccccgacgacatccatggccagcgtttgtttgtataatcgcatattcaatttgttttcgttaaggcccgttaaaaattttcaccctgtaatatcaaatgttttgatatatacatggagtattaaattaaatataaagaaaaaacaactaattacacagattgcttataaattgcgagatgaatcttttaagcctaattgttccatgatatgacaatgtggtgctgtagtaaatatttgctaatgacggattaattaggtttaataaattcgtctcgcagtttacaggcagattctgtaatttgttttgttgttagtctatgtttaatacttcaaatatatatccgtatatccgatgtgacacgccaaaactttacacctgtggatataaacatagccttagtacagcaaactttacatgagacatgaatacactgtatgtaatatatctttattatgttgtatataggaatataggatccgcacatatatacacagacaaatatatcacatatatacaaccatgtatgcatatagtccatactcgatccctcgcccctaaatataaggattttttgttggatatgaacttgtccagatttgttgtactagtatgtgccacatccaaccaaaatcccttatatttagggacggagggattaacaagtagggaaggttggagacatcacatgaaaatcttcccatcgggcgcccaatgccccccaaaaaaatcggtcggtcaaatgtttcagttgaccaacgaataaagcattaagttatatatagtgaaaaaaatagcaaccgaaatatttaaaaattttatgaaacatggtgaagtacatgttaaaacatgtcgctatatcatatgaaacaactaatgttaacggattgaaacttatgttttttttcatcagaatataatcatgcgatatcttgtcataaagatttaattacaacaaatacaacaacgtgattggatcgtagattagataattagtttaggagaaaattcactaaaatgcaattatatccaatcacatgatataatacattatcgtagatcggtgtcacatatattagaccctgtttagttcccgagcaaaagttttattccctgtcacatcgaacgtttggacacatgcatggagtattaaacatagaaaataataactaattacacagcttgcgtgtaaattgcgagacaaaatttttaagcccaattatccatgatttggctatgtggtgctacagtaaacatttgttaatgatggattaattaggcttaataaattcgtctcgcagtttataggcagaatttgtaatttatttttattattagtgtacgtttaatacttcaaatgagtatccgtatatccgatgtgacacgacaaaactttacacccctaatctaaacacccccttagtcttttgcatgctgtaaaagcagttatccaatcacatgatagaatatatgattgtagatcggtgtcacatatattagtcttttgcatgctgtaaaaggaaatctactccaccttcacatcgtagaatacacaaacatcaaaatgctctgtcggcccgtgctagcttgggccttggagcaccactgttatccgataaccataacgaattggatgaccataaggaagcaacgctctcgatagaactagaagccgtgcagcccatctgcctggcatggctataggatcagcaggtttcagctccggcgtccctcagcagcagcagccgccgccgcctcctttgcaggcatctggtggcggcacatggggcacgtgccgtgcacgcgcagccacttcaccaggcacacgccgtggaaccggtgcccgcacggcatctccttccaccgtcccgccgccgccgtcgccgcgtcctggccgtggaggcagatcgcgcactccgcggccggcgccagctggtcgacgacgacgtccctgagcgcctcgatcgcctccttgaatgcgggcgccacgccgccggtggtgcagccgggcagggaggtggagataatcatggagacatgttgctgctgctggcgctggagatggtcgtcggagacggagagcagccgcgcggcgagcatcgcgagcgactcgcggctatacggcgcagcggcgggcgtggcggcgctgttgatccaggtggagtggagccgcatgaggtggtcggagttggaacggaaccgcgaggcgagcacggcgcgcgacggcgggaggccgccaccgccgacctccgccatggcagcagctgcgcccgtggtcgtcgtcatttggacgtacgctcgtgtaccgggtttaattggagtgcgtagaatcaagctaagcgagcgatcgatcgagcgcttaggtttgcagctgcaatatatgcatgagacaggcggctgtgttgttgttgattattttgctagcaatggaacagagaaggagaacagaggagagaagctctgtgtttgtttcacaaactggttatgctttgctcaagtattgcacgttacattgattgttggacagcagcatcacatctaggacatagctgcctatttataggatggctaggaacttttctgaacacaactagtactggtacatgcatgaaaatactagaactcacaaagaacatattattgtctacactactctagaaatttcacagagaaaggacttgctccttgacttttgtttcatgagtagtagagagagttagagagtaggctggtatgttctagaaataaattaactccaacaaactcccccttaatttatttcttgcaaactccgatgagctctctgtcgcggacaaatttttctttggataaagccttggtaaatatatctgccaactgctcattagttcggcaaaattccaatttaacttcctggcgatcaactgcttcccggatataatgatacttgatagcaatatgtttcgtcctgtcatgactgactggattttcgctgatcgcaattgcagacttactgtcgcaataaattgtagtaggctgatattgcttctcgcccagatcttccataattctcctcaaccaaacaacttgtgaaacagcttttgatgctgctacatattctgcttcggctgaagataaagcgacaatattttgtttttttgtagaccaggagcacatacctgaaccaagtgagaaagcgtagcctgatgtgctcttcatatcgtcaagacatccagcccagtcactgtccgtatagccaattaattttgattctttaactggcttataccatataccataatctgcggtccctttgatataccgcaaaactctctttgcagcggtaaaatttaattgacttgggctagacatatatcttgataataaacttgccgcaaacataatatccggtcgtgttgcggtcaaatataataaacttccaactaagcttctgtaaattgttggatctaccttatcagctccatctctagccttttgcttttcatttggcaacaagggggttgtaactgacttgcagttatccatcttaaatttctttagaatattttcagcatatttcctttgtgatataaatattccttcatcactttgatgcacttccataccgagaaaatagtggagcaagcccagatcactcatttcatatgtatgcatcatatctcttttaaagtcttgcatcatcttctcactattgccagtatatatcaaatcgtcaacatagagtgagacgattaggatatccgtacctgttttgttgatatatagagtaggctcacttatgctcttggcaaatcctttctgaataaagtacttgtcaatttgactataccacactctaggcgcttgctttaatccatataaagccttcttgagtctgaataccttattttctcccccttggactgaaaacccttcaggttgttcaacatagatttcttcatcaagatagccatttaagaaagccgatttaacatcaagttgataaatcttccacctcttttgagctgctagagcaattatggtacgaattgtctctagcctggcaacaggagaatatgtctcataataatcaatcccaggcttttgcttaaagccttttgccacaagttttgccttgtatttctaaactgagccatctggatttaattttgtcttataaacccacttaactccaataacttctctgtccctaggacgatcaaccaactcccatgtattatttttctcaatcatatgaatctcatcttccatggcctttatccaattatcatgtttttctgcttcttggaaactttgtggctcaacaactgaataattgcaaaattcatgttgttctgaccctctttgttgagaagtagattctaataattcaaccatacttcttacccgtcttggagctgattccggtgtagaaatttgctcttcactgctcgggcttgaatctgaactagcacttgagcttgacattggacttgatggctgtggacttggagtatgatcttccacttcatgagtgccatgcatatgtggttggcctagtgtgatggtagtggttggcaataatggagtactagaggcttttggagacttccagttccatgtagcactctcatcaaaaatcacatctctgctaatgataattttctttttctccaaattataaagtctatagcctttgataccatcagcatagccaacaaatatgcaccgatcacttttattatcaaattttactctcttttgtgctggcacttgagcatagcaaatgcaaccaaatactctcatatgaccaatgacaggctttttaccataccaagcttcaaaaggtgtacggtttggtactgccttggtaggacttctatttaaaatataaattgcagtattaactgcttcagcccagaaagatttaggcatacctttgtcttggagcatagaattggccatatcattgatcgtccgatttttccgttctgcaactccattttgttgagcactatagcctgccgttagctgtcttcggatgccagcattttcacaatatttctcaaattcttttgagatatattctcctccttgatcgctgcgcaatactttaatttttcgattactctgattttccaccatggccttgaattttttgaatatctccaaggctgcagatttttcttttagaaaatatacccagatcattcttgtataatcatcgataaatgtgataaagtaccaatttcctccttctgaaattgttggcactttaccaactatatcagtgtgcactagttccaatggtgcacttgctctccaagctctactgtggggaaaagaagcccgaatttgttttccaaatacacatccttcacatgggtcagacttgagagtaataaatggaaggccttgaaccataccttttgtcctgagtagcttcaatgctctgtaattaagatgacccattcttttgtgccataaatcggaaatatcaatttcactcctgagagccatttgagttggatgattcatccttaatagaaaatttctgttcttctccatatttattttggcaaccagacgattattttacgatccaatattttgcaagaaaagacttcaaaataaaccgcgtacccgtgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttgcatgatacgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatattttgaatatggccctttcttttgcacttgttgcaggtcattttcttccagcacatatctgtagtatgactagatttttggcaaatgtcacaccacaaatttgaactggacgtacctttttctcttctctcttgaccatcttccttctgcctggaaaagccatttttctgaaaataaccacggtctcgcattggaaatccatttttttgaaaatttccgcgaaaccttgagttttgaggcctgaagctcaactttgactgaaatgcattttcaatagagctcccttcgcgctgaagctttctttcttcgtgagattccaacgagctcattagttgctgaattgtgagagtcgacaagtctttcgactcctcaatagcagcaacaatgtactcgtatttttcaggcagactgattaaaatttcctccacaaccttctggtcgtttatatcttcaccatagaggcgtatctgattaacgatctcaataactcttgagaaatagtcttttaccttctctgactccttcattagcaaattctgaaattgtcttctcaaggtttgaagcttcaccgcaagtaccttctgagatccttgaaactcctccttcaacttgtcccatgcttccttggatttcttggcgccaataatacgcggaaatagactttccgcaactccttgttggatcaagaacaaggccttggcgtccgacatccgatcctctgccaaagactttttctgttccgccgtaagagtttctccagcggaatactcttgatagccattctcaacaatatcccacaatccttgagatagcagcagcgtccgcatcttgatgctccatatatcataattttctcctgcaaatacaggaaccatagactgcgccattgtggcgcccgaacttgaagccatacttgtagcttcaattgacaataccgatacgccgtgctactccgtcacgccctactcgaacctgggcgctctgataccagttgttgttgttgattattttgctagcaatggaacagagaaggagaacagaggagagaagctctgtgtttgtttcacaaactggttatgctttgctcaagtattgcacgttacattgattgttggacagcagcatcacatctaggacatagctgcctatttataggatggctaggaacttttctgaacacaactagtactggtacatgcatgaaaatactagaactcacaaagaacatattattgtctacactactctagaaatttcacagaggaaggacttgctccttgacttttgtttcatgagtagtagagagagttagagagtaggctggtatgttctagaaataaattaactccaacaggctgtacgtgccgttgggcttcgtgaacgccgagaagctatcggaattcggccatcagaatgtcattgggttctagtgatcaggactgtgatcacaagcaccaacgcattcggacttggacctaggactcggattcggcctatgttttcaactcgataagtcggaaaaaaaatgttttgactccattctaaaatatatataccgacacagttactacctccgtcctagaattcttatcgctttgagttttttttttttaatttttgatttttcgtcttattcaaaaaaattatggaatttttatttattttatttgtgatttgctttattatttaaaatactttaattatgacttcttcgtttttatatttacactaatttttcaaataagatgaaagatcaaacgttataagaaaaaaagttaaagcgactactaatttgagacggaggtagtaccttttttcaaagttctttagcgtttattacctgcagggtactgtagaataggtcccacggtaaaccgaaagacctgaggcccgatggcccggctcatggcacgagattttggcccagtccaagcacagcacgacctttaattagaccatgtttgggcctctgcctcggcatgataggccaatccggtatgacccagtccaacgattagagagttaagtagttgagggagccaaaaataaacttattctagccatataaggtatgtcccaaagagacgaggaatgcaaaataaacttattccaaacatataagagacggcacaaagagattagggagccaaagttttttcaagaaggagcaccgtaggctttcatgtcttcgggtcggcccggcacgacccaagtcttattgggctgtgcctgggctgatggtgcagcaagtgagtgggcacggcctagccctgcgtgtaggtcaggccgtgtcggtccgggcggcctatttggccatctatagaaaaaaaaactagaaaacttagcgcggctttgccgtgcccttacgataaacgggtacaaagcaaaagcatcaaataaatatgagaatttttaccattcttgaggaggtaccaagaggtaccaggtaccaggtaccaggaggtgccactcacatctaaccgtcgatctcagaggggtaggattggaaccggttaaacgggatgtagcttatcgtctccgccctcccagtatggaatgctgagctgcacatatactccctccgggttaataatacttgtcgttttggagaagggcacggtctccaaaaagtaactttgacaattattttctattataatatatatagaaatatcaacaaatatatggtttgtttgaagtactttttaagactaatctacacatatggtttttatatttttaagataaatattttagaaattatttgtagtcaaagattttaaagtttgactttacccttatccaaaacgactaatattatcagtccggagggagtatcttcttggggattcctagttggtgcgtgcgtgtcagcaacgcgcacgcggcccaacccttgtgcgacaacccacgattaacgttgtaattagcgccataactagttttgatttctcggtaatttgccgtgtcctaattttttaattttttttaagtaacagactaaaaacagatctacacgtgaagtcaaattttgaaaactttcaatctagatttaaaaacttttcaactcgaaatttgaatttttgaaatcaaaatttgaaaactttcaacttctcatctcaaatttgaaaaactttcaactagggtttgaaaactttcaactcgagatttgaaaactttcaactcgagattttgaaaactttcaactcaagagcaactcgagattttaaaaactttcaactcggattcgaaaactttcaagtcgagatttaaaaatttttaaattaattaagatttaaaaattttcaagtacagtcaatatttaaaaactttcaacacaaaaaattgaaaacacttgctgctggaagattaaaaagtagtgggaaaaaacgcaaaaaaaaagggaaagcgaaaaaaatcacggaaaaaagaaagcagaaaataagaagattaaaaaagtaataagaaaaaagcgaaaaaaagatgagctgcgcgaaaaaaagtaagattaaaaagtattaagaaaaaacgcaaaaaaaaaggaaagcgaaaaaatatcaagcgagaaaaaagagaaaaggaacagatgggctgcgtgaggggtgggccgcgtgcgagcatgggccaggaacacgcgttgatagtgcgtacgcgctaattaggaaaattgtatcttcttggctgtgtgaggcagcattaacaaattgagtgaatatgcaatgttcaggaaattccaaaatcatctaatggcttaatgcaacgacaattattttgatctacagtgtcagaaggcaatataatttgataagttaatttggacctcaaaatagcatgagttacttcgtattcactgccaaactgcatgcaaaaaataaacgtataacatgtcttggtcagaaattggtgtggggatgaaagctatatataacaaaaaatggcagcggctctgagcctctgatacttcctaagataaagagcatatgatttcagttattggtcactgcaagtataacaagtacataagtggttaataaaccctatcatcagttaattatgcttaaagtcatgcatattaaccatgaacacagtacatcagaataagaaaaaaagaagaattaaacttgttccgaagagcaagagatctcgtcaaaacatcaactcccttcgcagcgcttccttggttattaagtgatgccaacttgatttctttctcccgaaggttcatataacggaaaaaaaagtgaatacaccccccttatctactacttaaaatgttagtaatggtggtgtctatttccaaccacccctagcattgatatgtaggcttcacaatctatactattacattacctctcgaaaagtcctttcccgtttcactattgactcttctcaaacttcaaaatcacgtacttattcaataagaaaaattatagtattactaggactaaataagtgctcattaattgatttaataaggtaaaaacttaatgtgttttctgttgcaacgcaccagctctaggctagtcgaatataaacatttgcatgttataggtggaaatgaaaagtatacagcttcatgttggtagttccttcaccaattggaggctcttctactgtaacctgccatatgcgtacattctgatgtcttcatccacaattcctgccatggagaacaaatcaatttcactaatccatgaacaattgagcagatgaagaaccagggatatcaaacatgaccgctgaatcaaaaatccattcatcttgctgaatctaaatcgattgattctacttctgtttttgcattgagcaactgatgaacacattctttctccctcaattccttcatcaccttggctgccacgccttctccctccacatagcaacctgaaccaaatcaccaagaaacaagcatcaacccaagtcaaaaggaataaccaaacacgagattcaccaaatgggaacagcaccgctcgccatagcgttgagtttctggatcctatcgtgctgctcgtcgagcaccctgtcgagggaggtggccttctactccagccggtcaacctcggcgacgagctcttccgggtcggccccggcccgcgcatcgggctcctgccgccgtgccgcgtgggaggagccgacctgtgtggggcacggcacgctccggtgacctggaagaagaggcaggtcgggtgtgggcgacgccacacggctacttgcagatggggcaggtgatgagtgaacttattctcctctctcgggcagtactccagccattgctccaggctgcccaagattaaaccatcatcattcggaaatcgattcgaagaataaggagaaatttcataatataccattcaattcgcagcaccatcaggaattaccacctaattcgtagcactttcagaacataccactgagaacgcgaattgttccattccgtgacactccgtcccttcgcaagtcacgccgccccgacgcccttcatgtgtcgtccatcccttcatcttccgtcgctgtcgagcttctcctctcccacgccggcagctcctcctccccacgccgtccttcccctccccacccggcggctcctcctccccacgtcggcggctcctccccacaccggcgagccccacgccggcggcacctccccacgccggcgaacttctcccaacacatgccggcaatctccccacaccggcgagatcttacccccatgccgacaagcttctcctccgcactgccggcaagctcttcctctccgcggtggagcttctcctcgcgcatgtccccatcctcacaacgccggcaaacctcgacggctggatccacatcagccaccgccggcgctcgtcgtcccctcgttgcctcccgcaaggtgatgttgctcctgccgacgtggggaggagccgccggcatggggaggaggagaagctcgccggcggcggaagatgaaggggatggacggcgcgtgaagggtgtcggggcggtgtgacttgcgaagggacggagtgtcacggaatggaacaattcgcgtcctcagtggtatgttctgaaattgctgcgaattgggtggtaattcctgatggtgctgcgaattgaatggtatattctgaaaattctcaagaataagaggatgaaatggatttgggatggagggcgaaccacaggatgtggaagatgtgactccccgccaacggatccaaactccctgccaccgtagccacatcttttcgtcgccgaggtgcccacgaaaccatggtaagtggaggcaaaggggataaaggtgcggcggggagaggaggtcatggcggcggcgaggcaagagaggaggaaaccgagtgaagtgggaatttgggattgactgattttgaaaaaaaaaaaaccctcaaacttcgtatatacaacaaggtccaccgcagcgatctctcaccgttgatctaagctggaatcgcgcagggccacgtggaggggctatttgcacgtggatccgcatagatttcgatatttagagattcacagtgtcctaccgagagctaacggtgggacccacagaataaacgatcacactttctctttttttttccacctcaatcccttctcttgcatgttctgacaagtgggacaaacaattactccagtttattccataacaccggttgcttcggctaggatcgactcttctcttctcagcacatgttatttnnnnnnnnnnnnnnnnnnnnnnnnnnnnnnnnnnnnnnagagatggtcaatcaaccgg

SEQ ID NO: 10113 - DNA, 8527 bp, Oryza sativa
  unsure (1)..(8527): unsure at all n locations
ggggttttgaaagaagccacatggtgaattttattgataggaagcggcggagtgttttctccctcggctttgatggattaaaagtaggaacttctagttaagaaccctaagaaggtacaggtacaaagcaagtcaactcaccaggtcaaactatctataaagaaaatagctggtctgattagttagacaaaatggcccactaaaataaaataggttgtccccacaattctatatttgagatctgaggccaagtcagaaaggtaaaacgtcaagtgaagctaagattgggttgtcactttacgcccaaaaagctttttaaccatcaatattctcacctgctctgtttcattgtagagcgatatcttattaaaatcctccccactgttttctctctccaaataataaacctccctgagaaaggagcanggggagaaaccctccttctcctctccctccgccgccggccgtgacgacgacgactaccgtgacgccgacgcttgggtcccaccgctgactgcgacgacgacgccgccatcgcctggatccgctggagggagaggccgtcgacgccgccaacggattaggtggtggcgccggattttttttttgttagttgaaaatattttcacaggcgggtggatctactgcctgcgaaaatagatgccgcctgtaaaaatgattttcgcaagcgggctattttcgtagtcgtttgtctacaggcagtccttccccctgcctggaaaaactattttttaccgcctacaaaaatgcttttagtgttggagcatctattgcacctgctcttacggccctcttctctaggatttgaaccatgatgattggagttatatagccacgactttactgccacactattgatgttaccccctcttttcttatttctctttcttcgttaattagtttgctttttaaaaagatactaaatttttacgtaggattttaatttatatgattttttttctgttattttttttcagatttcaggattcgggtcgtctgtcaatttggagcagaattgcacataggctgacatatttgacgcaatgcaacactgttgtataatacaacacttctgtttttattccttaacttgctgcaaatggcacgtgaatttatggatgaatttcttaaaacgaaaggcaagacagcaccaatgatttacgtatccatatatatttatattaaggtaatatccattggtaagaggagactgaacattattatctaggcttaattaagaaataaaattgatgcttagttgcttacatcccagtcatagggattagataatgtaattattcacatgattattgttgatatttcttaacgacattactagaaatataatttccaacaatgaagcccgaaatgttactcggtattctttacggatacagttataatccgcaagcacgcggatataccgttgtattccaaggtatctatttatttaatcccaagggaagatatgataagagagtattatgctaataattttatcgcttgtatagatcaaagtctaacgcaggggttaatcaattcgagtatagggtaggttgacacatagaagaaactaatcataatactctcattcaaaaaatattctaaactaagtggagaaagaataagaaaagaatcatttctgcacttctaatatataattattttaatctacacttgctattgtacaattatgcagccaataccccctaactatgccctcctagtatatcttgaagccacccctaattgccgagtttcttacgacaacccgtcacagccatccaactggtaaagaatacggaggagtacccacaccaggaaattctcttagtattatatatgcacgtggaggaatactcgtactgagttgtcaccattagtgacctacctctacagacatgtggcatataacagcttttaatggtatctaataatctaagcactgcgcttacattactaaatactactctacatctctgcagatgacatagagcaatcatataaatgaacattaaaccaataccattgcatatctctagtaagcttgctacataattattacgatttacgagacaagtataagcaaaagtcggtactcgaataattatataagtaaagtaaagtaccaaagctatataaataagaatattcattattgaataaagtcttacaagaggtagaagggatactagagccatacccgaaatcttcggaagacttgaagaactaagaaactattctaattctactccactagtactagaacaaagtaaataaactaaagagaattcttgatttcttcttcttggtttgtgttgaagtggataaggtgaactccttaaacaggctgccaatgatggttgtggcggttggaattgtcagaaatgccccgcaaccatcattggggagtgatcagggatgtccacgtgtacggccaggatgaaagggcctgatggcggttcagccaaaccctaggccccacctcctggcctatcctttggccaggaggctgactggtgggtccttatggcgttatgatagttatgacccattttgtggtggtttcacctgacttgtgggcccttcaatccttatactcgcgcctgattggtcggaggtgtgtctttgataatattttccattattcttctccatttgtatgaagatctctatatacaaataaagttccaagtacaagtggaaatatattattgttagacaaatatgcatgcaagcattgctagttctccttgatttccgaatatattgatagtcgaaattggtctataatatccgtcaacaattatctcatagttcttaagttgtaattgtgatatttgtgttcttcttttagtgtaggctattgtggatattgagttcgattgatgtattatgccgattctgaccatcttctccggatttttaatattacctacttcatcatgctagaaaaaaccactattatcagtgggtttctttgttttggtaaacatttttattgcttcctatttgttgttatacatcgtcatctttaagttaagttattgatattaaaatttttccttaaggatttctatttagtactagaaaaatgcccatgcttatttgaatattatgttaattacttgattcaaacaaatattgactattacataatatcagaaaatatcaagaactaatttgtaaaacatgtaaaatagtggtggtagagtggtagactgatgatagaaccaccaccactattatccttataatcctttatagtagtatagataatattgcgtgagaatttgatatgattgatgtaactcagacttgcattgtcgactcaacttggctcgagagccaatcgttttatcatttagcttgcacccctatggtggcctaccaacaggagacccattaccaaggccatctccaggaatttgggaccttgggatgaaatgcaaattggaccctaaattttcaaaattttatatgtctaatataaacaatataaacaaggcatagtttcactcaattatataacttcaatatgtgttattttcatacaaaaatatatcaaatattaacgctaaaattgtcaatgtagtgctaacctcatgttctacagaaaagcaccatttgtctattattttttaaaataaaatattaaattatatgtacgtaattaatctactccgagacatcattttcaatttctattgttgccaatccatcgagtctttcttatatcatagtacaacgacttgggtttagaaaagctcctttccatagatgcaacggtcacagcctcacatgaatggctaataaaactttgtatgcaataatagcattaggataaaaggggcgctccttcaaaactttaaaatatcaaagaacacccttttgagattgaattgcttcttctggtctttgcctcttctttcgcttttcagcaccagaatcgtacttcctatttctagctgacataatgaggattgaggaaataagtgtcttcctatttcataaacaaaagaaaagtaatttgagtcaaacagtcacatcactatttaagttttgattcaatcgatagtttgattcatattacatctactatttgatacgagactcaatgtctcaactcttaagtctaaaagtaactttccaatgctgcacaaaggtagtagtcagggacacgaagataagtggatgagaggcactgacaaaggtagccggccaaccgcttggcattgatggcgcttgcccgttggtcgctcgctgcctcgtgttgggctggggtcgggactttgcaggcatcgtcatttcatcgtcgaatttgaaatcgagattgactccagtcacacgacatgactacacaacagtgtgacttgatctcgttcgcctctcagcctccaatgcacctgatggcagatgggcctctctaatcgattcacaggtagaagcaggattgtggctcggctatgcattaatgtgcgcctctccgattaacttgggtgccccaaaaaaattgggggacactctatcatcgccaatgtcgcacacaaccttcgacaggcttgcccattagtgtgacactcctgcccacatcactgctccattgtcatccatcaccttgtcgaccattgtggtgtgccaaaccgcggctgtcgtctgtttgtgattttgtagtctgcttgtactccctctggaagtgtttttgttcgtcggtttacgagagatggcttgacctcaagaactagcctagacaagcaacactttagctcgtgatcctaactaaaccgagctgagcgtttctttcatcaagctttcacaatgcaagccaaaccaagctccgcgcttagctcatttccgcccctattttaaggttgggccatatatggctgtgaaagtgttcatggaacaaaacaaacaaattcatccattaaattgcttggagttttcctttccactaatgttttcccctggttttacaacaaaagaaaacttttcttgacaaatagttccatagagcatatgtgatctttgctagcaaattcttggtaaaggattttaggtgcactgcagatagcaaaggtaaaaaatccataacacaataatatttacaaggatatttgtggccctgtggcaggacaatcatcaacatagttttgccacactattacatgagttcatatacatcacaatactgatagcatccggaagaacacttaatttatttacaaagcatccacaagtgagcgaacactgcacatttttttggacataaaacacacgctataaaggtattagtcaaacacacacagtaacacaaacttcaggcaacatacaagttagagtgccatgaaacacatacacacatcggcacccacagttagtcattcgatggagagcggctagtaagttgtaaactatagtaagcacacacagtagtagtaataccataattaccttttcattagatgtcttcatcctcaattgcatcaatctttttagtatttagaaaatcattagacaatgagctttttgatgcgtctttccgcaatgattttgacatggggacgttgagagagaatatcaaattccttgagaatatgaagcgcaccttgctctatctcaatagttttcagcgttgttggtacatcaagcttgatcttcttcagactaacaaatccaattgaagagaataaaagatgctcgtccttgtatgactcagaatataaggcaagggtttcaagagatgggagttcagcaagctttgaaatgaatccctgagatacctttgttttctccaatgaaagcatgctgagattaggaaggcatacatccataccagttatctcatataaaaattttagtttcccttgtaacttcatggacttgaggcggcgaagcgagattgtgatgaacacggttgatggaataatgtggccatgcaaggccaaattcctaagattctctagcttgctcagagcagcaaacaaagcctccatattaccagttgtaatgttccaaacaaataaattttctagatggaccatctttccaactgtcccaatcaaatccttctcacagttgtcaagctctattgagtcaagtgtctgcatatgcttcatgctgccaatttgtttaggcaatttgagggtaaaaccaaatacatgccttagtgtcttgatcatcaaccaaaagttcagtgggagcttccgaacattagtttctctgacatccaatgtctgtagaccactcaggcttccaatggacggagggatcactgtcaatgaacaagatgtaattccaaggtactgcagatgcacaacactacctattgcatgtggcaactcatcaccaatctcaatcccttgtaggtcaatgacacggaggaactctgatccttgtagcaatccttttatgtgagatctgatgtctttctgcttcttgttggttatccactgttgaggtggtgtgcaacattgtctagtttggtctcctttgggctcttgttcctttggctcttgctcaaactgagagaagatggatcgtagctttggcaatggattagctagggccgcatacttgtctgtgtaattctgtagagagaggcgacgagcacttgtcaaagtagggatgtcatcaccactatgcacctccaagaaacttgcctcatgcgcttcagattgcaaaaactcatgtactttgttttggatggagatgaacatagtcccggtagtagaattatcatctacaagaacaagattgactagattcctggaaatcaactcattcaggaagatgtagcccaccttttccaatgtctttccaactctaggtgttagaaaaccctctgccattcacatacacaccaagttgcgtgcctcgaccactacattgggaggaaatgcagcaaagtatagatagcaacatttcagttcgtgtggaagatcatcaaaacacagggacagtagattgtcgagccgctttgatttcttggaactaagatacttgaatacttctgtccactcatggggaaactctttggtttggacaagacctgataaaagaacaacagccagaggcaacccttccgtgattttgcatatgtcttcacggtattcttcaagtttttgatattgtgcatcaaattggagtagtttcttcaacttcaataccattggacctccggcatcaccttgcttgtcttggtttcgtaatcgcttgtggaacaatttcatgacaacattattttcaagaggttctaaccgaatgtgatgatgataatagagagacgactgttctggtctgtcaaatctgatatgcactattctattaccagtagaaccgactgcaagggtagtgagcatagtgataatgttcttccattcagttctgctaacttcaccatctatcaccagtaagtatttcttatctctcaacgctgtagccaacatttcatggaccatgcttctaggacaattcttgttgtcttctgtaagctgctgaacaatttgatgtaggatgttgggggctgttaaatgaggtgcaaaactctccatagcatgaacatcaaaacaattcttcttcttcattatattgtacacatttctcacaagagttgtcttgccaaccccactctttccagatacagagaccacaattggacgattatcatttttctgtagttcttgatctgttggagtaagggctttctcaagttcctcttggtgctcttcatataatgtcaaatttccttgttgtaaatcatccctgtagttaaaacattatacagttagtacattaaagagtaaatttgcataatgccaaagtgcagtgtattgagaatcagtatcaagtttgaaccatctagctgccttttccccaaatattggtaattcagaatcttgtgtacatatataagcccaaaacccgtttatgtaactttatgaaggagaagagattactgatgaggcatgcactttatgtacatgtatttttttcgtatttcagtataatttttatcttaaccactagcatttatgcaatgctagtcatgaagcagctagtaggtgcatgctagtaatttcaaaaaacaaactttttctagtaaatttaaaaggtaaatttaagtctatctatttctgattagtttgagagcttttctactttgtacctaatatccacacggttcatcatacagacctaaaatttgataatatatggtgtatatttcaacataccttgggcaaatttcaaagttgttttgcataacgtggcagtaacatggcccaagtaaaaatatttttaaacatctactacctccgttttttaatagatgacgccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10114 - DNA, 4453 bp, Oryza sativa
  unsure (1)..(4453): unsure at all n locations
gctggccttgattgnnnnnnnnnnnnnnnnnnnnnnnnnnnnnnnnnnnnnnnnnnnnnnnnattcaaaaaatttacataattataatttattttgttatgagttattttatcactcatagtactttaagtgtgatttatatcttatacatttgcataaattttttgaataagacgaatggtcaaacatgtgagaaaaagtcaacggcatcatctattaaaaaacggagggagtagtaaatactgaaaaagttagaacacgcatgcacattagagtatttagaacctacataaattgtttccccaaaaaaaatggtttcgttcggttttaaataatgttttataactcaattaacctactttattttgtatgtacaaaattagtcaagaatattggtggtttctataagtgagatttcataagatccattttactcaaaaacctactttttcttggtataccatcttggcaccatgtcatccaaaatcactattaaacaagaccgaggtaaaaaactatgcatgacagttgaggtttgaataatgttcagtttgatgttcattatttgtttttattctttttctataatttatatagcatttctcttgtaaaaatgcatggagctataaaaagtgtttcgtcgatgtgctcttgcttgatcacgaagtatatttggtctgacactggagttatgactatatggtacttaagtcccataattaaaagcctctatacattaatggttggtgtagaggctgagttatattttcattaatgatatgataagtgtaattttttaaagaaattaccaatattatttggtttaccagtttgtgctataactaccaatgtcaaacatgacaactttccagtggcttaaccccttttacatgaaaagtattagggatcatttggaatgcaagatttcaaaaatgcaggaatagaaaagaagacaagattagagtgtcacatgtgaacaaatcctatggtaattcaaaacataggaatcgaaacatatttgtgtttggatgaatcattggaatataaccataggaatttgatggaactaagagagataagatgtatattggacttctcaaaggaaatgtaaaataaggtttaagcttagtgtaaaattttctatatataaaatgggtccagagcatagcaatccatgggaatttggtatgctaaaatcttttgttccaaacaataatatagagcaaaaaaaatccttgtgtttagaatcctttaaaatttatttgaatttccttcaatcaaaagtagccctaaagctactattttttctccatttacatgcaacatatgcacaccacaacacatgccctgagagaattgtgtgcggtaaattttcaaagtaacaattaaagtaattccatatatgtttaattatatgtggacactaattaagatataaacattattaatatacatctccactttttagcaagtcaaagacttacgagtgttcggtgtgattaagaaaacacagttgtatctatatgtagttaaagaaatcatatgccatctgcagattggaaaatagaagagaaccacaccaccaagtctggattggaatgccatttccaccatttttcatcattgggaacattaatttttgatctatctacttattagactgtccaacaggattctaggccattggattatatatttacatccaaaatgctgtcactatagtttcatactttattctttgttactttttgtttgttcacaaatatttctcttccagaattgaaagtgcatttatccccctagtggtttttggtgattaatgatgaagtggttaagggatcaatgtgtttatggagtaaaatgcaagtgttttagtcccaggatgcttggagaacccccaaatcaacaaatttaaaatggcgaaagaactcggagttgtattagactagtttacttttttgcattcgagtttaggaaaaatcatactattaagagggattctaggtgtggttctgagatagtacaagtgctcttactcctgtccaagcgaagaaatatttttaagagccatttttagaatgggtcttctcaagacagcaagggccggacggaagttcctggcactttgggccggaagttcctagctgaggtgaagtcgacattttcctaaatgttggtcggaagttcctagccccaggaccaggaacttccggtccacccttcagttcaaatctgtgagtgacggctagatgacgtcacatatttgttatatatatcaaactcagacccagctcattctttggacatttcacttttgctcttccgttccctagttatttctagcctctcccaaggtgaatttgcttcccccacccaaaatcttgagccattcttgtgtgagagagtgattgtgagggtgttagagagatttgcaaaaggttttgaaggttaggatgaattgagcacttggggtatctcgtgggctgtcatttggagcttattactcttggaggtctcttcctagacggttaggtgtcgcccatgagcttccttcgagattgtggatgtcccgggcaagtttgtgaaggtattcctcacctccgcaaggaaacgaggtaagtgattaaggaaaatgtgctaaggtttcagagatcgtcctagtagagcaattctcacttgtggtcctctctagaagaaagttgagttggatcttggcggtcactcaaattctagagaataacctaagggtgttggattgaaggctgtggaccttttctggaatctttgcacaagagaggcaagaggttaatcgagacccaactcttcagagttcctcaacagagagtaggatacgtgcgatccgaacttcaggaaaaaaaatccctcttgtcctctctatgatgattttgtgctcgtctctgtgatccatttacttttttgttatcctatgttttatattgctctaataggtcaagtttcttgagtcgaagtttgaatctttgctctgatttaccaattgctcggaagttcctgtcttgcaacaccggaagttctggcgttcttcatcaggatgttccggaccctgttaatttaaccgctgcgatttgtttttagaatttcaggtaaacctatcccccccctaggctacatatctctgtgttcaaggaatgtgtgtggctaaactttcaaacatgattgtatttttaatagttctgtccataaatattagaacatgtgtgatggacaacaatgcatttggtgctttgttggtatatttcttatagaaattacacctatatatcctctctaacaatttatataaacaatttaccttggtaaatctaattaagtgcacactaagtatgttggataatggagaaccaactagagaagcatgtaaaacacaaggaaaaatgcacttttgcacacttacagctcagaattgctttcggatattgacgttgaagccttccatgtcacttctattcccttattcacatcgtccatcttgtacctatctttgttttgaataatttcctcaagcctggtgttgatagccattatctttttagagagaatgcgtcgcattggtacttgcgttgtaaaggttacaacatatctcatggatggttgagcccaccttggaaacctgcaaaacatatatttatacactgaagcgctagaatagatatttacaaatagaaccttagtgggattttccccgcacatgcgcaccattagtatttagaataaagaggtgggaaagttgatttttgaactaaaacatagatagccaattaaaagccatggatgcttaatgtctgtcgagttaagtgaaatatattaggaaaataatccattttacaactctaaaaataaatcctaaatttcatttggacaccgttcaacattgaactttttttaaaaaaaatcactttgcatatatcctatattaaagttagagtggtcttccctaatgtggtgttgagtggcaatcaaatcagacaaaaaagaagaagctaaaaaaaggccctcacatgtgtcatcctccctttattctttcccctctcttcctgccggccaccttaccctcagccaccacaccttatttttttttccctcccttccgagctcccctccccctctctctatctctctatgtgtgcacggcttcaaagtagccaactaagttatattgagcaccgtgctcaacctgcagcttgcctaacaaccactacgggaagctccaggagtgagtcctcttatcctatatacttatatagttcatccccactaagtgtagttaatgctatttctctcttctctcattaagccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 10115 - DNA, 2920 bp, Oryza sativa
  unsure (1)..(2920): unsure at all n locations
cgcggtcttgtgatacatctcattnnnnnnnnnnnnnnnnnnnnnnnnnnnnnnnnnnntggatgatagatctatggttcaaattttctcttctttcctctcataacaccaagtaatctcaatcatttttaggcctcaaaattcataagtatcaatttgttttagttttaatattcatatttcatcttctttgtacatattatgcaacttaatttccagcagcaacgcggcggggtattcatctagtttacaaaagttgcaccctagcagcttttgagagcatcttttaatccaacctataatccaacatccaccaccggcacctcctattctagttgcgtaaacatggcatgggtgtgtgttcatgccaacgtgctttcgtaccactgaggtatgcccattgttatgtacttgtatgctaagctaccaaggacattagccttgaagagtgatggggatggggatgagagtaatatcctagataataattttcctattcacccattaattagccctatcatatatgcaatatgttgcctgaggtcacaccctgtagtggggtgtgatattctctaattactttggggcaatttcgtttctgccctactttaatgtctaatattgatttacccatactttttagggttttcgtttttgccctcacttcttttaaacgaacgatcgtttgcccctactttggatggggaagttaacaatgttaagtaattggcagaagggcatttataccctctcctatttctgttcgttaattgcgtttttgcccccatttcatacatattgctttggaactttatttttgtgaatatatttaaaatgaaatggcgcacattgactaatataacaattaggacaggagacaggacatacattgccacaacaattaggtctgaatctgtcctaattgttatattagtcaatgtgtatcatttaattttaaatatattcaaaaaaataaagttccaaagcaacatgtataagatgggggcaaaaacacaattaataaaaaaaatataagagggtataaatgtccttgtgacaattacttaacacctttaacttcaccatccaaaataggggccggatgatcgtccggttcaaaaaactgggggcaaaaacaaaaaccctaaaaagtaagggtaaaatcagtattagacatcaaagtaggggaaaaaacaaaattgctcgaattactttctagtttgcccattaatatttttttattttgccatgtgtttgctctagttttccagtttagtctaacctgagtttagataatttcaagccaacatacaatcatttgtgctccaaccatagcaccatggacttagcccttttaaactaaatggggataaaaatgtaaccattttccttaacctctgaaggagattatgtgtcagaactgccacaaagcatgtccactgctagggttagcaccccattgcacaccttgtcggtgttgatacgtcatgcgaagtccgaacttagggtcaagtagggagggaaagaagcatgatccgtgcatgtgcactttgtgtaacaacattttacttttattatgggcatatggtcaagtgtttggctgaaattttaacactttgaccttttacaaaactaattttataaatgaaccctgcacaaaaactatataaaaaatggacttcgaggacagaaccagggccaaaggcactgagttccaatggctcaacgccagcgagcatggtatagtaaccgctaccacgttagcggaaccttatgcacaagtggcatcgggtcagcactacgctgaactcatatatcgacaattaatatatacctaattaaaaatgcgtaaggcttctggacgagatttttggctgccctctccctcccatgcgccggacgccctcctccctccctccctttcgtgtgcgcctccacctcctcccttcccctgatcccccttcctcccgacgacctctatctctttctcacaatcccaaaaaatcatccgatccaaccccattggacatgctccccattcccccggcccctctcctccccccacggcctctctcctctctggcgctcctcctccccgtcgccccctcctcccagcgctcctcttctcccctacactccctccctcctgtgcgttcaacaaaaatggaacctcctcgtctgggaacacattttgacacactcaccgaccgtgtttcaccacaagagctcgtcgtgggtggttctctctctatcaggacaacgttgttgctggtcgtgtttcctatgtctggtttttcttcgttgccaccctccatcatctatggacgagtcacatcatgagacacgtccagccaccttactcaccaccgtttggtcgccagagcatgagcgcccatcttcactcatgttctgttttttgtttaggctagggaagacaatgaacaacgttagtcgcctttctccatctttcgttcttactacacattcaaggaaaacggaacctcctcatccaggaacacgttttgacgcactcatctggtcgtcctcaccaccagagcttgtcgttactgtttctctctctatcaggaccacatcattgttgttcctgctattctggttttcttcattgccaaccaccaccatctacgaactagtcacatcgtggggcatgtccggccaccttactcaccacagtttggtcgccggaggactgatgtccatcttccctccttttctgtttcttgtttcatgttgttttgattttttttttcattggcaacctccaccatctatggacgaaggctctaatccttcgtggtatagcccaaccatgctcctggaccacttacataatattgagatcataggaatatgatcagaacataaattcgggtacgagtagaagtanctaatngacagg

SEQ ID NO: 10116 - DNA, 2916 bp, Oryza sativa
tgatccactaaaaaattattgtcacttgcaatttgctctgtgttgaattatttatagctaaataaaataaggatttagttatataattttttctgatattgaaatatcgttccagcaaaagttagttgtagtttaatactgttatttctgtgatcatattcccttcagtctaattgtgatatatgcatggtttaggattttaatttatgtcaataaatgttatttagaatccgttgcaacgcaggggcattatgctagtacttaatataccacatcatgtcatcaccttctaggtggtgcaatggtttgttgctattgaactcccaagaggtcccacaaggtatggtgttgaccccaacttcggggtttgtgttaacctaggtgtccattcttatatactttaacagggtttatttcaaaaggactggaatgttataattcctgagtgtttggaccggtggtgtttgatcaagtgtttaatatataacaaccaatatttatacaattacttagtttaagtaaagcaaaaggagtattactagatttaccatcaaaagcactttaagcatgtctaatatgtttatatatatttgtctaaatatttctttcagaaaaaaaaaactcaaacgaattagaaataatttaactacatcatatgttaaaaaccgaaaatgcttccggacgaacgtccagacactgcaaaatatgggacgtcgaccttatccaaacacacagccacatcccacatccttctccaccacagattccttcttttctctctctttcttctctcttgctgcttcaccagcgttggctacacagcggcagcaacggagggcgagacgacgcgggataattgaggcactgatcctcgcagaaagccacacagtgatggagcttatgcggcggcgccggcggtgatgggactggtcctagctatgggcacccacctctctgttgctcgttagggggcagcggccggagttgaagaagaagacagaggtgtcgggtggcggcgaccggagttgaagaagaagacgtaggtgtcgagaggtggtggccgaaactaaagaagaagacgaaggtgggtttcctcgggggccggcaaccagagttgaagaagaagtcgacggaggtgagtttcctcgggggccggtgaccggagttgaagaaaatggaggtaggtttgttttgttggagttttagtgatgttgcattctactgtttaagcttgttgcactcctattaaggtgtttcattttgttttgatttgatgttgcatatattgaatctttgcaatcaatatgtttcgattgcatttggttgaaacacttatgttgaagcgatgaaacatttttccttgatggatgaaacatctgaaacattttgtaacaaatacaccgtccgatgttctgagaaatgccagacgtccgatttgtccatttaaaaccagaggcaatatctatcatggatgcagaaaagggaataacatactacctccgtttttttaatagatgacgccgttgactttttctcacatgtttgaccatttgtcttattcaaaaaatttacgtaattgtaatttattttgttatgagttgttttattactcataatactttaagtgtgatttatattttatatatttacataaaattttttgaataagacgaatagtcaaatatggaagaaaaagtcaacggcgtcgtctattaaaaaatagagggagtatctagtagcagctatatatacctggacatatcgacgcggagatagaaatgatcgagggcgtcctcggcgtcgaagacggcgtcgcgcgtctgcagcagccacaccttgttgacctcgtcggagacggcgcgtcgcttggcgtcggcctcccggagggaggcctgcagccacatcagcctgtcccggagcctcacgatgtcgtcgttcaccgacaccagcgcccgagcctgccccaccgccatctcttgcagcctccacaccagcggcccgatgatcgcctccgccattgtcgatcgatttactctctctctctctctctctaattgatttgtttgagttttcctttctgcagacaatctttaatttgcttatacattgacttaattcgttacatatatatgtatatagagagagagagaggggacgacatgcttgtacgtgagctagctagcttattaggtagctgctcagctgtgttacgtttgagtcgctgctcggggaggaatagattttgattcctcctctgctgactttgcgtacccatatcgctctgacttggttgttctttgtttaattgtgtcatgtgtgcttaattaaggtatatgcttgctttcatgcttttttttccagaaaagaagttaggaatcatgaaagggaataataagccgttgggttgtcaactaattcacgtcttttagaaagggttgtctgggcattctgttctttgttttttttttttcactgagtcttcctgtcccaagttgtgggaaagagctgtagcatcacgggcatatgcaactcgatcagggcatttacaatgcaaaactgtgcaagcggctttaccgagttacctcggaatcagggtttcccaaaccgccgggaccggggttaccgtgccctggcggtaagcacggttaccgcgcattaaccgtggtaaccgtgaaaaaccgtacgaaaccgtacaaaatttatcaaaaattcaaattattttttaaatttatttaaatttaagtaggttaccgcgggttttctattaccatacccccgcggtaaggccgggtacggcagtaaccgcatagttaccgacggtaatataaaccctgcctcgaatacaatatggctactatctatgctgagactacatgtgcaaatgtaaaacaaaatcaatggcctcatgggttatag

SEQ ID NO: 10117 - DNA, 26931 bp, Oryza sativa
  unsure (1)..(26931): unsure at all n locations
gtagtagacattccgtaccccncatgcaaaaanatatattccaaggaagaacccgctgggcttgtcgtgccttcggcccggcacggcacggcccgagtcttattaggtcatgcctgagccgttggtgtagcccgtggattggcatggattttatggattttagcactagccatgcctaatcatgtcatggggctcatttgattacctatataggtagcttcaaagcctctaacattttatatttagtcctcttctatttctaaatgacaaggaagttcaaaattttacactacacttcctaaattccataaactaaacaatataactactctctcccactcattcactccatcagctctcctctcccttctttgctgccaccatggtcgccgcctctctcctcttcgcctatgcttgctcccttcttaagcactgtggtgacaagatttgtggtggctagctatcctatctcagatctccttggtgctgcagtgatgatctccgccgttgtttgtcctctcagactaggggcttggtggagtggatatgacgatgaggatcccgatggcatttgcggatggtgagtggagctcaatgactacgcctgatgtggctacaggctcgccaaatctatcgctataagatctccatcaccacttcctcatgcttaggtcaatgctccctccttcttggaccacacatagaatgccaggtgaggttaacgtgccttgcagaaggcacaaggaccccatgaagccacttgcccccatcccctttcttctcctaggcagtatgtcgccaacatattccactctctcctccaaagcaatatgtctccaacatactgagttgaagttacttaccaacttaccgcattggaaataaacttagagagcaattacaaaaggctctagcataatgatcctatctcaatctccaaacttttccaagtgcaggaccacttaaaaatttgagagcttagattagatagctaaacatgctatgacttccattgtagttccagaaatgcaagatacacctttggctaacaatgtcaggttagtcaattttcatgttactattgccctcctgcatccttatctttggagagttccttatcttctctatcgacaagacggggtaagggttgagggtcattgccaagcgctactggctctaggtttagagggggaggtcaaggtgatggaggaccagcaatatggaaggtgtaaacacaacgtgatgagatgaagatggtaccattgaagccatgggggtatagaacaagcagagaagggtgttggatagtggaggctatcgaacaactaagatatagtggttaggcgctaggggaatccctgggaaagtgattaggaggcggtagatggtagaataacacgaatgaacgataacacatcgcatggcaccgtaagagagttggttgtggtgtagaggcagttttaatccatcatagaaaaaataaaagtgaagaagacagagagggttcggcaaggcagaggaacgaaggcaacaagctgaaattaggacgtttcgtcgtgcgataacgtgtaatgctggagtgcttcgcaacagcagtaacgggtaattctgaagcgcttcacaacagcagtagcggtttccacttttcgcatatgcaccaacaaactcaaaagatccctagaatatacatgcctgcgtgacaacaaattatttgcgagttcgaattccagatttattagaacaattttgaggccagatttagtatccgctttagtataatcaaagccagttttcaaaagacaaggtacccaacacttcaaatattcccaacagtattagcttgtgagacctgggatatatttcctgggtacactgaattcacatgttcatgaggagataaacttcaaatcaaaatttcaacagcgcaaacaacaatttttgacaaccctcggtggctaatttttgttttctactcatgtaacaaaaattaggtccctaataagacaagttcccgcaaaattaggtcctataacaaaaccgagctgacatcacatattcactcttcctcttcatcaccatcaccatcaccatcaccaccagaggcctccttctggttctttctctttgacccttccaggctcaccgccagtgggctggtaagggagaagtcgatgtgcttctctaatcaagtctcaccatgaataaggggatgttgacaagctgccttcccactctgcacaacccaacatttagcaagtaatctaggcttcaactacgcaaagacaaactaaatccattttgcacattttgcaggacctatttacacaagtactatagctgtgatagctttatgcatcaatatgagactaaacacaaattaaatcctagcaatcaccgtggacatgatgggatcacgcaattccttaacatgcaaataatgaaagacaagtgagatccattattaagagaaaaacaaagtcatgtacaatgtggcactcagaatgaaaaggacattttgagtcattagcctaatggcctcatagatacattagcaaagttagttcctcattgtgccaccaaatacaaactccaagaaaaatgtgcaaaaaagggcaacaaaatggaactactacataatgccaagtgccaaaccaacttaatgacaattatgaaccaacaataagatattataaaattctgcaaaaatagtatgtggttcacataaaactaaaaacatacatgaccctagcaatgtaagaagtttaaagagaaatggcagggcatcagagataatatgactgcaccattacacactaagtgtctcagacgaccgtcgtgagttgcatattgtttctcatcacatgacccagaatgaaaaacagaagtgcagttcgaaaatactgagctatgaggttatcaaaacagaaaatcaatgttcaatcaagcccatgtttatttatgcatatgcatttcagcagtgtacctaagttaaatcaccagtcatataagaaatttgaaatccatacctgatgtggtgttgcctgatgagtacatgatcatgatgaatggatttcaccgtgccgttcttgaagacaatggtctggaggcggcactgaaggaagttctcaacggtgagcgcaagcacgtaatcaagcttgttctggccctcaccaaggagaccatagcggttcatgtggcgcaggagagcctcgccctcaaagatacgtcgggggttcttctcatcaagggtgagcagctcccttgcagcattgcggatagggcttagggcttactgcacacgccacagctcacacttggacctgaggccatactcaccatacagcttcagctcagcatcaggacgctctttctcgtatggacgccttggtttcttgaaagtcttgccatctgagaaatattaatattgcgaaattagacatgtatagcccaacacaccatgagtatcaggtaaatgtacgaaaatctaaggcatcaaataaaaaaccacgtttgaaacaacagtcaatttatatcaagagctactgatcctcatatcatgagcgaacgtctccaagatatatgcccctatagtcaaacactttactctttcggttaggattcaaaaggtgcatttcagagtgcagttttcatttccacgtcaagcacgactactgtgattattaattcacataaacgaactattgacaactggcaaactcgagcaagccgattaaccaaaacgactcaaatgtaccaaatcagttacctttgtgaaatcaggcaagacccttaatctgcccgtggactaccaaaacagattcaaatgacgagatctcggactccagattcaaatgcggaaccaagtaattaagtatcaaaacttatcaaaactgctgaagaggctagctcgggatcagatgctactgctatcacgttctgtgatccaatggatcacgggtacagagagacaaggcaaggatgttgcttacagttgcgatagaagctaacgcgcaccatggctgacgccgcccccgcccccgccgctcgccgccggtctcggccgccgccgccgccgcggcgagatggattgtggggttagggaggcagtggaggcggacgagagttgggggcggagtcctttataaagcaggcgctaaaccctaaccctagagcttttgccttggtgggcctatcttttgtggccttttagatgatatagtgggctgtcttatgggcctatggttgaacacctctcgctttgttttctcctctatcttttttttttctttatctcttctactctttacgtgtggtaaaggaattccaaattcttctaaagaagaagctatatgcataaaaaagaatcattacaaatattttactaacactggtgtagtataatacattgaatcttggttttatatgacctccaattaattaatcctagtatgctatcaactgtgataagaagcacttaattttccgtgctcttgcaacaattaaacggtactgatccgatgatccattaaacctaagaattgtgataatgtcttgaagttctttgtaacactgtaaagtttattcaacttgttatgtagtttcataatgtttgaaaaaagaaataccaggttggcaaattgaggtttaaatcttaagatatgctgtaggataaataccttcagaatctaatcctttaggaagtacagtagtagagtccaaatatgcaaatcttataaaaggagcatggtcagtcgaactgtccataagtacataaaaggttttgattgaagttattgaaataatttgtgttgaaaagacagctgagagtgtgggagcaagagcgagagggatggattctcattgatcaaagcgtacaaaatatataatgtgaagcggtggcaaaatatcactcagttgtcgagaggagcaccgaggggggagagaggagcgatctcccccatctctgccagttagtttcttaatgatttggatttttgagttttgtggatgggtataatgacgttataacaacgttttcaaaatagttgtttttaatggaattttgcactgtaacgtagtttgactagttaggttggaaatagtccactcgggtttaagtcttaaacttgatacgagggcttgcatttatgactaattcttttttccagcggtggatgatgcacccgacaacgatgtgcctgtgatgacttcgttaatgtcaacgtatgtcggatgagttttccgaatgtacgttcatagaggtggttgtgcgcgcttctgtgagcatcaatatttggattggctttctgaaaagaattttttttaccaaactaaatgtatttaggagggcttatgataagatgggtatcaaattgcagaggatttcttagttgattgctacctatactccggaacaggagagcctctctgcgcgcatttcaccgaacacacaccatgcactcgctccggcgcgccctccgcgtccccacctccgcctctggcctgcgtcgcctctcctctaaccgccgcgcgcctccgccgtcgcgagccgccgccggcgccgccaccgcgaccaccggcgacgacgagtggaacgacgcctgggagacctcatggctcccgggcgactcccccaccttttccccggcgcccgccgcgccgtgggagtcccccacctcgggggccgccaccgtcccggccatctccgcggaggtggaccctgacaccaaggccttcgtggccgacatggacgagcgctgggccgagcgccgcgccgcgtcgaggcggccgcgccccgctcctcgcgcggagggtgcgggcggcgccccggccaagaaggcgcaggccgacgagtacagggcgaggaagcagcgggtgcacgccgcgctgtgggtgaaggagatcgagaagatggaggaggcgcgcctcggcggcggaggcggcggcgccgacgacatcgaccgactcctcgactcgtgctctgagtaagttgctgctctaattttttccccccttagacaaatttgcgatttaaactgtatttgcctgccaaaatgtcgcttgcatattatttgattcctcgttgtgcaccgcacttggtggtggaatctggagctgatagaccatgaatctgtatcaaatttcagctgtattttataagttagataggtattgtgttagactgtcgggcaatactatgaattatggctagttcatttgtagctagagcctggaaaagctgtgatttccttttcatctggtatagttgctcattggtgaaactctgatatgtttgataacttgggacttgaatagtgtatattatgcctccgattatttttttgatgcatagcacctgctgcatgtcaaattgataacctttttgttgcatgatgtacaaattaaatgttgatctggtgtggttcattcaaaatataaccgtgttgcatatattgtttatctccaagcttccaatgtagcagcttggtttcacaaattatgcgtactatgtgaatttcttctggatctagtacagttcacatctttcaccctcaaatttatttttttctcaaaaaataggaagtactgtgcttcgatgtttacttgattttgcttaggaacaagcatatgttagcgtcatttgctgctcaccatttagttgatagaagcaggagcatttggaatgacattagttatgcagttttcttttcatttgctacaattgcttagtaatcagcatatcaggcattaaaacataaactctcatagtctcggtattatggcagcactccaaaactcctaatgctactgtcagtctatttgtcatttttgcatatcttcctgccataacaattttttgctgcatgattggggaggctttatggcttgtacaatgttttagtttccgtaagctcttggttttgctaagttaggaatgcatatttttcatgtgagcaaaatgcttagcaatctataacacgtagctggcttataattttgtgaaatacaggattttcgattctggaaatacagattttggcgattcaaagattccaagcactgctgagatcaaaaccaagcctgatggttgggaaaccacctctagaggacaggatggtagcatatgggatatctcacagcgggaagatgacattcttctccaagaattcgaaaggcggattgctttcagtaaacagcaggtccacaatcactctctctccacaattttttttgtgttattctagttatttctgacatggtgttgaaatgcgactgcagattgctagcttcatcaaaacacacatatttagccggaggcgtcctattgacggatggaagtacatgatcgaagaaattggccctaatgctagaaaagggaaggggagcgtacagagactgcccagtgtgactgatcctgctactcagccgtacagggaagagccacctgcaattgcatctggttcgccattcagaggaaaccggccataatctctcgcgtatttccgttggtgtgtttgaagatgtatcagtagatacattatgtgcgaaaggacatggtgactttttccagctacggagtggagtagttcataaaattttgtacggattgttcttctgaataacagcaatggaaaatattcaagtgttcaatgttaatgctatactactatatatcagcctgtttggttgccaggtgctgcatagttgtattgagatgttgctggttcgtcagactcgatagaattgtgataatgttggcttggaggctggttacaggcgtatagtcttacaatttttgttctttcataacttttccttcgattgcaattatcgcataaatgcattttaattggacatcaatatttgcaaggggataaaacgggttctattctcactagagtttacagaaacaaaagggagattgaaatatttacatgcacatcattcagtagtatatcctctaggctcaaagtgagtttctgattggttggagctgatctactcaggtcttacttggaatgcaggaaattttccagttttcatgcaaggacagaagtgttttcgtgtggaattcctgcatgcattaaaaacagaccctctcaatctctacctgtgctatcatctatcgtgctaccactacatttgctcatcttccattcttggaagtcccaggctaataggccaagaagatgcctctgttgggtacctcggctgcggtcgtgccacattgttcggagcctcctggtcttctgatggttcagggtcttcggcggggggtgcttctaggaagagcttcagttccagtggctgtcttgcagagggctcaatgactgttggttgtggcagtggctgctgcaaggggaacactgtgcttgttgtcatgggagatggctgcattggctgctgcgatgggaaaaccgtgcctggagagggaggaacggggagaggtgatccagtcgcgccatggccccaacctggactccctgtcgcacgcatcctcagctcgttttggaggtcagagatttcgctgcgtagcgcaccattttcatcctgcaactcattcctttccatcgtaacctgtttgtgggagaaaaaacaatgttggaatgagtgttgcattatgcatacgacaagttagcaatgtaaatcatcaagcacgccaaagaaagggaaatggttctacaactgcaacaaatcaacagttttttttttccatagcaaatattacttacataattagattcattctggagggtgctgttttcttgccggagagattttacttgagaaagcagatctcttaagatccgggtggtgtcagttagtatgcatgccttcccattactctgcctatccgcttctgcagaaggttgttgtatttgatcagatgctaaatagcagcaaatttaagcaatgatgaatccagttgctagtaatacgaattatataatgacattcaagagagagatatgtggtttgtatttctgcgcaacaagctataataaatttccaattcagacacatagaactgacgcaatgccttgtgatcaaaacagcttacctagcatattacccagctcgccgaacagatcattgagatgcccgcgtttaagcttctccctctcagatttgtgaaccttcctcgggaccttcttccggcacttcttgtcagagataggcctgcacaaggtttcaatgggaacttacaacattagcaacaatgcacaattctcaactttcatttcctcccaaatggaaaagggataagaattaaatcgacatgcagagataacaactaagtcaataaacctgacgacaaataatttgccaataccactatatagctctacgccaccaacggcgtctaacgcagtatgattggcaggcttccacatttactattgcagggttgctgcttgagtagtgagcatcatcactaattctgtagattcactatggtatgatgcctaacaaacaaactgcgcctcgagacaaatcatgaaacaaaaattttagcatccccagagcatctatctctttgcttcctccaagaacaagaactatcccccaagtccccaaacgagacaaccaagaaacttcagtcactcacccatggacgagcttgtcggcagcggcgggtctgatggcggtggcgacgtcccccctctccgacggcaccatggcctcctccaaaaacctcccccttccgttccctgctgaaaaccaatcgaccaagaaagaacccatcagccatcgatccacccaacccaacccgacccccccaaattaatcacccaattaacagcgcaaaacatcacagcaaacaagggcaaacctcaaatcgatcgagggggcagaaagagaaccgcgtgggcgcgtacgaggaggaggaggagggcgaagattgaagaagaagaaggagagccgcgaagggagcaataacagcaagggggagagggcggcgaggcgagtcaagcgcgggaggggcacgacgcggcgcgtggcgcgcgcgttgcggcggcgggtggtttctcactggcacgtgggggccacgggagtgaacgggcccacctgtctgtgggggtcggtggagagatctggtggtgggccaggagccacgtgaaggggcgcgtggccggtggcggcctctggaggcgggagcgccggcctggcgcgtgccggtgcgtggggttgcgccacacgcccaacgcacggcgcgtgcgtgccccggtgcgcatcaactatcccagttcctccgtagtttttttttaaaggtggtgtttggatatcgggactaatatattaaaaatattaaatatagactaataataaaactaattatataaataagagctaattcacgaggcaaattttttaatcctaattaatttataattagcacatgtttactgtagtatcactagattaattaggctcaatagattcgtctcgtgaattagtctaggttatggaatgggttttatcattagtctctatttagtacttctaattagtgtcaaacatccgatgtgacatggactaaaattttagcccctaatccaaatacatgaaaagatttagattttaaattttttaagtatagttttgaaaataggcacttttttagaaatagatatttcttcgatatatgaacacaaagttagtgatatacgatgatttatagtcggcagcgttgtgaagtttggcatcgaagtgctcgtgatcatctctcacgcaaagtagttttgcagttcgattgtttcacttatgcttatccatatcgcttataggtaagaaaatcttatttatgataaatgttctgtatacttgtcgttagcgttcaaaagcaaatagtgtaaaataaattacgatgacaaacccttaaaatcaactctgaaattaaattttaaaatttaaattttggcttagaagggtaagcataagtaaaacaatggggatattggtgactggataatggctatgcatgtcacaccttgctgtcaagcctagtactaccatttggctaaatatgttgatttcttcaaaattcatataaattatctggactataaacagggcattaaaaagacctattttttattgtttggtatagagaaaatattttttgcgatgatgcattcgatgggcgaaaaataagagaaagtaagtatttacaaatatgattcaataattatgggtctttcatcttgtgttggtgcttattaatttgtgttgctttatgttaaattggtgtgttttgtggtcttattagattgtgagcgcttttgagcgatttgacgtaataattggctatagctcattgagtaaaggccggaagtacattccattatataaaaaagagaaagcaagtatttacaaatacatgatttgtaatgcgatacaagctgccatcagttggccaattgctgataatacgccaaaagacatattagcgtaaaaaaataatatatggttaaaacttttacatatgtgtttttaatgatttaaactccgatattaaaaaaagaagccataataaaaaccttaaaattaattctaaaattaagttttaagatttaaattttggtatgagcatatactactatgtcccagaaaaaaattaaactatgagtttgaatctaaacacatcacatgtgtgtgtccagattcaaacctaaggtttaattatgttttttgggatggaggggatacgttgtaagacaaaagatgtggcccacgagctttcacaatgttataacaaattatgattcacgcatttctcttgttattcaaatctttttaggaaaacctcttttacaaaaatacatttagactcgatgatgagttatgaatgatggaagtgtaaaatataaattgttaaattattattcatgcatccattattagttttctctggcagtatatattgacttgttgagtaaaccttgctacataattcctgcacgcaagttttgtacattgcatgcgcaagatggtgtaaaggctaaagattgtcttagggacttccagttattacaaagtaaaggtgcttctatttcttggttgcaatatgttgctgggactattatttaataataaaataactatttgttaactgataatctacagtccgtcacttctatttttagggttaaaagtgtgaggcgtcatggaacccgaatttccatcaaagtatgaaaaaaaaaataatatgaggcttctaaaccggcatagtacatctaaccatccgtttggttagcccaagttaaccatctaaccatccggcatagtacataattcctgcacgcaagttttgtacattgcatgcacgagagtgaatacatctaaccatccgtttggttagcccaagttaaaaccatttagaataaaatcattttgaattttggtaattactattaatacggacacataagcaaaaccctccaaaaaaacaggtgactggcaatagaaaaattgtttttcccggtaaaacaaaacactccgacagaccaatacccatttcagattttcagtagagaaatgcctgcaacagacgaactgcaagttgcagctccatcaaaatcgaacaacatttgtataactgaatctcaaaaggacagcctcaaatagcactaaaaataaatcgttcgtctgttaccaacagaaaaaaaactattacatacgtagctaaatttgattattggtcacctcggttcagacgatcagaatactagaatcttatggatctcagtttcattacagtgcgacacctccttagagcacaaatgcaccaaacaagcaagattagaggccagtttgagcattctcaaattgtcgcaccagctaaggctagacaaaactggctaaaagaaatacggtcatgacaagccttgcatacatgaactttcaaatccaagccatttacatcaaaagatgaaacctgtggttgagattgtcaagactgaggcagccggttttgaaaaagatttatacctgcagtgcaatttaccttgaaaagaactggcaaggccacattgcaagggtgctaacttttcggaaaactcaagctgccaagagttcattcctgactacagtggctataagtttacagaggaggtagatgatgcatacccttcatatgtaattaagtcatgtcttaggtcttgttgggagctcagtggaaaaaaacaacccagcatatgtaattagctgctcttgctttcaacaacccagtattgtttaaccgcaaagagtatcttctcaggcacatgagggccaccctcatgatcagtcaatcttgtctgccacctcatggcgttagctattttctccacctttacaagaacatcaaccttgtcacggattataactgcgccctctggtcgtaagatccggtccatttccaatagtatatcttcaaatttacacctgttttttgtaaatagaaaatatcaattaggaagatgtaccaacttaggagcacattcttgtttttgcaatgtatgacattcttacttattctcatataagctgaacacagcgttagcatgtatgagatcatatgtccttggatatgtagaaaatccttcacacctgtacaaagaataaaaaaactatggtcaacacatatacctatgtaacaagaagcaaccaatgcttttcagatttcaactgatcaaagctaacagtcagcacagtcaaaacaaacacatatttacaatagcagaataactaacagactgattttattattatgcaacttcaccatgaagagcttgaactgatattggcagagctaaagttcaatcctatccttcagtctctacagaagtaaataaattgatccgtttttgacatgtttctgaagcaaatgaaaaccattaaaaaaaataggttttccatgttggtaaagtaaaatgtgtctcctctaaaaagcaaaaaatagtatgcagaaacaatggcacgaagaataactgaataagtgagaaaaatagagtgcaatgaccaaaacatgagtccaggagagcaatacagagaagcattacataccaatcatgatacattcctattaatccccgctcgtagattacacctaatgtagaagtatctgcaatggttggaacaacattcatgacccacagcttcgtggactccaatgcagcagcaaaactaccaaggccagcattcatgtccattatgttacggtatcttccagtatcaagcaagttattgatctttttgtaagcgttaatatgtttctgccaaagtttattgtcatcttgatatgactggactgagaacccaggtacaaaaccatgggtaatcctgggaggtactgcattgagtctctggggaaatggctctaattgaccaccagcaacctctgtcatggttttaacctcgggaaggggagttacacagacctccattttcttatacctgtatttagtgaaggaaattgaattcagaagaatgtaagtgctagaaaaatgaaggcaaaaaaaaaagatcatatagattaaaacggcatatttttttgtggaggatgtcagaaagaatgtcactcaccatacatcattgtcatatgccaactcacacttgtcaacttttggattttcttgtttcatggggcaggatttgtcgtttattctctttctccatatagcaataccatccttctcagaaatcttattccaacaaagaagttctgcaaattgttctattcttctctgctcactttgaagatcatcctttgttcgttgccatcccttatagtgaatcttccagccaattggtgggcctgagagtacccaataccctccaggccttagtaccctatcaacttccatcatgtacattccatctgcagaaccagagcaaccagcttgcttcagatgtgtaaactttaaatgagaacattttaaacagtaaggattctaaaagtgattttaccatttccactccatggaattaaacaccttgagcagtgggccatgtcaaagacacgtgatgggaatgacagtttcattgatccgagaacacctatatatgcgggaacacctctctccagtgcaaactgtacttgagcctcatgattatcccttggtgcaaatgacatggtcaaaacatttttcttcaacaggtaagcacctagactagcaacctgaacaaaattgtggcaggaaaaagcattaaaagattaaactccgtaacatgataagaacaacaaaaactaatgcttgattgctcatctaagtttgcatctttagagttgaatcctttacgtaccccacaaccagtgtcgagtgctgttctcactttcccattggctattgggataacagaagcaagatggtctatatacttgtctgcaccctgaggaaactgtgttccaccaccaggaaacctgaacactttaccctcgtagtgaacccaattctggatagccttctcaaccgtgaggctcttgtgagggatatttgcataatgaacataatcacggctctttggccaatgaaaaggagcagcataaccctttggtgctggaaccagacaatagagcttatccttttcaggtgggcaatgcctctcccgatatatcatattatccctagggaaggtcattgcacgcttttgctcctcacagggagtgtaatctgtgtactgtgcatcacatggctcgaaagttttaacctcagtactcccagtatcattaggaaggtctgaagcactatgatgggtttcaaaattcaggtttggaagaaccacgcatttagtctgttcgttcaccacagctgctatgctgtctcctcttccgaaaccacttctctgccacacacccaagagatagaagaaggaacaaaggccaaataaaacaactacagatacagtggtcctggtcctgctctcagttgaactccgcgccatacctcactgtaagataaatacaattagattcagtaaatgtgtatagcacaagtatggacaaaccgacaagttacaaataagagtaaattttagaacacccctcaatctatggtcaaagttgcagaaaaccacatgtatagattagagcaagtttaatagtatagccaactattagctccaaatcatctatagccaatgtaatagccaattcatacaatagttgcttactatactattaatatctggtcctacctgtcatacacacattacgttttggagtccgtgctgcagctggctacaaatctgtagcccgctgctgttctctctcttcctttatctctttaaaatatgtttatagctggcttatagcctgctattgtacctactcttaagcaacgttgaccataaaacatggggttctgtgcaatttactctaaaaaataactctgaagttcatcatcaatggcatacattaagcaaggaatggaatgaattcttgatttccgctccttatatttccaatgaaacttactaatcaagccatcagtccattatacaactgaattatgttcaaccaaaaaaaaaacatgcagatatgtgcagaaaatatgtaagtaccgaaactagcagaactagaaacgagtccatgaacctctctatgttgccagccaaaggcatcaatacattactacattctgcaattgaattagatttggtaaggaaaaaaatgtacagcagaaactatcactaccgaaaatttagataacttgttccaagttaacaagaaatgttttaaatcggattatgtcttcaacaacacagtatctttgcatcgtttcatcctaccagcaccgactgaagtcaaaagagcacgtcctatccattcgatgcaaacacagatcatggattaaatacgccaaaattttgcgtatgcgtgcgcgctacctggacggagctctcctcggcgacgggcggggaggagaaatcaggcgcggggatcgagcgcgcgcggaccggatcgggagatcggggcggcgcgcattagcttagaccccccaggatcgatcgagaagatgaatcaggcaggtgttggttggttgattcggcctctctcaatcccccctccccaccgcaccgaaaatatctcctctcttctcactctcccaaccacacgcggagcaatgggcttggcgttcgtcggagcgagctcgccaaggagagcgcactagcgaggagggagaaagtggagaagaggagagagagagagagagagagagagcgacagaggaggaagaaagggttgcgcttgcgcaccatggcatgtgggccatgtgtgtaagcgcgtcgcgtccgtgggccggaggtatagtggcgatgaaaatagatggaccggatgttgtgggccatggcccagtaagtgcttcttcttcctccgtagtaagtttactttaggtccctcaatttgtcgtcgagtctggaattcatccctgaacaacaataccagatatgacgtgtccctcaactctcaaaaccagtgcaaataagatcctaatctgtttagatgacgattttaactgatgtgatgtatacgtagcgttaacaaagtcacagaaaaccatgaaacccgcttgggcttcatcgtgccggagtactttggagttctggtgctcgagatcgtcaccgacgaacgagctctctgcatgttccaggagatgtttaagctgccgtcgattgaattgatatatcagagcaatactccctccgtcccataatataagggattttgagtttttactcgtactgtttgaccactcgtcttattcaaaaaatttgtgcaaatataaaaaatgaaaagttgtgcttaaaatactttggataataaagtaagtcaaaaaaataaataacaatttcactttttttagtaagacgaatggtcaaacagtgcaagaaaaacttaaaatcccttatattatgagacggagagagtatatccgaagcacagttaaccatcaaatcaatgaacagttagatgtaatatatgatgctctgaattggttagctatgcttcggatatgttgctctgaattgatatttgctcgtcgactggggtggaggttgcttaacgccgtcgacaatggcgtttcttcttcttctatactagtaccgaagaatttgatgcaaatgatgccactaggttactgtttgcttgggctggtgtgcagcaatcctaacccgtcggactggccgagcatgacagaggtggtgcaggtgatctcccggtcggcggcgctgcagccggatatgccgctcgtgaagctgatgttcgtgtggtcgccgaaaggaggatgtgttgataggactacccttgtccgctgctgatgcaggagttcttgccgaggccgatgatgtggaaagaagagggaaaatgacgggacatcctatgttttttctaactttgtcgacaccacttagacgccacgttagccgaaaacgctttgaggtgttctagttttggaagttgagggatgcgaccaggggcggagctacattgaaaagagggggtgcccagaaacccggtcaagaaattttttagttatatttcatctattttcaccgtatatgcgccctcttcaacccaaactcaaacactcatatcagcttaaactcgacctaaagcagagtaaagcaagcagtgccaccccctccccatttcgttctagctccacccttggatacgacggtttaggaattaattttgaactcggtgacaaattacgacacctaaagtggagaaacacctaggtattccagctagctccacaaggtggtgggctagacaacctgggttcgaaacctcaccccttctatttatttgatattagatccttccataacattcacgtgttttacgacacctaagggtgtgtttagggtgtgtttagttcacgccaaaattagaagtttggtttgaaacgatgtgacggaaaagttggaaagtttatatgtgtaggaaagttttgatgtgatggaaaagttggaagtttgaagaaaaagtttagaactaaactcggccttagtttacgccaaaattagaagtttggttaaaattggaacgatgtgatggaaaaattggaaatttgtgtgtgtaggaaagttttgatgtgatggaaaaattggatgtttgaagaaatagtttgaaactaagggcctgttcactttgatgctaaaaaaaccttacacatttcaaaattttggtatagttgccatttgccaaagttttggcaggatttcttatatagttaccaaaatttggtagcaaactaaatgtagttattttttttagtaattttactaaaatttggtaagattgaaaatagcatcaaactgaacaggcgctaaactcggctcaacaggagccataacaggagccatgccggcgccgtgattccacagtctgcgtgaccgcatcgtacatcgacggacgtgtgctcctgtggccgcttcgatcctcacaatcacaaggggaggaggtacaagcctacaaggtggccaggccacgcatcgtggattacatagagattcgtcctgtggctagttaattactgtactatagttcaatgcgtgtcatttgtgaacagttaactgttctttcggttctaactttatctggcaggagtacatgacaaatgcaccttcttaacttcactgtttcatatttgattacctccgatagcaaaaagtgggaggtcattacagttcatactcaaagagtgggtgggtaaaactactagtattagattctctgcaatctttggtaaaagcttgtttgttctgtacttgagtgtctttatgaacatcataaacttaaagacacatcataaactttccatgtaactacgaaagcaggaaaaataacagtgctattttttttttgaattgaactgtgctgctgctttaatcacggtgtcatcattactctgataagatcaatatcttgtctctgctaagatcatgatcttttccagcattgtatcaattccttgtatgctgcattgcttaacttagaagtaaatatttgtttgttaatttatttgctgtgccctttctgatagagtattcctatagacctaatttagtgtcatgaaccagcacaatatgattactccttttctaatggaatcctattttgtagattgctgtcccggacaaaagcctcccattatcaatttctgggcactttagcaagtatacatatatttcaaatagtgactttaccaagtatttgagttagcactttaagaatctcttcaaacaaaagggcaaaccattgataattcattctgttacctttaatttcccctccttttttcttttgcagcttgctaggaagattttgtgggctccctaacccacttagcaagaagcaatctttacataatcttccatctctttataatgattttcttctggtttaaaatttatgcatctaagtgctgtgtttattacaaatttgaagctaaggtggcctgcctccactttaaaaggattcagtagctactgttttctctctttcttttttcgctttggtaccaataaaacggcctccttagaccatgaccagtccaacacatacacagctccaagaagctacaaccgtcgttggatcctgaaaatgctttaagattcaccattctttccattcctgcaccaaagctaggagagcaactaaagcattgggatgcatggcaagtagcacacatagaaaattgtgaggaaagaggctattgaaacttggtgcacttccttttaagttttgaatgctcccccatctttggtggccttagcttggaagaagattcaaagagaaaagtgtgtttcaaccaagaacaacaaacaacaacaaaaaaaaagatagaaaagcaaaaaagcctcacttgtttcactcaccactgtgcctgctgctttagtgttgggggttttactgcagacagtggccaagaaggggaagataacaacaacaaggagctaaagcaagtctttgtttctagcatactgttgctcctcctatcccctacaaatctacaattgcaactttaggttttgtctgttgggagataagtaccccccccaattcatgactttgccaaaatctgcctccctcaaactttcaggttttcagaaccttccattgacagccttaggcatgctatgctaatatgctgtgcttggcttcacttgtccctatgtgcttttggactcgacactgcctgcccctgctatatctagagacaagacatcaccatgattgatcattgtacaaaccattctagctacagagagagccaaggtagagacttgtttgtctccatctgagcagcagcagcagaagccaacatggtgcagcacacaagccgtctcgaccttttcttggtctgcaccgtcgtcgtcgtggttgtggagatgcaccacgccacggcggtgcacggcctgacgagagccgagctcgtcctggctccggctccggctatggcgccggcgccggcgcctccggccaacaatgtcgtcggcgtcgacgcggcgaaggagcggttcgcggcgacgacggccgcggcgcagacgagcaagtggcgagtccggcgaggctccgacccgatacacaaccggagctgatgatgatcatcatcatcagaacaaaatgcaacttcttcggcagctgaaggtgttggtttttgtggatttggtagagacaaaacttttgtgtccagagatgatgagaagaagaagaagaagctcatgaggattctggacaagattaatagattatgtgctcctccggtttaggagatgatgagaaggtggacaagatgatgacgggtttagtttctttgcgtagccagcttaggacagaagcagcagagggttggttcagtgtaatactgtaatgtaggccattcagtttgactgtaatatagcaaattcctcatcagaggctaagaacaacttaggatggattcttattccccttgcacattcattacagctaggtttcctgaacacattattgttaatcagctttgcttggttgttcattgagaaaactaatcctgcctagtccttggcctgaacactaaagcaggggctattctgaagccgaatcctgtgtgtgggcggtgtgtttgtcagcttctgaatacccaaagctcctagttctgcttgttgcttttctagccatatttcgagttgacgaactttcttggaatcagggcgaattgttcgtgactataataggattgttgtgagcaacaagtcatcatcatccgtgatacttcattgccagaagaaaaggaaaaaacaaacagagagcatctaatgaaattccgtgaaaatcttaatttgtttcggtgcaagtctctcatattttctctggactgtaagcactttattttctccctctaataaaattccggcagatctcctgccgtcgttctcctcaaaaaaaaaagaaaaaaaaagaagtgaacatgttatataggttccattatacacaggtcattttagattttctttaagccacactacaatgcactatactggtattacaaattaatctaatccgttgatcatatctattatattattaaaggaatagaaaaatgagcctccacgttcgctctcatggcttataaattctcacattaatcggagaaaaaaaaagcagagtccatgtagaaatacaatttagaaatagctgaaatttggaattaaaaaaataaggaatattagaaaaggagactagagtccatatagaaatacaatttagaaatagttgaaattcggaattaaaaaataaggaatattagaagaggagactagagtccatatagaaatacaattaggaaataactgaaattcggaattaaaaacaaggaatattagaagtagagtatagagtccatatagaaatacaattaagaaaaacatataaattcggaattaaaaatatatattagaagttgagtatagagtccatattgaaatttaaaactaactaaaatttggaataaacataataaaattaaaagtagattttagagtccgtataaacatataatttacaaataactaaaattctaaattaagaaaaatattggaagaatagtttaaagtcaatataggaatacaatttagaagtaactgaaattcgaaattaaaaattaaagaatgttgaaagatgagtttagagtccacataagaatacaattagaaaaaataaaaattcaaaaataaaaataaataatattggaagaagagcatagagtctatatagaaatacaatttacagaaaattcagaattaaaaaaaaagaaatattaaaagacgagtctagagtccatataggaatatatataatttacaaataactaaaatttgatattaaaagtaattaataactaacatgtatataaaatataatatgaatattacacattagtagttttgtaaagttattgcaaaatttaaaattatgttatcattttaatatatttgaataatataatgagaaaacatatatactattatatgagagaaaatataatgatactagccgcgcaatctgcgcgagccactatgctagttctacaaaagggatcaaatcttattataccaccacctcaattaacaacaataaaaacataagagggtataatagtccacattaatacagatgtgtggaggggtaaatttgtacttttgaaatataagttggaaaccacataaggaggtcatgcgctatgtcacatagaacgtggaacttaagtgtgttcctcgttccggattgagaagcgggaactatgtggaatttttgtcccgaaaatggatggaacttgtcatcctagtacaaggtatgatggagtaacaatagagcggtctgataaagaaatacaacacgatggagcgaatgatggaaagacaatccaaatcaagcaaaatctataatttgattaactttcactaaatttgaactcatctggatgggacaagcgctgttgttgctccctcactgctcgccaatatcatgttgtgtatgtacgggcgtcagcaccatcatgcagtggagactggacaagcattgctcttgtcgcgctgtgcgatgaccatgaagagatagaggggcattccaaataacttaggaacacgttccaactaacgttccatattttaggaggaggtatacctcgtcgttttatttttttagaaaataatgtcctgcattccagtttctcaatccatccatccattaacttttgtgacttaggtcatgcgctggccagggctggtgcaccttgagactagggcaagaaaccttgtcaattcaaggatttaagcgccaatcaacattacagtgttttgagcaccattctaatgggcactctgaactgcgcaaatgactattctgaactgaaatacttgggtacgatcctttggagaaattcagcactgttaacgacttaattaagaacagaacacagcatgtggagaaactaatcaaatatatgtgttttaaagataatcatggggagtgtctaacattaattacttgtgttcttgctgctcgatgttgactatatatattgatttgttcagtatagtaatagcttgcctgattttgtctgttcgacggaggagagagggcactgccgctggagttgagcgcacgcgggaacgaaaggaccagtgactggtcactataaagaaaagaactttattggtagtatattatgagagctaaaatagtactccatccgtccctaaatatttgacattgttgatttttttaaaatatgtttaaccattcatattatcaacaacttttgtaaaatatgtaaaactatatgtatacataaaagtatatatttaacaatgaatcaaatgatagaaaaagaattaataattacttaattttttaataagacgaacggttaaacatatttaaaaaaagtcaacgacgtcaaatatcaggaacaaagagagtaatttattaatataatgattagaagttactttatcttttatttttttcaactaaatccatctgtaatcatatcatctattacgccggcatcactcatttttcatcaaaaagccaaaaaagaggaaaaaaagtttagtcattgctaaataacaagtatatatatccctccacacttattttttttgacaataatgtatctccatatttctactaccgctaactggggtggtagtataaatagatcggaatccttcgataaaataaaattaacacttcagattgttttcggctactagtagaaagcaccgtagcgaggctcgaaaagaaaaaaataatgttgcaattatctctaactatatattaatagaatatattacgtgcccttatagggcctgttcggcaggccgatagctgcagccgtggctgcggctgcgcacagtgagtgcggcactgttcgtgccggctgcggcgcagctgcagcccgggcagccgaacatgcccataaattaatggtttatatagtagtattctactagcggtagaatactacgggtgattctaattttatatagaaatgtatccagccaaatttcaaacgtactattccatccttaaaaaatgaattcctagccacgaactcgaacatatatgtttctaaattcgtaggtaggattaatatttttttagacagaggggtacatacattacgtgtaagctgacataatgcacgcatcatgatcacgttggttttcatcacaggggagccgcccgtatgtcggttacatctcccgttctgctgggattaaaatagcatggacactccgcccacatgttcccaccgtcattgcgacgtggacactttccatgagctttatttgttatggttctctatataatattctactattaatagtagaagaaatagtttgaacgataattatttttcttactactcatcccatttatttttgtgaagtatatcgatttatttggactgtttagaaagtacccgttgatatcttattttatcgctacaatttgggaagtatcgattggctattttggtcccaaattttgaagtacccaattctatatatttgtattattgaagattatatataccctctaatatttataccttcaattaattaattgagacgatagtataaataaatgttgccccttacatagaatcaaatcaacagtttatattgatctctaccaccttcattttaaaatatagctatatgtctagtatagtattttgtcttaaaataatagggtgaatagctaattcagtccctcgggtttcaccgaaggctcaatttgatcctttaggtttcgttttgtccatataggtcctctaagtatttgttttggattaaaatcatccttttacccacttgatgtgccatatggctatttttagtcaacatttttattagaaaatgtccctttcgcctttaatttgtatactacactataaaagagaaaaacaagatgaataaacaatattgcagatgtaatttctattattttaatatgtgcacatgaaacttaagcctaatggctatctatacaattgaaagtacataatttatttttgttttacataagtactatgcattatctataaaaaaaatcattgcatgcaattttttctagtgaatgaaggagtataagcgttatttattaagagttgttcgttatgtttagtcatgtggcttctaagtgggtttaaggataagtttaaactaaaataaaaacttgaagaactaatatggacaaattgaaacattaaggactaaactgagcctagaataaaacttggaggatcactttagctgttcacccaaaataatactatttctttacaagcattctccatttaaattattcatctatttttatcttgtcaatcaatcacaacatttctccaataatgggtacgagctagttcacctgcgcgg

SEQ ID NO: 10118 - DNA, 2935 bp, Oryza sativa
tgtgatgtccactctgttcccagatgggccaagttgaccaccgtgccgacgaggcgaccaccacgacacggcggccggagagcagtggagcaaccgtcgtcgtctctattgcccttgtcggaagggagaagatggatccatggatgactaattagcagtgtttttttcggttcgtgggcaaaaaggagtgttactttgtgtccctttctctcgattaattgaagaatagaaacagttcacgaataaatcattgtaacaaactcccttcgttcataaatataaatagacgaacacggttatttttccttttcttttaataactaaaataaatttgggcaaccacacacatccacgagtccatgatcttagttacatgtgcacaacattattaagcttacttatgctcgagagctttcgtaattcagactgatgtatcgtgttgtgagaacagtatacacgattatataagtactccactgtaactcgttctccacgcacgcacgcgcacgcgcatccaatcaaactaacctatgaaataataataataataataataataataataataataataataataataataataataataataataataataataataataataataataataataaataatgcaatatttgttatgtcagcatattgtggcactacatgatactcgcgctccaacgggccaacagaaggtacaagcaaatgcatcaaccatttaattcatggctactgatcgatcataattaatttagacacatgccgcatatatatatcagcctaattaaagattcattcatacagtgacagtgattaaaggttcgcaaaattttgatgcctatatggagctttggcgccttaaatgcaaaactgttgcatatccaggctaacggtaatgggaattaatgagagcgaaagatgacgatctagctagctaattaagctgctcatatatatctgtgctccacgatactccacgtcacactccaacaacaaaatgtgtgttagcctagtcgttcaatggtccaaattaagttatgcatttgaaacgtggtaggtgtacaaaaatatatatccatgactccatgtaatttagtatgatatacttcctccgtcccataaaaaatcaacctagtactgatataacacattttaatactataaatctagccatacatttttatagaatggaggcaaaggcagcagttgccaacccagttcagatctgaattatattgtggcagccaggcaacaagaaccgtacatgtacaggcatgtgtcatatctttgttaaaagctactctctctctctctccgtcccagaatatagcaatctataatgggataagactcatactagtagacgcccaacaacggcggcataataggccagccgtgcaggcggaaacaccagtcggcggcggtcgaggcggccggtcggtgaaaatgtagacgcccaacaacggcggcataataggccagccgtgcaggcagaaacaccagtcggcggcggcgaaggcaagccggtcgatgaagacgtagacgcccaacaacggcggcataataggccagccgtgcaggcggaaacaccagtcggcggtggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatactcagcaccttgcgttactcggtccatccaacgagtccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgaggtagcgaggcaaaggaaaaagcaaaatatcatataaagaataaaataaatgatgacttagctttgtcgtattccctcgatgacagcaaaagtagccgatgtgggaacgaagcagtccatcaatggtgacaaaaacaccagtcggcgccagtggaaccaagccagtggtgtagatgatgaagcccattaacagcggcgaagtccgccaaccgtataggcaaaaacaccagtcggcggcggcgaaggccagccggtcggcgaagacgtggacgcccatgaacggtggtgtgaccaaccaaccgtataggcgaggacaccagtcggcggcgatggaggcaggcccggcggtgaaatcgtagacgcccaacatcggcggcataataggctagccgtgtaggcggaggcaccagtcggcggcgacggaggcaggccggcggtgaagtcgtagacgcccaacagcggcggcataataggccagccgtgtaggcggaggcaccactcggcggcaacagaggcaggccggcggtgaagccgttgacgcccaacagcagcggcataataggccagccgtgtaggcggaggcaccactcggcggcgacggaggcaggccggcggtgaagtcgtagacgccta

SEQ ID NO: 10119 - DNA, 6299 bp, Oryza sativa
  unsure (1)..(6299): unsure at all n locations
gggcatatagggccagccgtgtagncgaaggcaccactcggcggcgacgaaagcagccgccgggtaaagtcgttgtgttatcagcaatggcggtggcgaagacaagcgggcaaagtggactcgcggccgatcgaccgaaaagttgagacgcctcgactccatgaccagcattaatcgcctcaatagtgccgcgtaattatatgcgaacaacaacaaaaaataacaagagattaatctgagattaaaaatcaatatgataaataatgataaaactaggcgtccggcgctggacgagtagttagcatgagtagatataaaaaaattgctcaatggaaaatatcacataaagaggaaaaataaaggcacttagcttttttctcagtgtcctccgtatatatgtgttaatgggtggacaggagatcatatcggcagcttgtgacaaacatgcaatacatgcatgagtgctgcacttccctgcgtgaaaattgctcctattgattggctcagattccacgtcgactccaatttagattagtaattgaatatcgccaggagatttgacatcatcagatgatggactcggcatgtcaaacgatcaagttgacgactgacgtcccgtcggaatttccggcggcggcgatgcaagccgaactccagaagaaaagaaccggtccgaagatgaaggcggtgctgacggcagccataggagattgaatctgaaacttgccgcggtagattgttgtaatccctcgattgagtttccccctgactgatttggatcaagtcagagaagaggagcttgaagaagtggtcgacggaaaggaagtgaaaactcccgaagcgaaaacgaagtcggcgactcatgaagttaattccatcgcgctcgttgataggaaactcgacgcaacccctacctggcgcgccaactgtcgaaacatgaattcggcaataataaaagggggtagcgcacgagacctaaaagtggatggatgtggagacaaaggatttagacaggttcaggccctctcaatgagaggtaatatatttttttagattgtcctaggatgtgtctcatcccattagttgctatattctggtaccgagggagtaatagcatatattgcccgtggaccgcgagttgcaacacattttttaaacttagcattatcattaatttatttttcattactttttatacatcgtattacttagtcgtacctttcggttgacacgtagatcgtttaacccacacttttgttttcttataaaacaatggagagttagtggtgccagacttatctccagctcattttcaccgtttgcttaaagaaagtacaactaattaagagtgtttagattttttttattatttccattatctaaaaaaagaaaattttaagttcagtcatttattttatcccattttatttatttataaacaaagtcacatctttagataaaagggttgaatataataaattatcctaacatacgcaaatatgcaaaagtacataaaatagataataaaataaaataaaatcttatataataacacaattaaatataaattgaactaaaatcgtgcattgcttaaaatctagcagaccctaacttctatatatgtttaagaattgctcgaacttttttcactatgtatactctatgatcaaggtttctgtcgatctagctatctagtggttgatcagcagacaattaatcaataatccctttaatggcaaaacgggatcgacgaatcgtcgccgtcggcgagacgatggcgatccatgggaggcatggtttcctggagagtggaacggaaaaattcgtacgtctgctcgatcgatcggttaggtaacgatcggtcgatgatgtaattaagttactagcttaattgcgacgagaccgatcgatcgagctcgtggctttgggatctactatatagtgagtgatacccaatgtaagtacgcctctctttaattcattattaattcgtcgtccgtggtaaatgacaaaaagtaaaatttaaatagccggccggcaggtgaattaaaagaatgatagatgatgatccatatgaaacgtgaacattaggatcgattgagtaccagcaatttaaaaggtacccccaatatatggtacattagctcccttcaatttaaaacgtgaacattagctccctccaaacataatttcatttctacccaataaaagtataaaacatataccaatataaaattcaaaagatactataatacacttgggagaaaactcccgatcggttgaccgatggaccggtccatccaactgctcttttcactccatccttatatacatacatgtattaatttttaaaataacttttttttcataaactactaatctaaatctttacaaccagatatcatatgattatattctgataaaagaaaaatatatgtttcaagccgttaacattagttgtttcatatgtgatagagatatgtttcaacatgtgtaccttatttcataaaatatttaaatgtttctgttttttttttcaccatgtataacttgatgtttcactttttgctcaactgaaacatttggccacctgatttttttaggtatcgatcatccgatgcgtagttttctccctacactttacttgtattaaatcctaatattgtttctaactttaacagatctaatgaattttgtctctaaatttatcagttctcaacgtatttgtcctaaatttatcaaatcttaatgcattgattatttaaaaataaagtttctttaagacaaatggatagagaaaagataaaattgttttgggaccaaataaattctttatgtaaagcaaagtgagcatggctcaactagttaggttcgttgtggtggaaccaaactacctggtagtagacgacctacccgatgctcggttaattattctttaagtggtagacgagtacccggcgcctggctaactaaggcaaatgtggtgacttcgatataccggtccagcttttcaaaggtgcttataggtgtgcgtgttcatagggataattgctcgtgtcatgagcacttgtgtttttatgtttataataaaaatacttatataaaagatcagatgagcttaagttaatgtcacgccccggactagtaccgaccggaactagcccgtgacgctccaaattaccctgttaatcgataccagtcccaggaaacagtgctggtatcacaggaagacagattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcggcgggatccgcttcatcttcttcagcaactgggggggaaattatttatatagagcaagggtgagtacgggagtactcagcaagccatgggaaataagtgtttaatgcaggcttcaaggaaagactgttgtttttgcaattgattttatttaaactcttctctaaaaacaactaagtgagtgcttctcaaacgacacggatgagacagtgtgtctcgtccggtcggagtttgtgcaatgtatcagtcttttgaaatgattcaaggttggcacccggccaacagcttttcaaacggccacccgggccaacaactttcaaacggccacctgggcctagctgatcccatcagctgcagatttttcaatcatcgaacccctttccacaacagcaatttcacaagcagtagtcaaacaaaactacgctaggaatcacctcacatccacccatgaccgtgggcacggctgttcgaacagtttgttaacctctgcagagggggtacactttacccacacgacattactaacccggatcacccagctcgtggggatcagccacgtcgggagacctccaagctttcatgacaaggcatttccaaagccgacacaggtttaccatatgccaacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcagatgaaattccaaggaaacggtccttaggtgcaagagcgggaaaaccgtacacccagtacgtttcccggtccgcggttttggaaatccatttagttcgcaagcaccgacccaggtgtcgggttttccaagtcttttgtataacccaagttttacccaagaagtttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgtagacgggacaacagattaagtgcgatcctatcaatgcataatatttttcaagcaacataattaaatttcaagtataggctcaagatgttcaaaggtggcttgccttgctcgagatctggagcttgatcctcgaaatcctcgcactgcgggtcttcgggctctgaaactacacgcgaaacgggacaactcaacaaacggcaaaaataaagccttattaatgacctctaagcgtgccattagatagatctcgagatttgaggaattttggaagttgaacggagtcaaacggatttacggttgggaagatattaaatttctaagattattggatttttggtctaaaggaaaaggatttaattaaatcctttttggaaaagaaaagaaaagaaaagaaaagagggagggaatatagacttttcctcggcggctagggcgcggcccgagagaaatggggcggtccggccgagctaaatgggccggccggcccaaggcggcccaaggcgcgcgcgcgggaggggaggagagagagagagtcggtggaccgggctcaccacgcgtggtcccgggtgggacccgcttgtcggtgacacggttcaccgtgcggagcgagcacgcggcgcacgcgcgcgggcgggggaggaacncggtgcacgcgcgcggttcgcggtggaacggatgcggcggccccacgtgcagcctcacggctcgcggtggaacgcgcgcacgggaggggctgacaggggtcggcccgacccgatctcggccgagctggcgccgacgtggcgcctccgtggcgcctacgtggctgccacgcggtctggcggaaggtagacgacgatgccggccggaacggacggcggacgacagcggcgagcggcggagcgatccacggcgatacaggtgaaagcgagcacaccgggtggttgcacaggacgaggggagacgagccaacggctcggattcaccggaggatgcccgacggcggcgaattgcggcggcggcaaccggcggcgggagaagggggaaacggcgacgaggtctcgaggggccgattcccggcggtgagagcatctacgcggctacgggaatccgttgctagcgtcggattgagcggagctacgccgagcaaggccggcgacgagcgggtgctacggagcacgggcggcgacggcggcgagcacactgcgagcggcagcaacggtcggggcggcgccggctagctacggggaggctactcgagctactaccgaaaactaagggggggagatggagcggggaggaagaacggagggaggcactaccgagatgaggaggggcgctgtgacgagaggctgacggcgcggaagtaatctctccggcctcgggccggggaagagacgagaggccgacggcgcgggagtaatctctccggcctcgggccggggaagagggaggagacgagcgcccggagtccccttccgcgtccacgaacgcaccggctctcccggcgcttggcgatgaacggcggaggcgagacagagctcggaaggcggcggcaacannnnnnnnnnnnnnnnnnnnnnnnnnnnnnnnnnnatatgagattatccaaaacacgctgnngggaanagggtganaagagaacaagaacaatagtgatntcgcttacattcaattcgtaaacaatcatataagaccacgtaanaatatatatatgccataaccacccggtatctagtaggatgaagacggggag

SEQ ID NO: 10120 - DNA, 1998 bp, Oryza sativa
  unsure (1)..(1998): unsure at all n locations
gagcccattggattcactggacctttanaacctgacataccctggnaaagncgaattgcagaagaggaagcaacagaggtgaatgaggcaaggagtcaggtagttccgatagttggaaatcatgttgatgatgataatgaaatggcagatggatcaatggggggaggtggagaaaagcgtacaacggatgctcaattagcatccttggtgcggttctgttttcgagacaaaatatatactcggagggagtgtgaggagactttgttgatgaatggattgagtgttgatttgttgcaccaacattcaaaggagtatgatgacacacatgaagaggagggatatgaagtttagtatgccgtaaactcagatgacgatcatctagtagccaaaatgtctcaagaagaaagggaggtgtttgagaaattagttggaccccattcagacgttgttcacttcgaggatgttagcgattatgagctaccagctgttgatggaggagttacatacaatggcatcatcgatgcaatgggtgaagacccaaaaaatggtttggaatttaaatctcttgagctattacagatattgctgcagagttactcgatcagggtgcatccgtccattccatgtgaagcactccaacgcttctaaaaagtacacggtggcttgcatcgaagaatcatgcgaatggcaggttcgtgcatggaagactaatgatgggaggtggagagttaccggtgtaggcaaagagcacacatgttgtagtgctgaggcttctggcaatcacttgcaactaacttctaagttcatcggtaataggttgcaaccatttgtccgagctgagccgacattgactcatgttgctatagttgaggctgtggaggccatatggcactatcgtccttcgtacggtaaagcttggcgtgcaaagcaggtggccatgaagaacatatggggagattgggatgaggcatatgttcggctcccaacgcttctaaatgctattaaggctaagaaccccacaatgcattatgttgttgagcctcacccagagaggtcgaggccagtggatggggtaatgagacgtgtatttgggcgtgccgcatggatctttcggccggcatggactctagctggcatagctacagatcccgaggatgttgaggagatgaacgagtatgacacccacactcgagcaagagcgacggtcaagtacgggcctatacgtgaccgagtggtgagtattaaggctcagagttgttcatttcacattacacctacatgttctcacaatattaaatccacttgcagacacgtgagctgatgaggtccgtgaacgacgtgggtgttgcccttggcacacccgctgggtcagagaatgaagttgggatacttcggagcgcacttcaagtaattaaccaattagttcaatccatgaatcatttcacttgcctctaactaatttgttttgttcttgcagaggctaaaacaacgaagtcggatgttagcggcaagacttggttgtaggtccacagacgcagttgacccacaaccaagactaatgtggacacaggccggagaaacaagtcaacaaagagctgaagaggaaggggaggaagaatatgatgaaagggaaagagaagatggacagagtgacgaataggaagaggaacaacccgaagaaatcgggtcatctcagcttgcaggtgccccgcagccatcgcaaccttcccagggtcgcccgcaaagaaagagggccccggtggaccggtacacacctttcactagtgcccgaagaggtcggcactagtggattactttgtacttaacactctaggcagcgttagacttatatccaactctagatcatggttgatggatgtccctgaactctatattttgtgatgggtgatggatgtgaataactcctaatacaatgatggtttgagggatgttcttgttgctttgaagtggtaaatattgggtggctggcaaattttg

SEQ ID NO: 10121 - DNA, 1494 bp, Oryza sativa
  unsure (1)..(1494): unsure at all n locations
tggcaaccccagttccagtatgtttggcgcgaaatttaagccccccccccccaacgtcaccaaacggcggtcaccgaagaaacgggccgtccggtactcagccccaatccggtcggcgctagggtgttcaagttaagcgccatcgaccctggcgttaaggtcggggtccagatctggtgatagtttttgccagggaccaaatttacaaatagttttcaaaaagggtcaaattgtcaaattttcgggactaatttgtagctgcacgctacacaggttcccacgcgctataatcggcatgcaactagtactagcgatagaaaacactttcagcgggccggtgtcacgcccagaaatttccgaatagaatttcaagcagaatgtgcattaaattccccgtccaggaccagccggggtacacaagcgacaatgttgacattcagatccacgtcttacaaacatcataaaagtttacacaaatgcagcagaagagaagaaaggcaacaggagctaagccttgactaaaactgcagcgggaacaccactccacaggcatccttgacggcacggacgaagcctactcctcggagaaaccttcatctgacacaacctcgaactctggggttgggaaaagtagagcaagactgagtactacccactgtactcagcaagtcataccggaatagggatatgatgcaaggaattatcaaagaagagctagagtggttcatttgcataaagcgagcatttataaacagaagttgaaagattaaacagttgtaataattaattaatattaactatccactgtccaacgctgacccacgttgcgacaggcccaaccatccacctaaactatccaatttcaaaagattacactagggtgagactaatcacggtgaatctggttgaccgcccataaccgcgggcacggctattcgaataattttactctgatcagaggtgtacaactgtacccacaagacacagccccacgacacgtttccgtgcgccgacatgccaccacgacatatcggaaagaggccgtgacaggacccttcacataaccccctctagccaagcacaccacacctcaggtttcacccccgtccccagagggcaacgggcagtcccctctcgtgcctaggtgaatccggaagcgacagaggccgtcgcagggcccgccccgctccatcacgcccacccttgcctggatgcgtcgactagaggagagctacactacaggcccagccgttgcccacgctggcttgtggtaagtacgataagttcttccagggcatcccgcgaaccggtccttaactgtcatgggtgcgtccagcaaaccatgcacccacagcccaccatgtgatttattttaattaaccaacaccaaagcggtgtcactaatccaacaaaaccattagaaccaatagtctaaacattnnnnnnnnnnnnnnnnnnnnnnnnnnnnnnnnnnnnnnagaatntatatccacc

SEQ ID NO: 10122 - DNA, 951 bp, Oryza sativa
  unsure (1)..(951): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaatcttaacccgtcggactggccgagcatgacagaagtggtgcaggtgatctcccggtcggcggcgctccagccggatatgccgctcgtgaagctgatgttcgtgtggtcgccgaaaggaggatgtgttgataggactacccttgtccgctgctgatgcaggagttcttgccgaggccgatgatgtggaaagaagagggaaaatgacgggacatcctatgttttttctaactttgtcgacaccacttagacgccacgttagccgaaaacgctttgaggtgttctagttttggaagttgagggatgcgaccaggggcggagctacattgaaaagagggggtgcccagaaacccggtcaagaaattttttagttatatttcatctattttcaccgtatatgcgccctcttcaacccaaactcaaacactcatatcagcttaaactcgacctaaagcagagtaaagcaagcagtgccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 10123 - DNA, 1147 bp, Oryza sativa
  unsure (1)..(1147): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcgagacaaaatatatactcggagggagtgtgaggagactttgttgatgaatggattgagtgttgatttgttgcaccaacattcaaaggagtatgatgacacacatgaggaggagggatatgaggttgagtatgccgtagactcagatgacgatcatctagtagccaagatgtctcaggaagaaagggaggtgtttgagaaattagttggacgcaatccagaggttgttcagttcgaggatgttagcgattatgagctagcagttgttgatggaggagtaacatacaatggcatcatcgatgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10124 - DNA, 735 bp, Oryza sativa
  unsure (1)..(735): unsure at all n locations
cgcgtttgtttatataannnnnnnnnnnnnnnnnnnnnnnnnnnnnnnnnnnnnnnnnnatttgcacacaaaatatattgtgggactcacatgtcatcctttctctctccaacccttattcctcccccctctccctcccttctctctcttttctcctgcagccgcactcgctgaacatgccggtgcagttgaacccgtgcgccacctcgccggtgccgaacaccgtgatgagcccgatgaaccctttgtccagccgttccttgacgcagtagtcgatggcctcctgcagcccggcgccccttacttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10125 - DNA, 732 bp, Oryza sativa
  unsure (1)..(732): unsure at all n locations
gtggcccttttgtatttcgactcggtacccctaacgacgtcaggatgcatagttaagagggtttgagggagttctgtgctttgagattgtgacgggacacgtgttgcacaagggattaagtcttttgcaggagcgtaagacttcagtcttaccaaattttcttcccagtctgtgacacacaaaagctttccaacgccaagcttgccaaggcacttgcattttgtttgttctatgtgtagatcctgaggaggctgacttgctcggacctggccgagggagcacattgggaggtggtgctcatggcgctctccgcggcagcaacggcactgctcgtgctcgcagctgcagcagcgatcgatgaccactactcagcgaggcacctcacgtcgtcgtccaattcaaacaaatcagaggctgacttcgactagatttacgccaaaaaggaaaccgcgagttgttctccgaattgatagggatcgggcatgacctccacggaccgattgagaaatccaagaatcaatcgcgaaggttgagcggagtggagaggagccacagaccaggtgaccacggaagaggaaagcatgatcggcggccgaacgtcgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10126 - DNA, 949 bp, Oryza sativa
  unsure (1)..(949): unsure at all n locations
cgcgccatgaatgacatttcgtaccctacnacaaatgaacccaacactatttacatgatgttcggggacatccccactccctgtcagcatgtagaaaatagatgggagagaattcatatagacatctatacacagaatctgcaatgcgaaactgctgataatggcagcttcaaacaagcaagcagcagcgttaattctcaggctttggaagccgcctcctgccaccgttgagggcccgtatcagctgcaggtgctcatcgctggacacgtggagctgcagccggagctgcgtcagcagctcctccttctcccacgtcagcgcgccggtggcgtggaacaccctcatcagcgcgccgtacgcgtccacctccaggcggtggatttgctcgcctaccgccgccgccgccgccgccagcggcggcggaggttgctcgttggccaggcgccgctgcattattggcgcaacggccggtcgcggcttcattgcggtggcggcgcgcgacttcgtcctgacgtcgtcgtcgtcggcgcgctcttctttgatgtgtggttggcattgcggctgcaatggcggcggcggcggctggttcgccgccacttgggcgtcccccggtgggctcctcggcgcggcgcggtcgccgttgtcgctctcgctgctgctgccgtcgctgctgctctcgctgttgctgctgctgccgctgccggccgacgagacggacttggcgtcgtcgtcggtctcctcgtcgctcatctcctgctgcttgttgacgaacacggcggtgggtggtggttcgttcgcgcgcaccacctacacgttgccgtatcctacgagcagctccccctccttttttttcatggcgcggatccgctttgagttggcctcgacccttcggacctcgccgggcggggtcggggtcgctccgtggccgcctcctcttgatcttgcccn

SEQ ID NO: 10127 - DNA, 1723 bp, Oryza sativa
  unsure (1)..(1723): unsure at all n locations
cgcgaccattagatatactttnnnnnnnnnnnnnnnnnnnnnnnnnnnnnnnnnnnnaactagcaaaattcccgtgcattgtaatggttattgtaatgggtgaagaaaattgtttcaatgagcatggtggctacgatagcgcaaatttcttgggagtatacattgtatattttgtaatattcatagtgtaggtggaattagagctaaaaatggttaagagcatgtccattcgataatcctctccagtctataataaaaatgtcatccgtatggtcaatatgataagcgtaacgttggggagagcagccaaccagccacgcctcgctctcgactcttgtggctcatgtagtaacggagctcgaagatcgggtcgcgggtcgatttacatggatgattataagaaaactattaataccactttaaaataaaattatttatcatagactaaagtttgaaaccatatatagtatttaattttatcatgtattattatgagtcggttgtaatgcatggttatttttttaattgatattaataaacagttttttcatatcgtaaagagtagccatagtagaagaaatgtttttcgctagctatcacagcaagctcactgcactcaaatagcagaatcgctttcactaaaaaaaatcagaagtaaattgtatgatgaatagaaaaaaaaggtgatcaggttaggtgtcctacgacaaatgagaaattgacgaggaaaacaatcttgatgcaaacacaattcgttttgttgatgattgtatttttctttaaaaaagaaaagcatgcttgttttattttttgaaaaagtaattcattttgtcggtgaatagcgtctacttttatctgatccctgtatgtgacctcctatttaagctttagtctataataaaaatgtcatctatgttgagtaaaccatttcgcatgcatgtataagacccaacacgtgtatacagtatacgtgtagagtttgactggtcgtgtgatgtgtggacaatatatagcgtgcggactctaatataacatgtctcgtgaaaaaaatctattttttttcacaattattattctttatttcaaataaatattaaagtagaagtttaggctattttgatgccaacaataaaaagtcttaataaaagaaaatatttttgagcggaactgaatcccattgattagcacattctagatcacagtggcacttgacagtaattaattccagtctgaagctcctatttttttttttcaaaaaagaaacaaaaaagattgtactgttgtacattacgggacctatgtggtggttgagatccttatcctctcgctctcacggtctctctcccattttatccgtttacggggaatttaactatttgccactattagatttgttaattatttaaataacttcttatattttcgtagagagaacttctccactttttaccacttttgtatacgtggtgcactaactaggctgccccgtcatcttcttcctcccgacgatgatgaaccggatggtgctctgcgttggcggtgggctctgtgtgcgggttcctgatgatgacgctcgtcggtgttgtgtaggtcaagctcgtctacatcggctgcggcgccggcaacgccaccgcgtggggcgccgtcgtgcctctctttacgctnnnnnnnnnnnnnnnnnnnnnnnnnnnnnnnnnnnaagagtttgtctatcaatngccag

SEQ ID NO: 10128 - DNA, 2580 bp, Oryza sativa
  unsure (1)..(2580): unsure at all n locations
cggtgagcatactgtcacttttagtttttcattcattcatcagattcatttttcatccatctcatttagtttctccatctatatcagtccatgttcagctggtcacattcaacattgacacaaacaccttaactgatcgacatagtaatatagtatggatcaagacagtgttattttcaggaaattggtatgtcgagaggtggttctctcacctgaccatgcagacatgcagtacacattgaatccttcctctaaattatacgctgtgtgattctgatctgttaactttatacaggtcaattattcctgacagcagttgcttgaatgcttcaaagacttctggatccaacctgaagcccttattgtttgaggtcaacaagttcagggaacaatgaagaatcgttaaatacttcttttcaaaaagaatagttaaatactaaaagcaggaaggtttcatgaaaggtttcaacgagaggggaaccatgaatgagctttggttgcttatatcagattgctccttctgacgtaaattttgttacagcctttccacaacgtattatgcagctatcaaatttgtagctataaattcgatgttgtattatatacaagtattgaaatgaggtatgccctcatcttgtttcttggggaggaatagaggcaaatggcaaagggcgaaaaattggccatcagtacgtcaaatatcattaatttgattcttttcataaggaaagttgttgcttcagttgaaagtttatgattggccgttatggcctccacactagactgcttgttggatcttttctataggtttttcatattctggtttactgcacatgctacgagaaaacccaataagtatagctatccatatgtttcttgacgaattcagccaatagtaataactcagtcttaactggataaaactatgttctcactcttgcatgataactatagggctaactgaataacctgaaattttcagggcataatagtatgttgcatgccggtaaccctaaagtagcaatgaagaaactcatatgttacatactacaaatcccaaattcacgaatacgacaactttgggtaactttgagaatttaatcaagaataagtaccgttaatgctatcctgtgtttgtcaacgacaattatatttctgaatattttttaacctctgagtatatatacaggttatgtaaaaccctctgctactctgcttttttaggatttatttgtggcttgttttccccattgcccacaaagatcctgatttcactgttgaaaaaccatggccctgtttagattctaactgttttcttcaaacttctaacttttccgtcacatcgaactttcttacacacacaaacctccaacttttccgtcacatcgtttcaattttgacgtggaactaaggctgtgtttagatccaaagtttggatccaaacttcagtccttttccatcacatcaacctgtcatacacacacaacttttcaatcacatcatcttcaatttcaaccaaaatccaaactttggatctaactaaacatagcctaaacacagcccatgttttccagccttacacctgcatgatctggctagaatggaaaaaaacgaaaaagggttaattggaatgataaattaacatggatctatgggcctcgttgacatcgggcctggtcacgcataacctcgctctccctgaccgttaaactgaccgttactctcgctcgcacccgcccttgcttctcgggcggatccggcggcctccagtctagtccagaccacgcctccctcctcgagttggaacgccgccgccgactcccctctctccaagccagcacgtggcagccggcgaggagggccacgggcggagcgaagcgggggcgacctcctcccctcccgcacgcatatccttcaccaaaacttttgcaaaatcaatgtaatttgaaaactatcacttggaaaatgtttcaaaaggtttcctatatgttttccaagcctcacattgcaagaaaaatgatatttttgaatgaaaatgcccttttggctctcttttgaagaaactagattcttagttttggccaaaatgagattgagaaggaatttgagaaatgtttcaaaacaaagttggtagagaagaaagtttgtaatgtttttggtattcaaacctatttcaaaaatcaaatatttcaaaagttgtttgaaaatcaaattcgaccaaaaacccctatagaccataaaaggtcacctcctagcacttgagtgagttttgttgcaaatcatcataatcttcaaatattatgggtggttagcaatatttaaaaactcacacatttcaaaaattgctccaaaaatcaagtttttattgaattttattgtgtgggttgccggcttgtgcaaggactgtgcacagccagcagggggcctggcggtctgacccgcgctatatgcgcggtctgaccgaccaggtacggcggtctgaccggccacatagggccggtctgacccgccgaggtgggcctaggcagcttttggcctttttcttggccctttttcttctcccttcttcccctacccgan

SEQ ID NO: 10129 - DNA, 742 bp, Oryza sativa
gcggccattgaatgcactcggatccgacctcgcccttctagaaaccccacacatgcttggtagccacggctgcatgcacaaacacacacatgttgcccgtgtacggtgctcgattcgtacttgtaccgaaccgagcaccagcaggctagtcttccacacatcccgcctccgcgcctcgctactctgacccgcgtcccccaccttctgcactcgcacaaacagaccacagcaacacagcgcgccgcctccccacccaccccaagttcccaacggtttcccaccccctacaaaaacccccacagtcccactcgggaccaaacacaccacaccccgcgccgggccgcgccttcacttgcaaaagcccggaagaaatcccggtgccgcgccgcgcagcgcagcgcgcagactgcgaggaatcggaatcacaacaatcacccacctcgagaagcgcacaacggagagggattagaattgatagctctcggcgaggaggttttggtggtggtgggagatggacgcggcgggggagatccagaaagtggcgagcatgcggctaggggggagcatgaggggggacagcgggtccatgtggaggagaggggacgacgtgttcttcaggtcggcgagggaggaggaccaccaggaggcgctgcggtgggcggcgctcgagaagctgtccacctacgaccgcgtgcgccgcgccattctggcggtcggtggggacgaccgcgccggggactga

SEQ ID NO: 10130 - DNA, 999 bp, Oryza sativa
  unsure (1)..(999): unsure at all n locations
ggcgcccattgatttgcgattcagctcggtacccaaatgaagtttactccatatttgtgttatcctaactaaaaattcaccctaatttaatatcactcatattttgtttatataatttatttgaatttttaattagggttaattctcattccatcgtactaaaatttaattattgctaatatggtcgcgataatattttatttatttccaatcccacctaatctttattttaatttatattttaattatttatttagccaccttgatttttagggtttattcctagttagttattcattattcgcgattaataaattctgagatcaaaatccaatgaaataggcgaataaaatcggcatgatgcaatttattacttaaaaagtttttgaaaatccgtatttttggtgctttgatttcgttggtcgaattttcagggtgttacaccatcctagccctttaccgccaagccaccgtgtcagccatacctctgggggtcccgttctatcctactccgccacactttggtgaacgctttcacctccctctttccccatcgttctggacttgaccttgctcaatgtactaggcatgtggtgggtggggacggtggcaggtgctggtgaggcggcttggttgcgagctccgtgcaatgtagagagggtaggctcagacaccgcctccttcccttccccatctccgatcgctgttagccgctagatttgggcacaaggttgccgacctcttcttccctagttgttggtttgctcgatggtagtgatggtggtggccggggtcctctcgacggtgagagaaaggtgcactcttcgtccctcctctatcgctttggatggtcgccgaccagatcagaccattttcaccttttccccctaagccactcgtaaattcattgggctactctgacacccatgaagccctttcgcaccttcaccgtggaatctgagcctagctagagggtgagaccgtgggctggagcacgan

SEQ ID NO: 10131 - DNA, 2867 bp, Oryza sativa
aacccggcccggacttggcgaacgccgtgcggtggttgtccacttcggccccgaaagacgacgacccctttcttctagctggtttcatctccatgcctttggacttttcctgactcccgagagagagagagagagagagattgtggaggggaagggatcgaaggagataaggtagatgagaccttatcccgttgtgacgggatactgttgtgtagattttctctataaaaattaaagatgtttttgccggtatttgggtatgtcatccgtatttgagtcggtttttaagttcgttcgcttttggaaacacatatccgtgtttgagtcggatattaagtttgtttgcttttgaaaatacaaaaggagtcgtataagaaatctctttaaaataactcacatgctactttgagatgaaagtcggactcctaattgcagcttatgatttttcttaaaaaaatatttaagcgaatttccacagtaaatttcattctaactaaaccgtataactatcaaaataacattcacccgttgcaacacacgggttttttttctagtaaaataaaattttaaccatcaatgagttcttaatgcttacttaaaaataagttgtatacatatatttgcccccaaaagtaatactataatatgacattaacttattatagtattcaattaatgatcgtaaattatcttgtcctatatattgagtttttatgatcgaagagagtatatcatttcgcaacattttaatataaagattttgtatcccttcacatgttggcgatcatttggttccgtaagtcatatccattggtgaattcagatttagaactgcggggtctggaatgtaacgacaatctgcagacatctcttaataacttttcgtgaatatttgcaacataattgagcacaacgcacgcatctcgcattctgagttcaacaataccatcacctaaaataggctagcctgttcatctttctcgttcaataatgcaacagcacttggcactgagcaaaatgttgtttgaagtattttattcctgagttcaatggttttattcaatacgcagaccacactctgcaaaagcaatagcacctacaagatacgcagcagttatgtagtctttacagtaggaacagtatctctaccgtcagatgcatcaagcatcaatatacgtgatttgccaaaaatgcacaaacaaaaaaaaagaaataaaaacaactggaccagatattcttctgataggtctccccgaaataatttacagattgccatatgaatagaactaggcttttgcaggccatgttgcttgagatgacatgattatgcccacaatcactccaaacagacccaaggcgctgccgaagatctcaatcaccaagatctttacaaagagtgatgaattctgagcatcagacaatgcacagctgcttccaattattcccacacaaaccctgccgatcacaaatttaaccatctgagaacgtgaaccatgatacacaagaaataaggcacaaggattggtgcttacccgcaaacaagattagcaaagccaacaataagaccagacgcaaagattgcatagccagcccggagagactctggatgatgcactagagcagttggtacactttcaagcttagtttggaggatgattgccacgataacaccataaattgcaacagcctcacagaagatgacactgtaaagcacaattagatgcatagatgtcagtatcgcaagttaaaagtgaacacggctgtgattcaaaagggtctttcaagacatgttccagaatatgaactagcaaattaacaaaatagtatattttaatattaatggtggaaataaaggctatgcagatgaaatcctagaggccatgtatgtaactgttttgtacaactgatgcaaaaaactaaacttaatgcagttaacataactatacatcttataaaacattcagtggccacttctatgaattgtagcatccgatttattcacaataaaatgcaccatgtatccaccgaagcacgatggattgctttgagcagacaaacaaatgttaagtcccttagtcatgctgcattgtcatttactgtagagtgcacacactgtttgtagagtagataagcacacaatgtgtgcctcttttcttcagccattcaggggtacttgaaatgactgaaaagattgtagttaagcaccatatctagttttcagaatgtgcaaaataaagcatgacagtcacactgctatcagtaaccatctgtcgggaacataatcaaattcttgctagtactatcgctctcttgctgctggtttataaaatgagaaatgcggtggaccaaataaaattggagaactttaggtttgacttgtcaacagaaagcaccaaacacttcctcagtatctccatatttttcaagcgtgctataatgatcaggcaatgttacctaagttgtgaagtgaccattagacagaccaaaagttcagctcctaattgcacaccagactggtgttcatcgcataaatcgcacgtatgtgcatagttgtcctacatgatactatggatgtagaacctaatgttccactgcacatgttacattgcatgacgcagttgtcctagagcactacaatagcttaagtacatatgacagcattatcattagtacagtagcccacattctagttacaccagtacaccactacgattgcttataatcgagcaaacatgccccaaataacgtaaaggaaaatacaagtaaaacacagatgctaagcaatgggttaaaagatacaggctggctaagggggatcctctagagcgaccgcggcatgcaagagtagacaatcaacatgggccagc

SEQ ID NO: 10132 - DNA, 2021 bp, Oryza sativa
  unsure (1)..(2021): unsure at all n locations
gtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacttaaatatacaaggcgtaataattgaaagccatgatgaaagggcactctacaaaaccaactgcctagaggaacagtgtggtaatcaatctccctagatacaaaatgcatggaattctatgtccagcagttttcgcgtattgttggcatttttacggatctcattactgtcaaaatcaatgggacacttgcaagatggcatccgattagtcctagaaagaaacctatctgataatctaagtcaattcatgttattaactagtactggcactcaagtaatccgcccgaggaagtacttatgatgtacatatcagcagctctgaacaatttcatgtgctcatatcaaaatatcccctatccgcactaacagaaaaaaacatcactcgagctattcagccaaaccctaaatcgcatcagcaagccgcccaatcacgaaatcgacagccaggcggtcgagaacgaaatcagatgagaaagaagcaagaatcgggcacctgatgaggttcttggaggtgatcctgggggccttgatggcggccccgatgaggctgctccccgtgatgaagatccccctgcaagcaaaaagagcaccaacgcgcgatgaggacggcgcgcgaaccgggggctttcgcagatccggcgacgcagatcgatcgagcgagcgaggggttgggggggaactcaccaggcggcgccgaggacggagacgccgatggagacggctatgccgatggcggagaaggtgtagggcgagatctgcacgagcgcgcgcgcccacgacgacgaatcagacgacatcctcgctacaccacctccggatcccacgccgcggcggcgaggcgatctccctccctctctccctctctctctctctctccttcgcgcgcgcggcgaggggcggggaggggcgggggctggatcgatcggaggaggaggaagggcgagattggggaagggaagaagactcgggtgtcgggtcgggagagggagacgagacgagacgtcgtcacacgatggcacgacgaggagatgtgtgtgtgtgtccgtttcttggtcgcacgagaccgggacggggcgtggggggtctgggggcaacgagaggctgtggttgtggtccgtccgatttattgatggacggttcagggcttcaggtggattgggcacacgggatcgggaacgagttggactcaaaacataggctcggtttttttaaaaaaaaacttttatacaatacaaaatagaaaagcatacgtcaatagcatgtactgaaaccatagtttggtagtataagattcgataaaaccatggtttcggatagggatagttggcacagccaatttgtttttctattaacaaccatggctgtgttcatttgcttgtgttgagaactaatttccttcacacagaaaatgagatacctaattaatatatgattaattaagtattagtttaaaaaaacttgaaaattgattaatatgattttttaaaaaaactttcatgtataaactttttgtaaaaaagtaccatttaatagtttaaaaagtgttagcgcgagagagtaaagttggaaaagttgtccaaagaacatagcctatgttaacgaggcttcccctcctcttccaccggcataaggggaaagccaatggaatgctgctcgctccggtcatggcgatgaacacgcgaacgatacatcgtcatccacctcccctccttttcttgagtggcaaagcatatttgagtggaggaggaactggtggttttgtcgacacgttgcaaggaggggtaccgagaggaattcaaacgncaca

SEQ ID NO: 10133 - DNA, 1494 bp, Oryza sativa
  unsure (1)..(1494): unsure at all n locations
ctggccntttgatttcctgtcgctacccganngcatcgatgcagcggcggtaagatgcgagacctcaccaagcttncgaccccctncccaccttcctcccactcctcccagcacatcccggcggtggaggtgatggggagacgcggctttgtcggcggcggtggaggcgatggggagacgcagcttcatcggcggtgggggcttgtatgcctaattgcttatcattcccggaagatttgatgcggttgcttgatgcacgagccgcgttggtgaaggcaaacaacactgcatttcttttttttctctaggttcttgctatgttcatgcactgcttttcttttttctctgggttcttgccatgtttatgctgttgccagtagtactagtattttctcaattggagagattttctttttaagtatttgctttcggcaatggaaacttttggcattttttattctgcgtcatatgcttctggcatgtgtaatcaatagatgcagagaaatgacatatgtaatcaacagatgcagagaaatgacagtaatatatggatgttgtcacggagggtattttcatcattttacattagtactaaatttgcatcagggatccaggaattgcttctttctagaacggagggagtactatctacatgaaacatcgatgatacaagatatcatcataatacttcgacgattccacctccagaaaccaatgtcacattcaaatattatgatactacgacttatcatgatgtcttgtcatggatatatcataatcagaccaccatgatacggcgaaagtatcacacctaaccatgcaggcggggcgagttgcagcagcccgcaacccattagagcaagtataatagtgagctataagcctactgtaagctcaggtatagaagagagatattgaaaaattaaggatactggctctcatgcaagagctagcttatcataaggtccaagacaaatgcattaaatatataagtgagagatagagagataaaaagaaaattgtagccaattttatagctaatctattatatatattggctttgagatgggctaatattaggaagtgggctctattattacccttgctgttagcagtgtttgttgcagcctgcaaacccacaaactatctgctgggctattcgcggccagtccgccaacccataaacaaacccaccaggccaccacacacacatcgctactttactgcctcactttcactgccacgcatcaatctacctgtgtaggtggaggagcagcggatggttcggcttcgggcactgtatgacgagcgaacgccgtgcacaacaatggaggaagatgggatcgacgaggagaggtttcggcggcggcggaggacgataggcatgcgacggccatcggcgaggatcagtaggggagccgcgtgcgggttcgtagacgtggttaatgggccgatgtatgtgacggcgggtacgagtgcaattcaaangcacgc

SEQ ID NO: 10134 - DNA, 3770 bp, Oryza sativa
  unsure (1)..(3770): unsure at all n locations
ggttcctcaagagggcggtgctgttccaccaccggttgcggaccgcgcaggagaaggcgcagcgggagctccggtggcagctcgacgactacagggagcaggtgcggcggctggaggcgtccaactacgcgctgtccttgcacctccggcaggccgacttgcgccgcggcgccggtggcggcggcgccatgccccacggccccggcaacccggagatcttctgacctaacctgaccggatcactgaccaatctgacataatcgacatggcgccatggccagcatttcaggaaccaattgaggataggtttcactgatctcttggcaatggttgctggctaactcgaccggctgaccaaacaatgaaacaaagattcaaacaagatatgcataatgaagtgagccaacgactaacaattcgcaaatgttcttgaaaaacggcttggtacaaggtgagcactgagcagtgatatacaagaggcaaatggttttgtaggaggttagagaggggagattagacatttagaagctgttgtctatttgttattaatccttaattaaggtcttcgttttcttaacaatatctaaatgtttctaccattatatttatatttttggtagtggtatactccatcccacccgagaagaaattgaatggactaggctaatgcgacgatcaatactgaatgtttttcgttttgaaatatgacgatcaaaagtaaatggaggaagtaccttttagagagtagtagtaaggctatgtttagttcacatcaaaattggaagtttggttgaaatttaaacgatttgacggaaaagttgaaagtctatgtgtgtaggaaagtttggatgtggtggaaaagttgaaagtttgaataaatattttggaactaaacaccgcgtaaagcattcaatacctgagcataaaaaagagaattgatctatcatttactcccttagtctcaaaataaatttattttccacttatcagcacatatcaataaaagaattagaataacctcactttatcaaatgctagtgcaaattatttctctctttatttttagataaataaaagagaaaaatgatcttattatgagacggaaagacggagggagtacttcgctgtcgctgatcgagtagtcggatgatgataacaaggtggagaaaccttggaaatgcagtacggagtacttccatgacgacctggttgtttgtgtatacacatcttctagttctacctttcttccttgtgtgcttgtattatctctctgttctttgccagttgaattctagtcaaaccatgagaaattccgagtctcaaaactttaatctgtttaggtggatccagataacagtctcgttcaaataacagaatccgtagtgagaacgcgcgccaaactgtccgaaaacaagaagatgcgaggtaggagtagctagcacataatgttaactactgtattttagaccagaaataattagctctcctcctcatcttctcctcactcttcttctacctaccggcctgaccactcctaattggtcaagtgtcaacactggagaggctaatttgcagcctgcgttgatctattcatgtcgatcgaacaaattaacaggagattttgaccatattagtcgcacctttatattgaaatccactgcaactatatgattggcgtccagatcaactgttgtggaaagaacatgaggtgttcagagttaatacagtcatcatatggatacaagatacattacattatacatattgtttgcttgctctgtgacagttgaatggtatatatgttctgtatgttcgcgtataaatcacaatcgaatttgtgaacagtgtcatgcatgggcttgcaaatagtaacaataataatataataataacaataacaacaacctgcctttttttatgttgctgatctcctctgagtgctgttctgaccgagatatcattggagaaactagaaggaattagctaggccgatgcaacatgcaagtgatgtgtcacttccggtcgagtctgtctgtgccgacaccccttttttttttatcctgttaatgaattcctgctcaagaaccataaccatatagcgacgccatggtgatcgagaaaatttgcgttgatttacttttgggacgaaaataaacttgcgttcgttgaaaaatttgctcaaaggaacgcaaattttcaaccatggacatacatacactcggttgttcactgtgtccagatcttgcaatatcaccaacctacctactgcaatctgcatgccatcacccacgcacgcgagactactcaggccttgtctacaccatgctgctactgaatgtttgatgcacgaatagagtattaaatatagacgaaaaaaataactaattatataaattacgtgtaaattacgagacaaatcttttaagcctaattataccatgatttgataatgttgtgctacagtaaacttgttaatgatagattaattatgtttaataaattcgtctcgtggtttacatgtggattttaatttattttgttattagactacgtttaatacttcaaatgtgtgtcggtatattctgtataacacgccaaaaatttatacccttagatctaaacacagcctactttacaatgagactttgcattgcggctgctactacttgcctagcgttgaccaggtcacgagctggctgcatcaccaaaccctcctcgtgtgaatcccaagaaaccttgaccaactctcttggcaatggtcaatgtatcatttttccttttcttttttggatgttaggtcaacatattctacttttgttggggtcaacagttgcagctttacgcgacactagcacgggtggaaaggccatcggatcagaaatcgacggcccggattaatcgacctcggtggagagacgggtgatgaggccagggtcgttttggtgacgttctctgcgtcgatctgagccgtcggtccggtgatcgatggggcagctgaaccaggtttttacgattccgatgaaatccggtcggatttcacgaaatttcgacgtttcgacaaggctcgaacgtagaaaccgtttaaaattttgaggagtttcatctaaattcaaatttgaattgataaaaaagaaaaaaaatcatgtaaatactatgatattcacagaatctattgggatataaattttcgaaaaaaatgatacattgtgtatttactgaaaattacatcatgaaagaaaagaatttcagcaaattacctctattacaaattactgatcgaaaattcaatgatttcgatcagaatttcgccaaaatcgaccagttttcgagaacttgtcggcaaactcagtaaatttgatttataaaatttgttcggaatttaccggttttctaccggatttcacgaaattccaaattccgcctgaccgaaacggaaggtaatgtcggaatcgtaaacgctgagctgaacacacgatatggagagtacctgcgggtgcatgtcattattagctaattaagtggattcttaagcgtaattaaccaggtcaacggaagccttgacctgtttgtccatacagggtgtatttgtatatacgtgagtttttggtttgggcatgcaggagcatttctggtaacacgtagtacgccgtgtgtacgtgtactcgcattatataaccagatcaaattagcgacaaatatgatgtgannnnnnnnnnnnnnnnnnnnnnnnnnnnnnnnnnnnnnnnnnttataaattatctaagccgccg

SEQ ID NO: 10135 - DNA, 5066 bp, Oryza sativa
  unsure (1)..(5066): unsure at all n locations
ccgcgcctttgaattcgcttgcaccctcctatgaattattttaccactacaaatattttaagcgtgatttatatctcattcatttgcacaaaaaatttttaaaaaatgagtggtcaaacatgtatctaaaaatcaatggtgttatctattaaaaaccagagtgagtacctgttttagtaaaaaaataaatctcggtgtctttcctaaaaaataaacctgtacgtagttcaattatttgtgtgtttcttacacctgtgtacacttcttttttcaacacagattttacaagaaaaaccaaatcaattaagaagaacgcaacgaacaatcgtgtgatgatctatggttgcgtgcattttcgttcacctctcactctctcttctcattcagcttgatccgtccctgcgttggaaaatatgtgtacacttgcaaagttcactgatgattccgtgtacatgtcaaagtgtactgcaattccggtcttcacccaaacaccgttacatatatatctgtccaaatttgatgatctgccgtggtggaaatgtattgtggccaacggaagaagttaattcgaggtcgtcgtcttgttctgaaaatgacacgtatatattacggatatttgtgctgaataattcaaagctcgcgatttcgagttgagagttgttcttttttttttctacggagctattactgttggcataagtaggttaaaacagaggatgagacagagatctatggaaacatccattctctaagaagaacaaaaaaaagtagaaaccgacaagtttaaattgaactttcaatagattatatcttcatcacatgcatggtatttactcatggttttctctctcatctgtgtcgttccatcttatctattccctctatcataaaatataaataataaaatataaataatagatcaacataatcttcaagacactactttaaccaacgatatatatatatatatatatatataaagtaagatgttttaaataaaaagagctgcataatattagtttgtttaacattaaatatagtaattcatcttttttatttttttctattaaatagcaaaatttaaaatgtttggcttaacattattaaaaaaatctatattttgagacggagagagtaactgttgactttcgcttactacactccggaggggagactgcgactacctaattatccgattcatgaaaaagaaaaagatagctaaaataatagtccaattatacaccagctaagacttaaaaatacttataaattagctcctgcttcatggnaatattcatccgtttttaaatatataacgctcttgatttcaaacgtcttatggaaaaaaaatctttgtaaataaatttaaagttacttaagtatgactcttgctttggatagttacactaaatattttaatagataaatgattgatctttacatataaaagtcagcaactttgtatattaaaaacgaagaaaatattacctataataagttgttcctgcaaggaaaaacaacactatcactgtccaaaagaggacgatagaaactggctaacccaacagcgataataaataccctctctttgcatttataaatgtactaatcaacatataagtggaatgagggaatatatcactgcggttaatgttgatttttccaccatatgtcttcaagtctgaatattaaataaaatattaacatcagaacatagtgagttcctgccatgatcactaatgtttcctcccgtacatggagtaggtgcaccacatgccgccatgatctcaaactggactcaactataagtgcgttacagtgcataaaactaaaataactaaaccgagtcaacaaactaactgaattgaatcgatcaaatttaacaaattaaatgaatctcagaaagtaagcactttcgagtcattatgagtggcaaatatcaagcctcattgtttcgcttattcatatccttatccgaatcacttattagcatatacaaaattatttgtgagaaaaatttttataaatgtatccttagtgactcaaaagctaatactgaaaaaaaaaactacaatgagaaaaaaatcaaattcaaaattgagttctagaattcaaattttggcttataggtacaagcataagcgattcaattaggccgggatccacggaacataagagttagttaccggtggaaaatcatataactagaatgaatggatcaaactgataactaaatttgaaggaatcagagcagcttacattgaaacaggaggcacagaagataaaatctcttgtctctgtcattgatcagcctagcttgaaaaacaaacatttgactcatttttttttacacagggagagactttttaaactctatctaggcaattagaccaaactaaaaagcccctctcatcacaggggtacgacagtgtcaatacctactccattggaacaatcttaaactaagagaaaaaaggataaaacatctagctactacagttaaaacaatgtggaacccactcttgctaaccgaaaacccaccaaccgattaatcaaatcagacactaattgaggcttgagaaacatgcattattcgctggcaaaacatgtatagtacgtcttagtttatagaagtggcatagttaatttaattaagtgcaaatgtcccatatatggacactgtctgttagttgcaactttcaagaggctgaattgtctttttccctgacgaaggtgacacccagatctatgggtttagcaatcaataatgaataaaccttctaggcaagaacgaatcacaaattgccttgtaaaaacacatcttgaccgtaaccacacactgatactgcagctggtagcagaacacagtcaagatcagcttggatcggtagtgtgtgtgtatcatctcaaaagctacggattggaaaataacagaaaaatactgtccatggatactgcaagcgcaggcaaggttaatgaacaagaccgcaaccggcaaattaagacagattgtagcacagaatgatcaaatactgaaatgattgaacaaccaaatcacaaaaaaattcaatttgatgctcttgtcgtcgtcgcacgagctcttagcttgactaaatcacactgtgatctgtgggccgttcaatcggtgtcccgacggtcaagatgtgatcgcctgcatcatcgtcgtcgagtatatatcagcaacaacctcaaccaaacatccacatggccactctaacccagctggaaaacagtcgacaagtaaaaataaactttatttaaaaaagatcagataaaagccactggataaactaataaataattcatacatgcatgtactatatatatatatatattactgttcatttgttgattataaatttaaaaataactttatttcaaaaagatcagacaaaaggcacgggataaactaataaagaactcacacctgcatgtcctatatgctatactactccatctcttgattataaaataacctgggtttgtcccccaaacgtactcgatcctaataaattaggacaatgtcattctaattttgtaaagtttgagatatgtcatcggtatctcaatgacatgtaggacccacataagtcaatgacatgtgggtcaggatggcatatctcaaattttacaaaattataatggtatggttctaatttttccaataatcaaaggttaacataaaccaaatggccactatacacacgaatcgattcagtcacctaccgcagcaaacaacaagccgagcagcctccaataattcatcccatacgtacctctcccctaaaaaaaccccaaatattacttcgattctagcccatgaggtcgacgacaacttaaaaagaaaaaaaaatgctcctgtatttttgttccagcttcatgcatgcacacacacagtagctcgtgctgactaagcggctgaccggtctgccccctgctgatgctaggaagctcccaaactcctaatctttcggtataaacacgcgcgtgaaaaaacacaacggatcagcgagcggctctgcaacgaagctccctaccatcccatggctgcgacagattgttttattacgcaaatggctttattattattattacacggattaattacccccctcgtgcccagtccaagctcaccctctcagtcaagccgaagcttaatcctcaccaacttccccgggttggtatatataccccgtctcctctcctaatcactagtaaacttgtagcttagccttgcaaggccaagcaggcagaggcagaagagcacaactccccccaaaggaggagtttgctcgatcgatcaccaagaacatcgagaggaagaggaagaagaagcaggatggatcgggaggtgcacaggatggcgagcctgaggagggaagggtcgatgtggaggagcggcggccacgtgttctcgcggtcgtcgtcgcggttccaggacgaggacgacgacgaggaggcgctcgcggtgggcggcgctggagcggctgccgacgtacgaccgcgtgcggcgggggatcctggcggtgtcgtcggaggacggcggcgccggcggggagaaggtggaggtggacgtggggaggctgggggcgagggagagcagggcgctgatcgagcggctggtccgcgccgccgacgacgaccacgagcggttcctcctcaagctccgggagcggatggaccgcgtggggatcgactaccccaccatcgaggtgcggttcgagaacctcgaggtggaggccgacgtccacgtcggcaaccgcggcctccccaccctcctcaactccgtcaccaacaccgtcgaggtacgtgcgtacgtaactactaccgcgtgaattttcctcgtggtggtttgatggcgcggcgcgatgccgcgatgtaacgtgaggagaaggcaaacgctttttgtttttgagatgatgaaacgattcgagagagaggccgagtttagtttcaaattttttcttcaaatttttaatttttttcattatattaaaaattttcttacctacaaacttttaactttttcggtatatcatttcaan

SEQ ID NO: 10136 - DNA, 3079 bp, Oryza sativa
  unsure (1)..(3079): unsure at all n locations
tgtgnncnattgatttgtcagctcggtacccaagcaacgtgtactcttgtcgtgtgaggtgtgtttgcgtacggcaccgttcgattctgggtgatgaagattaactagaggcacataaaataagaaaattattaacatatgatcaactaagttttaattattttaaaccgataaaatagatttatttgttattttaaaatattttttatataaaatgtttttatacgagacgtacccgttttgaaaatctatatcttaaattaataaaaaaaccattattgattatttttaaaggaatagttaaatcctgaaaaaaaagttgtggatgaacagatcaaatagtaaaattaagattttttttgggataggaaaaggtgaaggaaaaaaaaaacgttttcttgaaaagaagggaaacaaggagcagatatagtggagcccactaagctaaaagcccccatggcgggcccggcctgcagggagactctttctggttcgggttcaaccaaactagttgaccgtttccactatccaccaacctcccaccctctccccgccacctcccaccttaccgccgccgccgccgtcgctggcggcgccgcggcggcgagacggcgaccgcttttcctacctcgaatgagttctcacggggtttccaccgacgcggcggcgcagaacaacatgacgcgtggtcgtcgcggtcgcggcgcgggggcggggctcagcggcattccgtcgagcacgtggcgcgcgcgcgcgagtcgcggtacttgtggccgtcccctctctcgccgacgcgacggcgcgctgcctcgccgagagaagtaagttttctgcgtatcgctgtgtgctgacatggttggtggtgccgtgctgtgctctccaggcaatcgggaacgcgctccacatcctccccaacaagaagcagccgatgaccgtcctccatgacgtcagcgggatcatcaagcccccgaggtaaaaacccataacacagccagccatgcatcatcttcttctgcgtgtaccagtgcatcatgattcatggcgctcgcgctaacgcatccatccatgggggtgctctctgtgtaggatgaccttgctgctgggacctcctggctcgggcaagaccacgttgctcctggcgttggcagggaagctcgacaaggacctcaaggtctcggggaaggtgacctacaatggacacgggatgcacgagttcgtcccggaaaggaccgcggcgtacatcagccagcatgatctccacatcggggagatgaccgtgagggagacattggccttctcggcgcggtgccaaggcgttggcactagatatggtatgaacctgaatgccaagattacatgatactcctaccatctaatgcttattgacgcctttgacatgagtactgaggtttgctgtttttgctttgtttagaaatgctgactgagttggcaagaagggaaaaggcagcaaacatcaagccagatcatgatattgatatctacatgaaggtgatgatgctatcacataagagtgttctagtttttttttctctctcttggaattgtatatgtaaccaggattgcattggcgaatcatttcaacaggacatgtgatatatactatacatgtctactagcaatgtaagtaacaccttttatatttcatacatgtaggcctcagctatgggaggacaagaatctagtgttgttacggactacatattgaaggtacagtctgctagctgtggattaaaccgtagtactacaaatatgatttcttgtggcatttgtgtatggataatatctcattcctgcttctctgctacataaatgcagatattaggattggatatttgtgctgatacggtagtaggaaatgagatgttaaggggtatatctggtggacaacggaagcgtgtcacaacaggtatgactaacagtctttagcaagatgggggttgttctttaaagaaaaactctaactgtcctatatgttcacaggtgaaatgcttgttggtccagcaagagctttgttcatggatgagatatccactggactggacagctcaaccacgtaccagatcgtgaattcccttaggcagactatccacatccttggcggaactgctgtcatctcattgctccagccagcacctgaaacatacaacttgtttgatgacattatactcctctctgacgggcaggttgtgtaccagggtccccgtgaacatgtgcttgagttctttgagttcatgggcttcagatgccctgccagaaagggtgttgctgatttcttgcaggaggtatgtgctgtttatcatctgtaaaaattcatgccatttactgcacaaggttttcaaaatagacagtactgatatctctgaatttgttgaaaaaggtgacatcaaggaaagatcaggggcagtactggtgtaggcgtgacagaccataccgttttgtgccagtgaagcaattcgcagatgcgttccgttccttccatgtgggccgatccatacagaatgagctttctgagccatttgataggaccaggagccaccctgctgctctggctacttcaaagtatggtgtcagcaggaaggagttgctcaaagccactatcgatagagagcttcttctcatgaagaggaatgcatttatgtacatttttaaagctgttaatgtaagttcatatctctggtgcactaattttgattcaagatatcgatcgatcgatctgatcatctgaaactttctttcattgcagctaactctaatggcattgatcgtgatgaccacatttttccgtaccagcatgcgacatgatagagattatggaatgatctatctgggggcattgtactttgctcttgacacagtcatgtttaatggtttcgcagagcttgccatgactgtcatgaaactacctgttttcttcaagcaaagggatcttctcttctttcctgcatgggcatacaccataccatcatggattcttcagattcctatcacatttctgaagttgnnnnnnnnnnnnnnnnnnnnnnnnnnnnnnnnnnnnnnnnnnnnnnnngcntcacac

SEQ ID NO: 10137 - DNA, 1614 bp, Oryza sativa
attttaacccaattatgttgttttatattaacaggcaatgaaagcacaaggcataacagaagaccgtttgttgcttctaaagggtgttagtggttctttcaggccaggtgtacttactgcattgatgggtgtaagtggtgccgggaagacaacactgatggatgttttagcagggagaaaaactggagcatacatagaggaagatattagaatatctggctatccaaagaagcaagagacctttgcacgtatatcaggatattgtgagcaaaatgacatccattctccccatgtgacagtatatgaatcacttgtgttctctgcatggctgcggctaccctcggaggttgattcagaagcaagaaaggttagttagctagattatgggctaacatttgtttcttgtgtatgtttttcggttgttaactgactgtacatcttacgcgctgaaccatgattacagatgtttattgaggaggtcatggatcttgtagagctcacatctctgaggggagcacttgttgggcttcctggagtgagcggcctgtcaactgagcaacgcaagagacttactattgctgtggagcttgttgcaaacccttcaattatttttatggatgagccaacatctggtcttgatgctcgggcagctgcgattgtgatgaggaccgtaaggaacaccgttaacactggcaggactgttgtttgtaccattcaccagccaagtattgacatctttgaagcatttgatgaggtgactagttgtttctttgggaagttatcctttgattcattagatgaactctgtatattaactacgttgctgttcaccttatctacagcttttcctaatgaagagaggaggtgaagagatatatgttggtccagtgggccagaattcctcaaaactgattgagtactttgaggtaagaacggaaaatcaacataaataacaatcatctcttcatgcttcagcacgtaggctgactaagtcacatcaaacggaaattccgttgttcatttgttcagggaattgatggcgttagtaggataaaagatggatataatccagcaacatggatgttggaagtgacctcttcagcccaggaggagatgctcggtgttgattttagtgaaatctacaggcagtcagagctatatcagtaagcttcggcacatgccattctgattaatagaatgaatagtgtatttgaactgcaattctaattattattattattattttgcatatttgcaatttcagaaggaacaaggaacttattgaggagctaagcacaccacctcctggctctactgatctcaacttccctacgcagtactctagatcgttcattacacagtgcctagcttgcttgtggaagcagaattggtcatattggaggaatccatcctacactgcagtgagattactcttcactatcgtcattgccctaatgtttggaacaatgttctggaaccttggaacgagaacgtacgtctctaacatatgttcttattattttaatctgggtgacaaataacttctaaacctttactcatcatatcttgttgcagtaaaaaacaacaggatctatttaatgccatgggaccaag

SEQ ID NO: 10138 - DNA, 6464 bp, Oryza sativa
  unsure (1)..(6464): unsure at all n locations
cggcgcccattgaattgcagctcgtatccatgatcgttgcgaatgtctttggatccttcatgttgctaatctttatggttctgggtggttttattctagtaagaggtaaaacttcatctctgtactatgtagttcttctcattggtgcattttttagtaagtcaggttcttattcatgtatgtactggcagagaaagtgaagaaatggtggatttggggctactggatcccccgatgatgtatgcacagaatgccatctcagtgaatgagtttttggggcacagctgggataaagtcttgaataattctctctccaatgagaccctaggcgtacaagcccttaggtcccgtggcgtcttcccggaagccaagtggtattggattggctttggtgcattgctcggattcatcatgctcttcaatggtctctttactcttgcactaacatacctcaaacgtgagttccttccgaattggtttgcttttgttttctttcttttcttttgaaagaaaagtgtggcaaaagctctgcatcatttcaagaaaatagggagaagataatgcaaacaaaccgaaaatatggtagagactaaacaataagacaacaaaaataaaatatgacacagcaacacaaaaaagcacctcaaatcatcaaagtttgttcattgttcttacctcagaacggttttatcttccgattttacattacagcctatggtaagtcccaaccatcagtatctgaagaggagctgaaggagaagcaagccaacatcaatggtaatgttctagacgttgataccatggcatcaagtactaatctagcaatagttgacaacacggaaactagttcagaaattgctgataattctcaacctacacaaaggggtatggttctcccttttgctccgctttcactcactttcgacaacatcaaatactctgtcgacatgccacaggtaacatattttaattccttaacttatattgtccaccagtgagtcattaatgacaattttgtcgtgaccttttgtatcaaattaaaattcaaaaatcaggaaatgaaagcgcatggaatagttgaggaccggttggagctcctcaaaggtgtcagtgggtctttcaggccaggagtgctaactgcgcttatgggtgttagtggtgctggaaagactactctgatggatgtgttagcagggagaaagacaggtgggtacattgaaggcaacatcaccatatcaggatacccaaagaaacaagagacatttgcacgtgtatcaggatattgtgaacagaatgacatccactcaccgcaagtaacagtctcagagtcactgcttttctcagcttggctacggcttcccaaggatgtagattcaaacacaagaaaggtcagtcaaaaaaaatatttttaattccttctctcagcttataatcaattgtttaaattgtttttatttttattttggagaagggtatttcttacccggcctctacatccaaccgaatatatgcagcctttttaaagtaggaacttagcctatcaaacagggaacttatctctcaaataacctaatctgaaattcgctcctatagagatttgaactcaggactttcgggtgctactcaggtcactgcaaccactaagctacatgccctttcaactgagcagagaagggtattgtttaagttgtttaacctttctctatgcagatgttcattgaggaggtgatggagcttgtggagctcaagcctttgagagatgctttagttggtcttcctggagttaatggcctctcaactgagcagaggaagaggttgaccattgccgtagagcttgttgctaatccttcaatcattttcatggatgagccaacttcagggcttgatgcccgagcagctgccattgtgatgaggacagtgaggaatactgtggatactggtagaactgtggtgtgcacaattcatcagcctagtattgacatatttgaagcatttgatgaggtgagcataccttggaatatctgctacaccttttggtgaactcttatcggttttgtaatatggaataactgggttaacttattaaaatttaacttattttggctgattttccaaacttttaatgtgaccaatgctttattgtcctaaactttagataatgtgcagggtcctaaatgttttattaattattgcagcttttccttatgaagcgaggaggagaagaaatatatgttggcccgttaggccatcaatcttcagagctgattaagtattttgaggtatagtaatgttataaaagttctaatatacctctttttggtttgttcgatactgttgttaatcttatattgtttcgtgttctcaagggaatcaaaggagtcagcagaattaaagatggctacaatccagccacgtggatgttggaggtgtcaacaatttctcaagaacaggcattaggtgttgatttttgtgacatatacaggaaatctgaactcttccagtaagtaattactattatgttaaatcctgtaaatcaaatagttgactcactttgaatcttggtagtgaaagctagaatctccttagctgctttatgtatggtggtgacaaaccaacaagagtaaataagtaggcttcaatacagttggtcagatttacatggcttctacagataatgcatcatactactgcaagtatgctactaacaatttagcttgtgataaaattcaagacaatcggtttgttcatgccattacatattgcagttttcggtagcattggactttcttttctccaaagcagttttgttgtggctgaacttgcatcaactattgccagcgtcttaacttgctggttatagaatgctagcagcattgtcaaggtttgatttcagaatactatgctatatagcaaatggacaagagctagagtggctccattaccactgcagctctacaacaaatagtggtagtgtgctccacaggtcaaattcatattactactgcaaactgttgtgcgacatgccgacatgagtcattttcacatttcatatgttcatatgtttgaagtttcaaaggttttaaatttcctgataatttcttttttttgcatttatgaataattaggaattaaactaagcctcttttttttgaacgaactggcacagagtgtgccagtttcattgaatatagtgggagtaaaagttatttacaggtgtgaaaggaaaaaaaaactatacaaccattatcgacaggacgctagatttacaggaggagctgtgttagcttctttgcatccgcgagtacccatgttttcccttccttgattttcgctaacagaattaagctaaggctgtacttctacatggataaagatttgctttaatatcttatcatcaattagattaccatatagctatgatacacacatgtttgccttttatgcgcttcatgtacacttctgagttttcagtggacatccaaaagtgtgaaattagaagtgggaagatttagtatgacctctctgaaaactttttaactaagtggtagctgtttccaacacattgctatgaaatatgataattgcaatctgaacattgattactgccatttataggaggaacaaggcattgatacaggaactgagcacaccaccaccaggttcgagtgaactatatttccctacaaagtactcgctatctttcttaaatcaatgcctagcatgcctgtggaagatgcacctgtcatactggaggaaccctccttacaatgccataagattatttttcactactgtcatagctctcctctttggcaccatcttctgggatcttggcggtaaaacgtatgtaccctaccttgtacatatcaagcatatgactaaaccatcttcaaaatgttatttatgcgccttttgcttcttgctccaggggcaagtcacaagacttgttcaatgccatggggtccatgtattccgcagtgctttttattggcgtcataaactctcagtcagttcagccagttgtatcagtggagaggacagtcttttatcgtgaaagagctgctggcatgtattcagctttcccgtatgcatttggacaggtatttgtttttttagactctcggttggcctagttctaatctcatgtatataatgtatgacttcaaagactctgatgcgtgaattctgacttgcatttgggattgaactgaaatggctgtgcaataagctattcgttagcactgtcaagctcttttggtcccataacctaacaatgccacttttccctttttaggttgcaattgagttaccatacatcatggttcagactctgatatatggcgtgctggtatactcaatgattggatttgagtggactgttgccaagttcttgtggtacttgttcttcatgtacttcacactgctatatttcacattttacggaatgatggcggtagggttgacaccaaatgagagcatagcagcaatcatctcgtccgctttctacaatgtgtggaacctcttctcaggatatctgatccctcgaccggtaggttattctcccatctcaatttcgccccctttcttttctcatgaaatgtcgcttttattagtcctttagaaccgttttaaatttctctacagaaaatccctgtttggtggaggtggtactgttggatttgcccggttgcatggactttgtatggattagttgcttcccagtttggtgatatccaacatgtgctcgaaggcgacaccagaactgttgcacagtttgtcactgattactttggcttccatcataacttcctgtgggtggtggccgtggtgcacgtcgtcttcgccgtgaccttcgccttcctcttcagttttgcgatcatgaagttcaacttccagaggagatgagaaagtgatcattcttttttgcattcgttctattgtactactgaatagctattagctatcctgtaaatggtatagagatcatcttctagtatttcattatttcaagcatgtaaaaattcggacatctagtaggattctctaggaaaaagaacccttgttgagcttcctgcctcttgaccagctctagctgataaatgtcggatgcagatgaatgtaaagtatggccttcaatgttttcatttttgtcgaattaatgaaagcagaaaatttgttgattcaatccctttgcagcaactcttcagaataacttttgttccattgttctatagatttgactaatagcggagtaaatttttcacaatgcggttactgatcttgtagtaatttactaacaaaataacctctatttttaaatatatgatattgttttcttttgaacataatgtttcactatttttaagaattatttattttcttgcattttattatgaaaggtatttaaagcattaattttttttactaaatttttaaataaatcgaaatggttagaagtcaatagctgcgaaagtaaggcctggtgccctggtttagttcctaaattatttttcccaaaaacgttacatcgaatatttggacatatgcgtggagcattaaatatagataaaaacaaaaactaattgcacagtttgcatagaaatcgcgagaagaatcttttgagcctaattagtccatgattagccataagtgctacaataacccacatgtgctaatgacggcttaattaggctcaaaagattcgtctgtggtttccaggcgagttatgaaattagttttttcattcatgtccgaaagccccttccgacatctgatcaaacattcgatgtgacaccttttcgcgaactaaatagggcctaatacttctgtcatgatgtgcaccttctgttnnnnnnnnnnnnnnnnnnnnnnnnnccccacataactttccttttgaatttggggatgctagttggcgcagctctgcgtcaactttcccaagtcacacccgctgcgaggctgcgaccctctgtccccatctctcccgatgctaatgttaatagtatttttcctaattaatttagagttgaaagcttttcaaatttggaattaaaagtttcagattctggagtaagttttgaattttgatttgaaagttttggattttgagttgaccggcgaccgcacgatatacggagaccatgagctctttcccttccttatctggaggtgttcgctggaatcggaagtagcgcgcgtgcgctaatatggcaatttcgttcgaattttgaccggcgttaggtttcgctttacccgccactcccattttttttcccgcgctttctcgttcccgccaatccgactccgagtctctttacaactgcgtacgggccaagcaaagcgtaagcctcccgagctccatctcgacttggtcggtgcgcccataaattgcaagctccgcttcttcatnnnnnnnnnnnnnnnnnnnnnnnnnnnnnnnnnnnnaaagatatctaaaaggcacg

SEQ ID NO: 10139 - DNA, 998 bp, Oryza sativa
ctccccgggttcgtggcgtcgtgcctgcacaaggacccgagacggcgcgccacggtggcgcagctgctcgcgcacccgttcgtcgctcgccgcgacggcgaggcgtgccggcgccagctacgggagatcatcgtggagaccatgtaggagtagagaagagaaaatctcatcatgtaaaattgtagatccttgtgcaaattcttgagtagagaagcgaaacatctcatcatcatgtaaaattgtagatccttgtgcaaattctcgagatcaattgcacttcaattgattttttgtattttatcctgtactctagggatcccctgtacgctgctaggggatgttgagatttgagaaggaaaatctaaaagtttccgtccacgttttaggtggtgttctttttttaattaagatatagattttatctcgattttcaattttcatcattaaattctaacggtaggaagcaacaaactataaccagatcaattatttttaccctccgtcctaaatatttgatgccgttgacttttttaaacatgtttgaccgttcgtcttattaaaaagggttaatttgatccatgccactgcaattttgcctatttagaaaaatgctattataatttgtgtattgataaccatgccactagaatttttcaaaattggtgatatgccactgccgtcgcgtttccatcctcccccctgccttttccgtcttctttcactgttgttcacttcggcaaggttagcgccaggagccggacgtatggcacgcggcgctcgctggcggcggcggggatctactcggcgccggcgttcttggcctaccttgcggcggaggcgtcgccccgccacccgctcgctgcgcggaacaaggcccgcgccgccgccacgctggtgcaggcatggcgcgcccgccgtcagccttaccattggcgggcctacattgcttcccttcccgggcccctgcccttggccccatccagtctctccttcgcggc

SEQ ID NO: 10140 - DNA, 1960 bp, Oryza sativa
ccgccgccaattgccgccgccgcagccgccctcgcgccgcccccattgttgctcctccttttccgccgccaccgccggttaccgcccttgcgccgacctcacgccgcctctagctgtgtcggccatggcgcgatggccacgaagaagatggagaaggaaggaagaagacggaaatggagaggatggatagaaaaggtgacgtcagtggcatagttttaatttagtaaaattggaatgacacggttacgaataggcgaattataatggtatttttctgaataggtaaaattgcagtggtatggatcaaattaacacattcaaaaaataagactagcgcgcagtgcgacacggcggcggcggtggtggccagcaactcccggtacgggacgacggtgcggacgagctcctagctacccactgcatcggcctgacaccgcaggctggtgtggacgaactcctacccagtgcaatagcaaccgaactcagtaaataaaggtggaaaagatgatgtactaaggaaatacaagtggtggaagatgctagaagcttctagaaggtacatgaagaaagaaggtagggaggaagaagatcgacaaggtgcctagtgggttttttgtcccgtttgcacagggatgcctagtgggttttttttatcccgtttatcccacttctattttattttttcttctaaattttgtattatcatgcgagaaataaactagcaagcgggtttttatgtgggtagcgggacaaaccacttgcatccctacgtttgccgttcgccgatgatcgaagaacttggggagctgatctgctttgatacaggagaaagcccagtcagccacctttttggtgcaggtcatgtgacctaaagttcggcctttgctttttgagacttgaagtttgggaaagctagtagataactgcaaccagagagagagttctagtgagtccagattgtttctttcgttcatcaaaacgcccgagaaagagggaatgctactagggacgaacagagttctggggccagaggaaaggggaacaaaaggtttgatcaatcgatcgatctctcctggaagtgcaggctctgttctttttgtagtttctgtcctcttgggccaagcgttggaagtgacagagccggccctgcctttccttcctggaaaaagtacactaaaggtcccttaacttgttatcgggatacaaaatcgtcctccaaccacaaaaccagatacgcggggtccctcaactacacaaaaccggtcacaatatatccctcggcggttttgatctcggttttattctacgtgactgctgagtcagcatgggacccatgtgggccccacatgtcaacgaaacattagtgtcttcttccccacttctctctatcccctctcagcttctctcccctcccctccaagcagatcgccggagagggcacgatgcggggcggagcggccagatagaggagcgggcgacggcgcggggagcggccggtcggacagcgggcggcagctgcgcccgtcgtactggcctgccggaggaccgggcgagcggtgggcggagcaggcgacggcgcggggagcggccggctggccagcggggcagtcgagcgaggcgggcggcgatctcgctatcgttcgcgtgcggcgtcggcgtcgtcttcatcctccgcagcgagctccccggtgacgctcatggagctttcctctcaccgccccaacagcaagacgctcgtcgaggcaggcgtcgtcccggacatggtggaggagctctacattcgaaaggtagacgacgagccgctccgcaacaaagccatggccgtcgccgtcctcgccaacgtcgtcaatactagcattgatcgggatagtcggataccaccgtggtgaataaagaaggccatgtcctcacgtccaagtactccatctacgacttcgtccacatgctcaagtgcttcatt

SEQ ID NO: 10141 - DNA, 2001 bp, Oryza sativa
cgcggccattggaatccagtgcggtacccagtccttgatttggtagatggcagcgtcgctcaggtggaagctactccgccaagagccctgatcccgcgtcgccgctgtacagcagcacgccatggatgggctcgaacgagtcgagcagcgtatatatggacaccggcaagtgtcagctcagcctagcttctagtagtacagcaggcgccatgaatcttgtgaaatcaatcaacttttacgttcctgccagttcatagcgactgcaataccacacaagcttggatatctagctacgtactcagccggggaagtcgtcacgaagcctgtcgtccaggggcggggtcgtcgtcgtacttggcctcgatgatgctgacgccgcagtcgtcgttgtagggcggtgcgctgcgacagcagggacggacgacggtggcatcctgtgcagcttgaatgcttggccgtcggcgttggcgaggtcgtagttagcctcccccgtcaccgagctcggcacaccaccgtcgacagcccgtgcccgtacgttcaccgccgccggtgtctcctgcccctcgagctactacctcagctggccgagcgagcgagctaggagacggcggcgagaacctgcaagtgccatgctcggcaaggtcggccgctgcggcggcgtgcgcggacgacgacgaggaaaggcgtcgtcaaggaaagggaaagaggggtgatgatgtgggtcccagagcaattttctatttttaatcggacaatcactgtcatgtgggtctcaatgtctcatggagtcttggtacttttttattttaagtagacagctacgtcagcagaaactgctgtctaaaccggcttaggattttatttgcatcggttttagaagttgagggacgagttcagggatgaattttagactccaggacaaataagggacccaaagtgaacttattccaaaccaaaatagatcagactgtaaatgtaatgggccgttagccgcagcgccacaaaaaccttgcaggctggttcggtgatcgctgggcctgccacccgtatagggccgcgtctgttcgctagatgctaaaggccatattggccatctcttaggggctgggaattatgtgccagtttagttggaaaaaaaaaatttgcccgtcacatcgaatatacgaacacatatttaaaatattaaacgtagtctaataataaaacaaattactgatttcactagaaaattatgagacaaatttattaagcttaattaattcatcaatagcaaatgtttactgtagcaccatattgtcaaatcatggcgcaattaggattaaaagattcgtctcgcaattctctggcgaactgtgtaattatttctttctacatttaatactccatgcatgtgtccgaaagcgtgaaaattttgtttgagaactaaacatgccctatgtcttgtttccatataaacgaaattttcattgataagattagctaatattttactatgaataattttgacaacctcagagaaaataagccatttactaacaatagaggtggcgagatttaacttatttttcttttttaaccctacctacaccttgtctctaccaccttaaggccccctttgatataaaggaaattcataggaattttgaaggattttattcctataggaatttctcctatttcgctctttggagcgaaggaatgaattctatggaaacctattttatttctttggaatgcctcttcccaggcaaaatttgaaggggatgttaacattaggttccacctgagggtattttttcctcatatccttggggtcgcgtcgtagataaaacatatgggttttttcttttttttccctcggaattatattttcgtcattattccctcgggtgccgtgttgaatttgttggctttttattcttccaaggagtttgtgattgtcttcatattaaaagtgggtcttaagattcttatgggtttaatttgcaacatatcccatct

SEQ ID NO: 10142 - DNA, 10408 bp, Oryza sativa
  unsure (1)..(10408): unsure at all n locations
atnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaagttttggaggaattctaacatgaggtaaaacctcttggaaactttcctttgagtctttatctctcctctaattcctgcgtttttcctgcggtccaatcaaacgaccattcctgtgtttttcctatgttttgcaatagtctgttttatacttacattcctatcaaaatcctgcgtttttcctattcctatattttctcattcctgcgattcaaaggggccctcaaaagtggagctatctttcttccatcttctcccaccacatgcaaacgtcactgcacgcaaatatctccatatgctccgcgtgaataaccaccggatccaatattgtatttttctattagtcttctattctaattataaacctgatacattacaaagtacgtatgttactagtcttacgaaaataagctaaggtttacgaaaacaaaaccaaattagtaagtaaatggacacgtctataacatacactatttctcctgacagttcaaattgactcagctttccgacaatatcgatttgtcaaaaatatcctacacctacatgcactccccaaaatggcattgccctatagcagccaaacgatcgaggtcctcaaaagcaatatacgcaaatttatgtcatccaattaagattataagagtatagcgcaactacacaagcagcaagtcaaacaaactacaactatatcactataagttgttaaatttatgtccatcatttattttaagttgttaagctggtcattcggcctccacacctctagtgaagtggatctacaaggcggtcttcttcctaggaatcggtggcggatcttcgggggaagttttgttttatttctttgtccttgggtgctctaacctccactacagatgccccattttgggtatgctccttagctatatctttgcagcttgccatggccggtttcatcatctccattgccgtcgactttggtcggatcgccgtctttgtggaagaagcaaggaaaggacccgattgtttttttctactctttagaagtccttttctgcaaatttcaatgtatttgtcaatttgccccagtctgaggggcctttctgtaaactggttgtactcccagttctctattaataaatgtatacgaggctttaaaaaaaacatttgacaccgccggagaaagtcaaccctctagaaggccatgtaggcagcaggcagcttagccactgtcaacacttaattaattactcctcctcctagatgcacgtctacctgcaaaatcttgtgcctttttcaacaagcaaactgtacgtatctttgaacccatgtggcccgagagatgcagcggatcgaaggactcacctgtgaattttgtgaatatgcatgtgtgacgcagtgatgttgcggcgttctagaaggcgagcggtatcttaattgatgtcatctctttttttttctcctaaatggaaaacaacttggtacttcttctagaagcggcaactaatgatggagactcccaggaccttgggacgaaagttgcagtaacgtgtccaaagttatactaggtatttccctccggtacaagattccgtaaaaaaaaatcgacaatcaataatttgttaaatgattagtttaagaacaaaaaatatacatttgttttgagaaacactaataaatatcatataaacccattagattttacaggcttgtttataatataaaaataaatctttagaatcttatctggagcgtcaaatattcatgattagagattttttttttcaactacagcttatataagccaaagacatattactgatataaaaaaaagtcacgataagacttttatgcatttattactatcatcagtctaaaaggcacgagtatgacggaaacggaaaaaaaaaggtctaatttgtctaatattaagctccaaaattcaaaactagctagccctaaacaagtagtagttccaaatgtattgtgtaacaatccttcttcccaagtagcaatagaaaaaaaaactgttgtgagaaatccataaacaagagagttccataaacaggagagttccaggtgtgaaatcccatgactactcatatcaaaattcagaggcaaggtgtctaatctctttctcattttcaaagacgtagggatctccatctttgctgagctactgtctcattccccgtaagtgcttctcctacaaactgctaaacggtactccctccgtcccccaataagtaattttaattttttgtttgcaacgtttgaccactcgtcttatttaattttttttgcaaatataaaaaacgaaaagttatacttaaaagtactgtagataataaagtaagtcacatataaaataaataataatttcaaaaaaatttaaataagacgagtggtcaaacgttgcaagcaaaatcttaaaatcccttatattttaggacggagggagtattattttgcgcaaaatattttatatagaagtttattaaaaaataaaaatttcaaatttgtacttcatagttaatacttattttttttaaattaatacttaattaatcaagtgctaattgcatgcttcgcttttcataccacttattagagtaaacctttcgcacttacaaatgcagctttaggcggagttcgattggacggttgaactaatgccacatgaaacaaggtaagccattaaaacataattaattaagtagtaattactaaaaacttggaaaaataaacttatttgatttattaaagaaacttccatataaaaatatttgcataacatactgttggcggtttacgaaacgtgttcacgaaaagtgagcagcatgtccaactgaagtccgtctcagataaggtatctgtccttcccctcccccctcgcagtcgcgggccccgttcgctctctctttttgtaaagactcggtactagcagtgttcacacaactgaccaactgaccgatacgatcgagaaagtgagaagtcctgggacatttgcatgtaccggtgcaatttccagaaggaaaagaagttaattaagcttaattagctaattagctaggagtacaaatgctgtgctccaagacgaccttcccaagcaattaagccttggttaccttggtcagcaagaacacacatcttatcgatccaccagggcattcaaacccgtcggctatcgatccattccttcttgcagctgcagatgatgtgtgcccgtgcgtgttttgcattctgcctacctcgtggaaacttcgaatgatctcacgcgcatgctgccaaaaaaaaaaggaaagaaaaaaaaataaagacatcgtgactgattagaagttggtttaatttaactaactgagaagacgacggacacaagtcatactcatattatcagagctagcgtatatatacgttgacaggtgtcacaggtcactgattcgtggaaacatctcacttattgatgtcttcgtatgcatgagaattcagttaattgatcttgcccaataattcatgggttcatcgctgccaattaattaaagctactcttcgtccatctcaaaatgtggtagtactaatttctaaacgaatatgaatatagctaaaaaaaagttaatgattatattttgagatgaaggatgtattagattttccttcatattagttacgcgaaatctggaaactctcaatcatatcttgcttgtggggataatctgggtgatgatcgaatataaatataatatagcaagaagatgaagatgcatgcatgcgactcaagcctttttttttctgaatgaattagttggtcataaattatatgattatgtgataatatttttaagtgtataaacgaataaattctattaaaaactttaaattttgttctataaggtattttgagaaactttttatatagaaagttactaagtttttaaaaaatgtggtactgtttaaaatgttagaaagtgtgctcataataatgtgtactaggtgattcccggcccataatttgctgcaggaattattaagtaatttttaatattttttaataaatgagctgagagtaaaaaaatattagttattaaaaaccaatcaaactggttagccaaactatgtttgtagagaaatggatttcatagattttatggatgaaatataatattctacgttttgattatatagatgattgtattataaaaaaagatggatatgtatcttgaaaatgttgtgaaaataatgtgaagagtgatgattagatatgcttacatattgatttgtcgaattcaataaatggtagatgatgctgcatgcttacgtaaactttgtatgtaattgttactagtggatgatgaggtggtatatttacatattaagtttagacctagtgggtgggttgtaaatatatttttatttttatagattccgtgataggtaaagaacgggcatatttccaagctttaagcgacgggttcagtgtaaagataacataatcacgatgatttaattacttaaatggccacctttatgggatattttgtgaatcgtagaacgatcaccttttccgtgacgaagtagtactgtgggttaggcataaaggacagtacttgtactacgtttttaattatatcacaatctagcttaggctgctaatctcaattaaactcattttctaaagagggccaaattaaggtgcagactgttatgattttgttgattttagatatgcttttgatccacgcacgtgatttatcatcgatttcacaggtcacgggcgtagctcacgtgcaaacggataggcggaaaactatacaaactcaacgttcaatcgaatgttcggccggttaatttggctctcaattggtaagcctcgcgtgaccgttgatcacacaaaaggaaacaaaactatatttactccctccgtcacgaatttgtgttttccagtatccaacatttgatcgtttattattttcttttatatataattagtatttttttcttatataaatagttttttatgtgtgacttattttttaaactttttcataaatttttcaaataaaacagacggttaaacgttggaaaacccaactttttaaaattcatagaagctggcaaccaaccagctgcttctcagaattttaaactccttaaacagtcccatagacacatgagaacccacgtttcattaacatgtagtggtaaatagttaaatatcaaatataaaagtgtggtaaatagttaaatgccctaatttttttttccacaggaaattttgtgcgtgtacgcagtggtacgcgtccgcaggaagtacatgccccgatccgcaagaattaccagctggcgagctatatactactcctaggagtgacgtacgtgcattgcttgaaaattgttttgaaaaataagctccatctagattgatctctaatgatcttgtcccctaagttaagcgttgacttgccatcaggctaaaattattgaccgatctctctcgtcatatagtaagataataagatatcgatgtacccaagctaggtggcaggtaattaaatactaggagtatctctaatggtttggttaattaaccttagccaaaaggcccaaaaccgttagaaagatttttgcatgcgtgagttgatgcgtgtcctagcatggacacaattagttaactacactaatgtactgccgtcactgatgactgtattaccataccggcacagggtttagttcatctgtgggaccagtagcacgtggttttcgtggacttgtcgatcgtagtactactgtgcagtttgtgctttgcttggttggctaatttcggttgcaaggggaaggttccccccccccccccctttttttaatatctggtcaattaagtaatcaggtctagagcttgaccaatatctactgaatgatcaggtatctgagaaaatattattcaaaggcttgagaaagatcgaggtatctgagaataacagtattcaaatagatgaaaatgatgcagaagaacgtgcatcatgttgtgcttgcatcaaatgattcctttgtaacaagaaaatcgacagcatatatggggttaacgaccgaattcatggttcgtaagaataccatcaattttatcggaaaaaaaaagaataccatctgtatgtggtaatgccgtaacggtaacatccagcttcccacgcccacgttagtagtatggagtatatcaaaacttataatcctataaaagaacaaattaattagggaaaataaagcaagtaaccctgctttgtcattattttccctgaaatatgcgatgccgaatcaaaatatttaaacagaggcgtggaggaggaagagagatgggagttcatttcgaaggttagtgcgccctcgaagcaaattcgtgcctggttcgaaatgacgaaagtgacaagtctggccgtaattcgttggcagcaagctatataggagtatgaattattcaccggtgaaaagagcttaatgaacttttcgtttcaagatcgaagtagccagaagtctccggaaattaatgtcaaaatttattccatggactatagtctgttgatttcaacacgcgatttcagcggaaaaatatacgcagtccaccttgaaactttgttcaaagataattaattactccctccgtactcgtaaagaaagtcatttaggacaatgtttaagtcaaaccttgagaatataaatcataaataactcttaagttgttgagtttgaaaatataaaaaatatatgaatagatttatcttgaaaaatactttcatatttcaataaatatttttatagaaacaagaagtcaaaattgtgttttggagaccgtgtcactgtacgaaacgactttctttatgagtagggagagagtaattaagagcggctaatcctgcataacagctagatagagtacgtattaaaatactgacagtttcaatcgatacaatatttcgatcagtccagttagctatacctgtttgggtctgtcctaaaataaatgcagtcgtcgaaatccgtgttcaacgtttgatcgtccgtcttattttttaaaaaaaatagtcacacataaagtactattcatgttttatcatctaataacaataaaaataataatcataaaaaaatttcaaataagacgaacggtcaaacgttgaagatgaatagtgtaaaactgcacttattttgagacggagttagtatatccgaaaatgcatgtactcgcagaggcagagctagatccaccggaacttatttgttagtaaaatttttacaatatttgccctaaacatattgcaattttttttagactagttacatacctgcacttctttggttccaaaataaataacaaacccagtatattatcattttagattcgtttattttaaaatggataaaatacgttgtaatagatcaaacccacttattagggagggatgatagttattttttcgcaaggaacacgctacatttgttaagaggaggatgataagatgatgactctgcttttaaaattgtagacaagacatcgagataaggccggcccatgcaaccctgcttgtccctgtgcattattaggctgtgtttgctggaatgggttggcaaccatctcctgcgcacgcgctattttttcaaaaaaaaaagcatcgatatgattttttaagcaactttcgtataggatttttttttaaaaaaaacgcatcgtttaacagtttggaacgaggcggagggtgttgggaaatagaattagagcaggtacaataacaagctattagtcagctataagtatattttaataagataaacgatgagagagaagagtagagggctacagatctgtagccagctgcggcacagactccaagacgtaatgtatgtatgacatgtgagaccatatattaatagtatagtaagtaactattgtatgaattggctattagattggttatagatgaattagagctagtagtgaggtatactattaaacttgctcttagcgtgtgtttggcagcccaggttcccatcactaactttacgcacagagaacggagcgatccattagcatgtgattaattaagtattagctatttttttaaaaaaatggattaatttgatttttttaaacaactttcatatagaaacttttttaaaaaacacatcatttaatagtttgaaaagcgtgcgcgcggaaaacgagtgagaagggttgagaaagttgggggcgaacacaccctaaagtattgtactaagttgcctggatggctggaaggcagagctaaaatgtcttactgctaatccgtaactactaacatatactactagtatatttaacgataaaaaaaacacgtgttcaatgttcgcggcgaggaacggaatcagtcggtcgcagccgggcctctgctaaaaacagcatggagtacgtacacaaataaacgcgacgtcagcagtcaaccgggctgatcaattcatcgttccgatcgacaaacgaggaacaatcagacggacgaaccaacccgtcgagctagcgctccggcaacagtggcgcccgctgcttttttttttctttttttctttttgacaacagacgccagctgctgggatgatcgatgatgcccaaaacgtcgcggtcgatcgatcggtggcgagcaaaagcccagcgattgatcgtccaaattaatcggcggcgcgggttcgtgtgcgcgcgtgacgaattggcgatggcgcagccgtgcttgcgtgcgtgcgtgcatgaaaacgtgcggcgttgtgctcgtgcaggcaggccgatcatatctttgtctcgtagggatagggatgcaagcaggaagcaggacggataaacgggatttttttttacccgtttatctcactttcagtgtattttttcttttaaaatttatactaatataaatgataaactagcaaatgggttattacgtggattgtgggagttggctacttgcatccctacctggggggatggtataccaggtgcaattttgactgatcgtgtggacgtatacgtgcggaactatgtgggtgtgatgcacctgatcgacgatgcagattgcagaaggctacgttttgttgaccgatcccatcagctgcatgccacctgtgcacttttgttaattcctgtttttttttcctgtgtaaatattccgtccgctgtgttctttctcgctcgatatcgtatcggtcagtggagtttttttcgcagacaggtgagattgatcgatagatactagaaagacaaacatgcatgccagagaagcctagcgaacacaatatttgaccggtgtaaagcttattcctcgtttctccggtaaagctgttggtgttttgtctcgggctcacgacgaagagggacttacgtgtggggttacgcgctgacttgcagggaaagcgtaaaggcgtatgcatgcatgcatccagctcggtctactagctaggaaaagggttaaaggggtacgatcgattcatttccatgtagtattgtcatttgtcaaccagtacttcctccgtatatcccattttaaacgtagcggtaggtatttatgttcaacgtttggttgtcatcttatttaaaactttttataaaaaaataagccagacataaaatactatttatattttatcatctaatagaaaaaaaatattaatcatagaaatttttaaatgaaatggatggtaaaatgttggacacagaaatctacaactatactttaaaatggaacataggggtactatctttcagtaagttctaaaaaaaagtactttcttctgtagatcctggctagttaacatgttcggtaaagagtttttcggtagcacgttttttaaactactactctctatgtttcacaatgtaagtcattctagcattctaatatttatataaatgtgaatacatctgtatatatatatatatatatatatatatatatatatatatatatatatatatatatatatatatatatcattaacatcaatatgaatgtgagaaatgctagattgacttatattgtgaaacataggaagtaaacaatatatacatttttttaaaaaaacttatataaaagtttggttttaaaaaattaacttaatttttaagtttgtaataattaatactcaattaattatgcactaataacttgtctcattttatatgcaacgaaaaatcccacttcaaactcacaaccgaacttagcataagacatggtnnnnnnnnnnnnnnnnnnnnnnnnnnnnnnnnnnnnaatagtatgaatccactgtttccaa

SEQ ID NO: 10143 - DNA, 3721 bp, Oryza sativa
  unsure (1)..(3721): unsure at all n locations
ctgaataaaagaggatggagtggatgtttttattcctatggaatgaatacattttgaaggatttatggaggattgacatagtgtttctatgtaaaatttcctttaaatcctatggaccgaatgcataaatagtgtttattccaaaggaattgagaatacctttaggaatccttcaaacataataaagcacacttgatatatgggacctacccacatgggcgtatatgtcataagcacacttgcctttaatgtacattctagagtgacatgtcacaaattgagtaagcaaaacaagacattagcaaaaaattttaaaatttcaacaaagtttagaaaaatgtgtcaataaaccaagaaaatgtctaaaaagcctgcttcattcgcacattcgatctcgcggggaatcttgtttaaaatgcaagattgtatatcaaattattacttcataaatatgatttgaatcatctcaaagagaaaaaaaacacatgcttttcatgcatgcatggtacgtaaaggtcatagtcggatactatttgtacttacacgtatatttaatagaagcatgtacattgtgctctgtattatactatgatatcctttgatacagtgatacacatgccctgttgagttttagcaaggtaattaacttgaccacatgaaacaactctccaatttataatttattaaaactatccaagaatctaagataaggttggacaatattaattctttacattttggacaagattaagttcaaacttttataattttgaatggcaataactttaaaaatgttttgattaaaggcagtactagaactttatcttataaaatactatagtaaaagtaaaaatatatttacttattgcacatattataatagaaaaacatgattaaaatatatcttggagataatgttattgtccaaaacattaagaaatatgaaaccggagaaaatgtatattaactaaatcaaatagataataaaaaatcaaccagtgtttgatctttattttggcaaacaaaacttaatcactgcaaaccgccatagatctctctatttgaacgtggaccaaataaacaactcaaggaaatggtcacaggagaacaaaacagtgaagtactcttacgtatgacacggaagcttccgatgatgccatgagaacacgtgaaaccgaatctccatggacaagacagcatggtggcatgccaaggctcaacgctcgctgtgccgttccaactcgatcgagtacgtaattagccacgcctaatcagttacttaggcgatgtacgtcaacccctcacgtgccgaccctctagaaggcctggcagaatcagagcggtaaacctatattattacaccttcgtcccccaaaaaaattatttataaatttttatgttcaatatttaattatttaaaaaaattatataaatcttaaaaaataagtaacatatagagtattatttaataacaattaaaatattaatcataagaaattttaaataaaacaaacagctaaatattggataaataatccacacaaataaatttttttttggaggatgttgtaaatgggggcttgactagtttggtccgacacgactagtaaaagcaaagcggccagccacgtctctcttctgcgtctnccaggtgttgtgtgtactacttctacgatcacgagcagcaagcaaagacaaggcgaggcgtgtgaaaagtgcttcaacgtgccagttttgatgtgacaaaaggggtttggctgctggttaattaataggaccagactgccatttgtcccctgagtaaggccgaatatattgggtgttttggttgtgtttgtgtaaatccgggcactacaatttgtcaatttccctgttatattacggaagcctgtctgtgtctgtgccgtccgctccacttcacacaactcatagatagtataagggccattttggattgatgccaaaatgtgccatgccaatttttttagtttgaatagtaaatatgatggtttagtttgaagccaaatgaatggtaatgcccatacttaatttggtataattctagaactttcttcaccataatataaaatttggcttccaattggtattaatctaaacacattacttagaattctaccctaccaaattattggtagtttcaaaacatgcctaggttttgtcactaccaatgttttggtatggccctaaaccaaacaagccctaagttcaaaaaaatatctaacctaaaatcaggatgagacataatttagtaagatgattatgtcccatactaattctatgttggaatttttggaacaaaggaggacaaacattccaataactcttcctttttaggatgactctgtaccgtgggaccgtgggagtgttgcattatcttgggaccgtggggggaaatttgcaccgatttttcgtttttagacattctttcgaggaatatccaattttgaggtttagaaccctagcaccttaaaagattttgagagttaagaaaaaaaaagattcaacacagaacatcaaaatgaggatccaatggattataactttatttatagtaagatatggtttctattttattaactattgcaaacatctcactatttgatgtgaacacttactacaaggattatttacttcttacataactatgttcacaaattgtgaggatatatatgccattctgatgtttggaagttctaaatttaaattagaattttgtggcgtttgaaattgtgaacttgaatatggatggaccgtatgcattagaaatatttatgctttagttattatgatgatgtcaaattagatgtaaatataaattatgtggtggaatagaagagaaaaggaaatagggggtaagaaatgaggattttagagttggaggaaatcttggttatcagaaaatggggacaaggacaaccctatttgacttttgggtgttctaaaataatggctattgctcaaaatgctctagggtacaacaaatggcctcatcttttttattatactgatgtttatcagccaaaatttgaatttttagccttaaatttgaagctgaattttgagttttttttcatcgaagtttacttttcagcctttacttttagattgctaagaacacgtatataaaaattttatttataaattacttttcgtttgcagatacgccgttgcgctaaaacgatggcttcaaaaataacttttttggccgtactattttccgtgagatactcggatgacgtgatgtacttgagtaaaacaaagatactaatccatcatctttttcagaaactctgtgtagtgtcacttttgtcaaatccgaaaaatgcattagcaagataaaagccatatatatatatatatatatacaatactctatacaagtactacctccgtctcataataagtacaactgtgaatatccatgcccaacgtttgaccgtccgttttatttgaaaaatttgtgaaaaaattaaaaatatttagtcacacataaaatactattcatattttatcatctaatagtaataaaaatactaatcataaaaaaaattcaaataagacgaacggttaaacgttgaatatgaatagggtaaaactgaacttattttaggagaagagaagtactataagggcaagttttataatagagaaggtggtcacatataattttgggtacgagtgaatgtcattcatgggccgg

SEQ ID NO: 10144 - DNA, 2111 bp, Oryza sativa
  unsure (1)..(2111): unsure at all n locations
tgtggacntttgatgacttgctattccagctcggtaccccgctaggtgtttgatctaacgactttcgcgcttgcgctgtgcgacagggtggggatcgacatgccgacgatcgaggtgcggttcgagcacctggaggcggaggcggaggtccgcgtcggcaacagcggcctccccaccgtcctcaactccatcaccaacaccctcgaggaagccggcaacgcgctcggcattctgcccaaccggaagcagaccatgcccgtcctccacgacgtcagcggcatcatcaagccccgcaggtgaaacaccatcccccccccccccccaacacactcccacacccacatgttgttttcaccaaaaaaaaaaagaacatggattctcttgtcttctggagcaatttttatctctcgtgttggagactggattagttaaatccgggtctttttttttagaattcaatttcttcgccttcttcccacctcacgttcttttcgtttctacaggatgactctgctgttaggcccaccggggtcaggcaagaccaccttgctgctcgcgttggccggaaggctcggcaaagatctcaaggttcgttcatccaaaaccaacttcttgcaaataattcaattccagatgcctgtatcccactataggcgcagtgtttcagcttctcatctctactagtagtactgctccagtacgtactaatacgaagaatgagttagccaaagaagaaaacacagagtagtacggggagttctttatttgggaaaaagaaaataagagatggatactggagtacgaattatactgggcgttcacacgttgttgatgagtataacgagatgcaattgcaggcttcaggaaaagtgacctacaacgggcacggcatggaggaattcgtgccggagaggacggcggcttacatcagccagcacgacctccacatcggagagatgaccgtcagggagacacttgccttctcggcacgatgccagggtgttggcagtcgctttggtaaattctacacgattctcagcagtagtagttgccttttttactgcttgcggattatgcgggattgcatggttggacgggcatgctaaaccaagttttcctttttcctgttgttttttttttcagatatgttgactgagctgtcaaggcgagagaaggcagcgaacattaagcctgacgccgatatcgatgcattcatgaaggtaaaaggatttacgaatccgaaataaaatcaacaagattttggtgtcctcttacttttgttaatttttctttttgaaacgaggactaagcattggttttctggtcaacttgttcaggcggctgcaatgggaggacaggaggcaaacgtgaacactgactatatactgaaggtgcatccatctttgagctagtgattaaattttaggtagaattacccaagaatttcttgttcaatgcattggacgttacttgttgcagatattaggactagagatatgcgctgacacgatggttggggacgagatgctgaggggcatctcaggtgggcaaagaaagcgtgttacgactggtgaggattgaactccaacacaaattcagattgagactaacggctatgaatgaaccacggtgtgattattcctattttgatgcgttctgtaggtgagatgctggttgggccagccagggcgctcttcatggacgagatctcaactgggcttgacagctccactacattccagatagtgaattcgcttaggcaaactgtccacatcctcggtggcacagctgttatctccctgctgcagccggcgcctgagacttacaacttgtttgatgatatcatcctcctctcagacggtcagattgtgtaccagggcccccgagaggatgtgcttgaattcttcgagtccatggggtttaagtgtcctgacaggaagggtgttgccgacttcttgcaagaagtatgttcatatctcactgttcttttttctatgaacacataaagtacagtttttgataatatatgtttgtgcaaatgccgagcaggtgacttctaagaaagatcaaaggcagtactgggcgaggcatgacaagccctacaggtttgg

SEQ ID NO: 10145 - DNA, 1951 bp, Oryza sativa
  unsure (1)..(1951): unsure at all n locations
aggtcactcattgcaatgacactcttcttccgtacgaaaatgaaacgtgattctgtgaccagcgggggcatctacatgggcgcactcttctttggtgtgcttatgatcatgttcaatggtttctcagagcttgcgctcactgtctttaagttgcctgttttcttcaagcagagggatctccttttttatcctgcatggtcgtacactataccctcatggattctcaagatcccaatcacgtttattgaggttggtgggtatgtgttcttaacatactacgtcattgggtttgactcaaacgtgggcaggtgagatttattgagattatatatttcacaggtgtataatcagctatatcttactatagtgctgctctgcattgttctgagagtatttgtcttttttttgtttaccccagcttcttcaagcagtatttgctcatgttagcaatcaatcagatggcgggatcacttttccgattcattggtggggcagcgaggaacatgattgttgcaaatgtctttgcatcattcatgctgctaatttttatggtattgggtggattcattctagcaagaggtaaatgctcaccattatctgtctgagaagtgcttggtttgcactttttatcaaaagctaagtgttccattctgttcgacttgcagagcaagtgaagaaatggtggatttggggctactggatatccccgatgatgtacgcccagaatgccatctcagttaatgaactcatggggcacagctggaacaaaattgtgaatagctctgcctccaatgagacccttggtgtgcaagtcctcaagtcccgtggagtattccctgaagccaggtggtattggattgggtttggtgcaatgatcggcttcaccatccttttcaatgctctcttcacccttgcccttacatacctcaggcgtgagtataccttgagaactgatttgctctttttcctagagttggctatatccaaacatgagaatgatttcatcttgtgatttacagcatatggaaattcccgtcagtcagtatcagaagaggaactgaaagagaagcgtgccaatctgaatggtgagattgtgggtgacgttcacttgtcatctggaagtacgcgtaggccaatgggaaacggcactgaaaatgattcaacaattgttgatgatgatactgaggttactcaaagggggatggttctcccatttactccgctttcactcagctttgacaatgtcagatattctgttgacatgccacaggtaaaatatggaagaactcctaccaaatcaggaattgatcattagtttgcatttttctaactttcagcgtgaaattaatttcaggaaatgaaagcacaaggtgtagctgatgaccggttggagctcctcaaaggtgttagtggttcattcaggccaggggtgttgactgcactaatgggtgtcagtggtgctggcaagacaacactgatggatgtattggctgggagaaagacaggtgggtacattgaaggaagcatcaacatttcaggatatccaaagaaacaagagacttttgcacgtgtgtctggatactgtgagcagaacgatatccactcaccgcaggtcacagtctatgagtcgctacttttctcagcatggctccgtcttcctgaggatgtagattccaacactagaaaggtccgtcaaacatttttttttgctattcctacctatacttgatatagatagatagtagcttacctttgtgtatgcagatgttcattgaggaggtgatggagcttgtggagctcaagtcactgagagatgctttggttgggcttcctggagtgaatggtctgtccactgaacaaagaaagaggctaacaatcgcagtggagcttgttgcaannnnnnnnnnnnnnnnnnnnnnnnnnnnnnnnnnngtagatcatcatgggccac

SEQ ID NO: 10146 - DNA, 1329 bp, Oryza sativa
  unsure (1)..(1329): unsure at all n locations
aggaaangttagatctctcatannnnnnnnnnnnnnnnnnnnnnnnnnnnnnnnnnnatattacattcattgagttgcaaacgctacctgaaatttgtgcatatcattggatctaaagaatttttttttgttgccattagaatattgtaaatcataccagcctttcccccttatttttatagaaagattgtactactgttacccctagtaattttgttattagtacccttctttttatagaaagatggtactacttttatttttaatttttatatggggttgtctagtgttcagttgactgaactcacattttgctcgatgtaaatgaagaacagttctgctgttcgtcactactatttttgttaattgtattgcccagttttcctcaacaactctgccctacaaaattgtgaaatagtgatacatagcctgtatatatacatccgtaagcatttaagctcacagagctcacacgtaaccggagaaattcggccgccgattagatgatcctaaaatcgttttttcttttgcggcacctaaaatcgtatttaacgtcgtgggttttggaccctgtttagaagattagcctcatgaaaacaaacagtgcccaaatataatgatttaatgatcctagagtgatatgtttggatttatgggctaattgagggctaaaagatagagagagagtagagagagaggggctaatgtttttgaggggggctaattcacttaagtcccaaattagcttacttgtttggattcttaaggactaatttatggctaaaaggttagggctaataattatcccacaaaaacaaacaggcccaaatataatgatttaatatgctgggctaatctgccttttaactttgtaggctattttcaaatctcatcaaacctacctccaggctccagccgcagtagtcattcatatacgatctggatcccataaattcgaggagcagacttgatttctgattttgctcggcaccgtgaattacttgctgaggttttgcttttgcctattggatggtttggtatactgtagtgcgaaccagcgtgtgattcaatatgaatactccctccgaaaatttgaccctaaaaatgaattaaattttcgaagcaggtcaacacattccacacgtgtcaaggaatgtaacagcaaccctggtacacgaccaaataaattaacatgagaaaaacagtgcatcaaacacccagagaccttctagaatcggcactgtacatgaaagccattagttctaaaaaataaatacatgaactgatgaaagctcattcagaccccacctgtcagtctcaccccagccc

SEQ ID NO: 10147 - DNA, 2315 bp, Oryza sativa
  unsure (1)..(2315): unsure at all n locations
ccggcgcccggttacataaccccccttcgcctcggcgtcgtcgtctccaaggcttccctcccatcccaaaaccagcgcaagcgaggcgaggagtacgtagtggtaggaggtggcacgccgcggcggcggaatcggaatcgactagggagatggatgcggcggcggagatgcagaaggtggtgagcctgaggagagggggaggggggtcgtcgtcgcggggggcggcgtcgatgtggtggagcgcggacaacggggtgttctcgcggtcgagggcgtcgtcgagtggggaggatggggaggacgacgaggaggcgctgcggtgggcggcgctcgagaagctgcccacgtacgaccgcgtgcgccgcgccgtactgccggtggtggaggagggcggcggcggaggggaggcgggaaagaaggtggtggacgtgctcagcctcggcccgcaggagcggcgggcgctgctcgagcggctcgtgcgcgtcgccgaggacgacaacgagcgcttccttctcaagctcaaggagcgcatcgaccggtgcgtactgtgctgtaccacactgcgtcacgatgtcgccgtggcggcggacgcggttgcctgcagggtgtttgatgattagcgcgtggtaattttgatgtgcagggtggggattgatattccgacgatcaaggtgcggttcgagcacctgaagccgaagccgaaggtccgcgtcggcaacagcggcctccccacggtcctcaactccatgaccaacaagctcaagggagccgcgaacgcgctggggattctacccaacaagaagcagaccatgcccatcctccacgacgtcagcggcatcgtcaagccccgcaggtgaaagaaagaaaaagaagcatcacgttttcaaaattgcttatgctttatataacgttacgtgtgtgctgctctcatggtttatttgcgattttttgaagcattgtaagatatttgcttgaagatatttttgtacgggatgccggttcccaggaaacgaaatgcttttcaattagacatgtccctgtaaactgtaaagttgatttgtctttgttggagcctagattaaccaagatcatttggaatttaacttctatgcttctcctataacacgttcttttgattatgcaggatgactctgctgttaggacctcccgggtctggcaagaccaccttgctacttgctttggctggaaggcttggcaaagacatcaaggtttcaaacaaattttatttacttattttgcaataactgcgatataacgatgcgtttgggcgtttggcaaaccagtccatattcccacagatgtgtgtacttcatctttaatatattgtatacgattagcgaaaatacagagaacatacttttagagaattaatgcataaaggcttacgcatcattgcattaagttggtagaaacaaacaaagttcgcatgaacagataacttttcttaggtgacatgtcccaaaaactgtataccttgctcttgagtgatattactgataactgacatacacaatgcataatggggggaaaactaatttgcagttctctggtcaagtgacttacaatggacaccagatggaggattttgtgccacagaggacagctgcatacatcagccagcatgatcttcatattggggaaatgactgttcgggagacactctcattctcggcacgctgccagggtgttggaagccgctttggtatgactatgtgcaaggaacaaccacaagtgcatgcattcttttctgcagaattcgccttttgagaaaatcgtcatgggttgactgatacttatagagttctcttgttatgtcattagatatgctgaccgagctgtcaaggcgagagaaggcagcaaatattaagcctgatgctgatattgatgcgtttatgaaggtaaaaattgcaaatcctatataaatcagaattattctggtgtctgtagatatgattttcatacgaggtatgagtgaagttttgctataaattttctgtcctaacttgatcaggcttcagcgatggagggacaagagaccaatttgattactgactatatactgaaggtacatgcatctctgagctacaatagctactacctccgtttcaggttatgagactttctagcattgcccacattcataaagatgttaatgaatctaggcacatatatatgtctagattcattaacatatatatgaatgtgggcgatgctagaaaatcttataacctatgtgcctagattcattancatatagggtnccgagtggatgagcaggtcctaattnggcaccg

SEQ ID NO: 10148 - DNA, 738 bp, Oryza sativa
  unsure (1)..(738): unsure at all n locations
cgcggnncatttgaatgccagctcggtacccggctatcactctagagtggagaaagggggatgcgctgtaaggctagaaaaacctgatgaggcagggggcatccagcaacgactgtgtgaaacgaccgtcagagaattgtaatactactcactatgagagacacaatgtcgaactgacgaccctgaatgattgcatcgatgacgtgccaagccacccccctaatgtcatcattgttgccaatgcgagggaggataatggctctcacaatcatgttaaccacactggggatagtcctcaagccggcaaccttcccatgtgtgtaccgtgctccatcttcatagaactgagagagatagtctatggagaatgaattgtgagtgtgctcctcatgcaaatcatctccaaaatccaagcgaatattgaggagccgccggaactacctccgagagatagaacactagagggtgtcagacatccacttcatctcactatagtctccagccacccacactgtagcataaaactgtcgaatcaattcttcattgtagtcttgcttaagggtcacaatccggtcaatgccaacagtcttgaagagataatgcaagctctcaaactctggagtctcattgatgtctctccaagaaatccacttatgctctgcaaatgctttccctgcataaacctgctcatacacagtcttcttggaaagcgtgtgaaaacggagatccggagtgtcn

SEQ ID NO: 10149 - DNA, 1068 bp, Oryza sativa
  unsure (1)..(1068): unsure at all n locations
cgcggccattgatgacactcggtccatggctgtgtttctaaactacctggatgatttgactaatatattttttgcttgcagcttttcctgatgaagcgaggtggtgaagagatctatgctggtccactaggccatcattcttcggagctgatcaagtattttgaggtaagtgatattacactaattctaatatacctcaatgacatttcttcaaaattactgattcaatcgcatctttgtgtatcatccagagtatcccaggggtcagcaaaatcaaagatggctataacccagcaacatggatgttggaggtgacaacaattggtcaagagcaggcacttggtgttgattttagtgatatatacaagaagtctgaactttaccagtgagtaacttgcttttaatcctaattgttgtttcatctttctgcaaagcaatttttttttgcaatatgccatgtaacactgattgctaccttattcaggaggaacaaggccttgataaaggacctgagccaaccagcccccgattcaagtgacctgtatttccctacccaatattctcagtcttctttaacacaatgcatggcttgcctgtggaagcaaaacctgtcatactggaggaaccctccttacaatgccgttaggttctttttcactactgtcattgctcttctctttggtaccatcttctgggaccttggcggcaaagtgtaagtaaaatgccactttctatatgcaaagagggtgtacctaagaaatcttattcatttcgtgcttcttaatccaggacgaagtcacaagacttgttcaatgccatggggtcaatgtatgcagcagtgctgttcatcggtgtcatgaactgtacatctgttcagccagtggtggccgtggagcgcacagtcttttaccgtgaaagggctgccggcatgtactcggcgtttccatatgcatttggccaggtgaatggtcctcctgcaactgacattgagtcctggttgttgcatccttgagatccagatactattaagtgggtnccgagcgaattacaaggaantcaaagncgcgc

SEQ ID NO: 10150 - DNA, 993 bp, Oryza sativa
attgtgcctagtttcattaacaatatatgatgtggggcaatgctagaaagtcttataatatgaaacggaggaagtacttacttcagattggattaagcaaattcgttttatttactactttacatatgtaacatgttgcagatattaggactggatatatgtgcagacacgatggtaggagatgatatggtgaggggtatctccggtggacaacggaagcgtgtcaccacaggttgaaaaatagaatttcactttcagaacatgggatttgctggacaatgttttgattgactgtttcttcccaggtgagatgcttgttgggccagccaatgcacttttcatggatgagatatcgactgggctcgacagctcaactacatttcagatcgtgaagtcgctcagacaggccatccacatcctcggtggcacagcagtcatctcgctgttgcagccagctccagagacatatgacctatttgacgacatcatactcctctctgatggtcagattgtataccaggggcctcgagagggtgtgctagaattttttgagttgatggggttcaaatgccctgagaggaagggtgttgcggacttcttacaggaagtgagtgagtctactatcttcaaaaatgtatatgcacaaatttatcggttatttatcaacatggaaataccgaacaggtaacttccaggaaagaccagaagcagtactggatgcagcatgacaagccctatcggtacgtgccagtcaaggattttgctagtgcattccagtcgttccacactgggaaaagtatagcaaacgaacttgctactccattcgacaagagcaaaaatcatccggctgcattgaccacctcgaggtacggtgtcagtgccatggaactgttgaaggcaaacatcgaccgggagttcttgcttatgaagagaaattccttcgtttatatcttcagagcctgccaggttgttagggatccattcaaacaaatg

SEQ ID NO: 10151 - DNA, 729 bp, Oryza sativa
  unsure (1)..(729): unsure at all n locations
cggcccttagatgctatccatctgccgccggcactctagaggatcccccggggcggtgtcgagggtgatctcgtcgtgcctcctcgacgccgtcatccgctcgctgcgacgccgcttcttctaccagcgctccctgttgctgccggcgccgaggcctctcccctcctccctcgcactcctcgccaaggtctccgtcgccctcgcgatccaccagtgccatcgtccttgcatgctgctcccgccacctccttgccggtgagtgcaggtgggtcctcctccaccaccgcagaagaagaagaagccggcggtctcagtgcctctgtcaccgcaacaccggcgacaacctgctctagaacctctacctcctctctttcgccatcaacttcaagatgaagttgctgaagcgcagttcctggagatggtcaccgccgacttccggccggacctcaccatcttctgcgtccgtgccacggccttccaatagagtttctaaataaatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10152 - DNA, 1450 bp, Oryza sativa
  unsure (1)..(1450): unsure at all n locations
agaacaagcctgaaaaagcatgcaataataacgaaatcatttcacacacaagaaagattgctcaaactaaaactaaggaggttctgactaagaggaagggatgagcagaaagcgatgcatctttctagaaccatcaacatctcaatgtatagatgagtgtcaaatcgagacttatacaagttgaatgataatctgatgatgcatctatttgatgctagctgttgctgttcaatcaaaggttcagttgtagcttgcttctcagcatatgttgtgatctgctttcttcttcgtgtatgcaacatcactccttggcaccagaaggttgctgagcgtcctcgctatcttatatacctatatagttcattctcacttagtttatgctattttttttctctcattaagttatatcacattaattatttttagtctttagatgattaatctatggttcgaattatcttttttttctctcattaaaccatatcatctcaattttttagcccttagatatatggcctaaatgatctttcttcttttgttctttcataaaaccacatcatcttactttcggtggcggagccaccatgattcccgggaatacccaacactttttatcaaaaaataagtatacttctaatatatacacatgtacacatatttgtacacctaaatcctcaactcttttatccaaacacagcccaactagtctcttgcgatgcctccaaccaacccgacccactccatcatgacccatcagacatcaattgacccacttagccaccacttttccagacagccccctctcgctctccctccatgacccatccctccctagctcggctccctcgcgccactccccatttgcaaaccctaggtggcggcgcggcgagacagcaatcggcggcgggagctagaccgtgctaccgtggagggggaggccattgccacggcgggcagcgcccgacactccgccaagctaaggcggtcaggtcggttgggtggccggcggccgcgagaggcagggacgggcaacggctcagcgcttagacgggaatacccaactttgaaatcctagctccgccactgcttacttttctatttgaatcatcatcttacatactatttaaatttaaatcacatcgaatgatataaacttatgtttttatgtttgtgtaaacttatgttgtttaagcaatcttacatattaaaatacttaatattatagtaaactccagccggggttccatctttacatagagttcgtttgcccagttggnnnacttggtcgttcagattgggatcaaaatgagatgacgtgatggagtagccatcacnatatactattaacgctaccattataccattagcgnttaacgtataaggttataccataaactgattcagaatacacattagtgttggacgcattagtacgtatcgacttgctgct

SEQ ID NO: 10153 - DNA, 3786 bp, Oryza sativa
  unsure (1)..(3786): unsure at all n locations
tgatgtgncnnaatgngtagtcgcatatgcnnnnnnnnnnnnnnnnnnnnnnnnnnnnnnnnnnnnttgtctacatgtcatgccatgtaggcaagatcacgatcaaatgagactttagaccggaatgatacaataaaccaagtttagagacttcaatacacactttgcaagttcgtggacctagatgaaacctgcttaccagtttaagaaccgtcaatgtaatttactcttaaagctaataaaggagatgcatcagtgacgcacgaggttgatagaaggcttgcagaggcacctccttgggcatggtaagaccagatccctcggtcatgtctactagctcctctccaactctttcccactcaaagcactgaatcattgtcccaagggcaagacctaccatttgcatgcccaagttctctgcagggcatttgcacctccccatgccaaatgggattgccatcttcccttcacttcttccattctcaaatctatagaaacataatatgctataatttaatacgcccgtacatatatatagcatttttgaaagaaattgataccgatacctttcagggatgaagcttgttggttcattccatacttgaggatctctgtgaatggcaaatgtgtttacaagaagcattgtcccacgggtaatatgaaaaccagcaattgaacaatcagtagacgcttcatgaggcacaagaagtggcgctggcgggtataagcggagtgtctccatgataatgcactggaggtattgtagttttgtgaggtcactcgcctctagtagcctactggttgtcctatgaatgcatcaatttcgtcacgagcttttctcatcacattcgggttgtttagtaggagagacattgcccactcaattgtatcagctgaagtatctgttccggcttcaagggaactctggagaaataaaaaacatgacaatattatcattttgatatatttatcatggaaatatttttcataaaaagattaaaaataagatgcatgggaatatttttcatataaatctaacattatcattttgatatatcactattttagaatgaaggaagtatgttttggggaatattatatacaattggagttttcttctaatattgtagatgcaatttagttatatatatgtgtttgtggaatgatatgtgatgatataatttatattgtttacttttttcacaattgtccatctatttcgatatgggtcttgaactattaatttaatcataatgaacacaattatgcaaatggattaaaaactggatacttatgcaaaattcaaaagtaatggtttgtttaaaacccatcatgcaaatcatggtttatgcatgggtgctgcttgtctaggtgctcaaggaggggagaaattaaagggatgtggctttgcaacccccttttgagataaatttcaatgatccgttcaatgatttaagtggaaactgaagtttgaattattttttttcatttctagattttctttattagaagcgccaatacaagtcatacaaatgggttagtagatcatagtttatttactccatctatttcatattacaagtatctttgattttttttccttagttaaacttctttagatttgattatttttttaaaaaaaatagcaacatctacaatatcaaattaatttcattaaatagaatattgagtatattttgataaaatgtttattttatattagaaatattgctattttttgtaagctttaatcaaactctgacttagaaaaaaaaatccaaacgacttataatatgaaatggattatgaaatggagggagtagatacgaggggaagaaggtggcgagcgcggcgtgcacacgtgtatgggtggtgtgtatgcggtggtatgggagtggagaggggcgtacgtaatctatgtgtgcttgtgtgtgtattagcagctcacgtgacatcatacactcgtttgattgcaatcactttttttccactatatgattggtactccctccatccaaagaaaaaaaaagccaaccatgtgtcctcttctatttactacgaatctagacaaagggctgtctagattcattgtattagtagggatctcctcctaggttggttttttttgaacggagggagtaactctctatttatatctcttccttattaacttttgtttcttttcttatctacttgtatgtcttaatttggccggtatttttttcaaagatttaagtacataatcagtcctcttgacctagttactatgtactagaaagattatagtgtaagatttaaaattaatagtataagttttcaaaattataccatacatatttgaaataacaatatatatataaggtacaaattatacaatgtgaacacatgttgcaaaattttgatcccgacccttttgtgaaacatataatttggcatgtgaatatatatgtagaaaaacaattacgatgcacaatgagcggatgagctggtcggggcacgcgtcggggtcctgcctctgcaccgagaggagcacgccgatcatggtccgccgcctcgccgccggctgcgcacggtccgcgccctgctcctgctccatctccttcctctcgtcgttgatcagcccctgcaggaacctcgtccggctctcgcgcagccgccacagccgccgccccacccctcccacgtccacccaccggagcgccgccggcaggaagtcccacaccgtcgacgcgccgctcagcgccatcgtctcctccaccatctccctgaaccacctcgcctccttgctcaccttgccgtcgtcgtcgctacacagagttataccagatccatggtggttaaccaaaagaacttacgagtcatgcatcatggtgatcttacgcgccgtagtaggtcttgtcgcagatcatggccatcatggtgttcatgagcagctcgaacagccgtgacttgagctccacccgcacgcgccctgtagccgccccggcgccgtggcgctggcgcgacgccgggcgggagaggcgtctcgccgtggcgcgcgccttgcggtcgtgggcgccggcgaactgccgcacccggtgcgcggagaggatctcggcgacggctacccggcggacgtggcgccagtagggcccgtaggcgccggtgcccatggtggaccagccgtaggacaggatcccggccgacggcaggcgggggcggccgacgaacgcgacgtcgtgcgcgccgaggcactcctcggcggcgggcgcggacgacacgacgacggcgacgcggcgggatcccaggcgaaggcggaacacggcaccgtggcgggcggcgaggcgcgccagggtgcggtggagcggcttcctgaaaaggtgcaggtggccgacgagcggaaggcccggtggctccggcggcagccgcagccgcagcctcccgcttcgccggcgtcgtgcggtcagcagcagcagaaggaggacgagcgtgagagcgatgagaagagtgcaggtgtccatggatctgggaactgacgattattgtagcagttgcagttgcagatgcggcaattttttcagccatgcagacacatcgtgcacaacccgccagacgaccccatgtggtgacctgccactaccggcttgattagaccagccaagcagcaaggcccaatgtccaatgtccaatgtggaccatgaaatggttctaattttagttaattgctattttttttttattttaaataaaaaaaggggatcctctanantcnnccgcngggcagcgagcatagattcacaagggacg

SEQ ID NO: 10154 - DNA, 2354 bp, Oryza sativa
  unsure (1)..(2354): unsure at all n locations
ccaccgtggcgcgcgncaaggcgcccaaggttcggtgaaacgtcttcctaaaaaggtgcagttgcccgacgagcgggaggcccgcgggctccgacggcggcgacggcacgttcccggcgcaacgctgcgtcccgcttcgtcgtactcgggcggtctccataagcgcgatcagcagaaggagaaagagggcaatgaggagggcgtccatggcggcgaggtgaactcgacgagcatgtcagtgacagtgtacatatatatgcttccgccactggtgtatatcgctttgctgaaatgcaggcttctgaaaatctcaagtataatcaagtggtactagcaagttggatcaccaaactactaattcgtcaaacataacacgggacgcccaattgcccaattgcaattgtgcaagtgccaaagcgtgtgtcttggttttctcgaaaatgctatacgttcaaccgacgcgtacgaccagcgtacggctacgtcggccaagcgtacggctacgtcattggccgtctgccgtccgtaacttctgcaacgatcgctaattcaattgggtttacaccgtgtatttcgccgttgagtcgtacgctggtcgtacacgtccgtcggatgtatagcagagttgttgttttcttcgctaatcaaaaggtgtcgtgcacaatgtgtgccataacaaattttttttgttttattacttagttaattacagggcagcttgcattgtgattcagtactctctccaatcacaaatgcaacacgttttttgcatgataaaatctttgaaactttcatttattattcctactccctccatttcatattattaattgtttggcttttttcctagttaagtttgacaaagtttatagaacaatttagcaatatttaaaataccgagctagtttcaaaaaatttatcattgaatatattttgataatatatttgttttgtgttgaaaatacttatatatttttctatagacttggttaaacttgactaggaaaaaagtcaaatgacttataatatgaaacaaagagagtacatgtttttgaaagtttgttctctgttcttatgttcttatgagtagtccaccacaagagtgttcttatttatggcttttgagacgaagagatggacttactttcattcttgtttgtaacaaaaacaatcctatcatttgtgaagcaataccttatcatgccagttggatcaacgatcacaacacatttcgatattgcgctataactaacaaagcctaagaaagaagatgcatcactgaagcacgaggttgatagaaggcctccaaaggcaccttcttgggcatggtaaggccagatccttcagtcatgtccaccagctcctctccaactctttcccactcaaagcactgaatcattgtcccaaggccaaggcctaccatttgcatgcccaagttctctgcagggcatttgcgtctccccatgccaaatgggattgccatctttccttcacttcgcccatcctcaaatctgtagaaacataaatgtacgtaattacactttatataacatggacattcatgcaatagtataaaatttttggaagaatccatatgtagtacctttctgggatgaagcttgttggttcatcccatatatgaggatccctgtgaatatcaaatgtgttcacaagaagcattgtcccccgtggaatatggaaaccagcaacagtgcaatcagaggatgattcatgagggacaagaagtggcgccggtgggtataggcgaagcgtctccatgatgatgcatcgaaggtattgtagcttcgggaggtcatctgcctctagtaatcgtactggctgcccgatgaatgcatcgatttcatcacgagcttttctcatcacatcgggattgtttagtagcagagacattgcccactcaattgtatcggttgaggtacccgttccggcttcaagcgaactcttgagaaaataaaaaaaggggaaagtataattatatgtaaacaaaacatggattgtgggttcacataaatctcattcctaagtagggttcacaatttccccgcaaaaaaaaagtagggttcacaattttggttcaaaatttgtgaattttagtttgtgtctacacgtgggttgtgggtcccaatatgatgttcttcgggccaaagaaagtattgtcaaatatagcaaaaaagacctattcaaagtcaggaaaaaagatgtgttcaaaattcaaaatgttttctttaaaatttctgagagttttcctaaataacaataattgtttgtgtgatgcatggggatcctctagagtcgncgtgcaggaatgagggcataagctactcaatggcgcg

SEQ ID NO: 10155 - DNA, 5731 bp, Oryza sativa
  unsure (1)..(5731): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgattattgtagcagttgcagttgcagatgcggcaattttttcagccatgcagacacatcgtgcacaacccgccagacgaccccatgtggtgacctgccactaccggcttgattagaccagccaagcagcaaggcccaatgtccaatgtccaatgtggaccatgttctggttctaattttgtttatttctatttttttttaatttaaatagaaaaaatatccgtgcgttgcaacgggtgaagactattttaattgtattattgttagatttttttttgtctaaaaagtatatgggatttttattttgatatgatatccaattcgaaacccttgtatttttaaaagcaaacgaattttaaaaccaacttaaatacggacaacatactaaaactatcagcggaaacaacttcacagcggaaacaacttcagttttaataataaatcacttaatcctaaatggccgaacggaatcatatgttgaaaaaattatgttaaaaagaatcatgtgtagatgaatccttcacaaaataaacggacatgcatgcaagccacccatacaaaaattagtatgtttttcatttgcatgtgtacaaaattattgaaataacacaaacaaatctgtaataaatagtatgtaacatatgcttagaagataggcaatatttttcactgagacagctcgaaataggaagacagattgtgatagacgttgggcccttttacaattttaggcccatatgtgcaaaaacgtattggatgtgcagagaaaaaaaaaaaggaaacgtgaatatggtcaaaatgctaaaaacatatatgaatcggaacaagacggcttgttggaatgaagggacggcggacgaaaattcgatgagtataaaattatcttcaatttttataataggtaaaggttacgacggaaacattttgttctcttttgaagcatttttttgtttttttttgccttttattattttggatggatttttttcacggactggtggactgccttttttattgttgcatacaaaacaaatctttattttttgtttttttgaaggaacgaactttttttcgccgctctgggggaatcagacttttcttctgggggactttttcactcttttttaattttttttacggatggtttttcacctttcttagttcttacgaggaatcggacacgttttctttttaaggcggcccaattaattcgctcagatggaaacattaaattaaaacctatttaaacacgggtgacctactaaaatctcgataaaaacaccttaaatttttataatagtagagatagagataaagaagagatagagatatatggtttagttaagatgaaacacattgtgttaaattcgtttggatatatattttgttagaaaattatgagttgtaattagagtccaatcatctcaagttaacctgcgagttttttaaacagatttcttttacgattccttatatatttacaaaagcaaacgaacttaaaatcaactcaaatatgaatttgtatttataaaggcaaacgaatttaaaaccgactcatacacggatgacgtaccaaagtaccggcaaaaacctctttaatttttataatagtagagatttagagttttttcatctcatctctgaaatttcttttccctaacatttatttccttgttcatttttccttttagcgttcactcctacgcttggatatataatcctcatgtaccttgagatattacgtactccatctatcccaaaatatgagcagttttagctctaaatttaaacaataatatatttataggtaaaagttattatattttaggacgggcttagtagtcatggtcgatcataattgataagaagtactatcattaaaaatttacacatatcatcattggtatctaacagatatcattgttgataaattgatatttatcatcaccggtacctcacgtgtatcatcagtagtacgtacatgtatcatcgtatattcattggtgtttacatgtatcattaccagtacttcgcaagaatcattactgattcctacatttagagcgtccccagcagatctttcatccggtactccatccgaaatatagcgcatgagaggagaaaacggcgctccagcagatacggtatcaaggcctcaaaaaatagaggatgcaccaaatcagggagagttcggccaaatatggcgattctctctcctcacgccaaaccttattgcccgcgctcctgcccacatccggagttccggatcaactttcctccatcgcaacctccctttcgtcgtcgcccggaggtatggaagtagagaggagagacttactggatctgccggcggaggctcggagtagaggccgaggcccgcccgcccgttcgccgcgggatgccgttcctctgtcggacaaccgccgcccgcgccggtcattcctccgcccgcaaacccgccgcccgcgcctgcagccatgcggccgccgcccgtcgctcctccgcccgcaaggccgccgcccacgcccatcgctcctccacccgcgaccccgccgcttgcgcccacgaccccacggccgccgcccgtcgctcctctgcccgctccgccaccgcccgcgcccgtcgctcctccgcccgcgaccccgccgccgcgcctcgccgcccgaaaccctcgcccgtgaccccgctgcctccggttgtccgctgagggaagagaagaggagagcagtagtagagaagacaagaggagagcagaagaaaagagtagtagtagctgtacacgcggctgctatattgattttggaacgtttacaaacaaataacgattttacagtgtcccatatcattttatttgtgttgctatgattttttttttgctatgattcactcaattcaaatataccaattaaaaattaccagttaaaattatcactgttaaaattatcgtgataaatagcaccgcgttaaaatttagttgttcaaaatatatcccttaaaaatagaaatgtaaagttagttaaaagatattataaaaaattggatatggtatagatgatctgctggagtaggaaaggatacgagtgaggaatcttttttggatggctatccatatgggcatatggaggatgagatttggatgagctgctggagatgctcttatggtcattggtacctgcatgtatcattactcctacctacatgtactatctgttatccgatactactctgtcaaaaaaaaaacgaattcctagctatgaaccttgacacatataggattggtcttttttttaggacggaggggtaagcatcatcactcgtatttatatctatcagaatggatgttacggtatcatataggtgtcaccaccggtacctacaaacatcatcattggtatccgcaagtatgatcttctatatctatttatatcatcaccgatatttgacatacattattagacgacattgttagtgtatagaagtgcaaattttagggtcatatgtatcatcactttatataagcaaatgccatgatgtaggattgaatagtaagaactaagccaaccagaggggtggatgaatggatgtagtacctaaaaaccgaaacttttagcagaaataaaagttaccatcgaattcaatggagagctcgacgtaatcggtctaaccgccagatctactccaatctgactgcagtgccgccgctggtctgactgccgcattgtcgccgattggattgcctttctgccgccgcctcctcgctggttagaccgcctgtattacttcagtcaaaccgtcgggacctaggaaagcacgtatcgatgaaatacttaaaagtagatcaactttattgcatcaatatgtgtttacgaagtacaccaacaacactcatcaccaaaatctcgactaaactcgaaaccctaacttttctctcaactcaactctctcaaaaaccaatcccaagaggccacaccctccgtctctatttatatccaatataggcagcctaaagctacgaaccaaccttgtacaagacatcctaatccactagaaaacatgtccgtaaaaaaaaattaaactttactaactcgaattgtatcaaatttggacaccctccaaattcaactccgctttccatacgcacacaacaccacatgtattccatatggaaaccttcaccctcacgtgcattcttctctagattgaacattccgcgtgatatccttgacccgccggaccttaaccttccgattcctccccaagcctagtaccgatccatcaccgactatactcccatggcctcaagcaacacttgcacatgaacaacaactaaactccatatccgagaacaagttcgcactacttgactcacatcagcacataatagcatcacatacaaaaagaaaccaactagaaatcatatccatgaagcaatctagaaatcccacgagaacaacccgaaattgattcccacctagagtctgccggtctaaccgtcgggcaacacgatcagatcgctccaacactaccggtctaaccggcggcacctgcccggtctaatcggccacacaaagtcgagaaacgaaaacactattcaccttatttttataaaataattacttttgacaattgttcatcaccatgattaaatcattacatgactctacaatccctccgtgatgaacacattggcaaaatcctcaaaatgcaatttggtgtttttaaaaaatgaaaaacaaaaacaaataaaaaaaacacaaacaactcaaaaatcacaaaagcaaaaaagaaaaactctctcctttttcaaaagaaagaatttcttcccatattggcaaacaaagcacaaaatcgactattttttaaaagcaaaacaattcaaatccccccggtgacttggtaacaaaaaaaaattcaaatctccccctttgaaagcatgcattttgtatatttctccccctttgacaatgatttcatcatgcatttgcattttaattagtaatgttcaagagcttagcatcatacatagagcaattcatgttatgtgttgtaatagaaagaagatgaacccatcaattaaatagcaggcatgcactagagtataatcatgaatcaaagatattactatcaagttcaaatcaacaatcaatattcataatttcaaataatttataatgcaatatattcacaagcacataggtttaaaagtcaagcctacacatatctttctcaatattagctctagcacaaaacaaccaatagaatttgtaacatttatttgagcctttttgtttaactcatttttttctctcatttattctggaaacgtccttgtcatcaagactatttttaaggattcggcacccattattttcgctcacatggaatacgtccttgttgtcaagactgtttccaaggattcagtattcattttttttctctcataaaaattattttattctcttgcacgatgagaaaataaagagcaatttgaggaataagggatctctagagtcgaccgcaggcataagagttagtacatcaatggcaaggggccac

SEQ ID NO: 10156 - DNA, 825 bp, Oryza sativa
  unsure (1)..(825): unsure at all n locations
naaacttgttaatttcgggaactctatatttacgggaaaccgtcacattatcataataatcaggatcgccttttttgtaacctctagcacgattctagttttcactcccaattctatccttctaccatatgttctgcagcgtctccctcgcgctgctgacggtggtggtgacttctccggcgcttcgacggtgaagccaccttcgacgccgggaagtcggtagtcctctgccggggcccgtggccctcccgctggtggggcacctgcacctcttcaggaagccgctccaccgcaccctggcgcgcctcgcggcgcgccacggcggcgcagtgttcggcctccgcctcgggtcccgccgcgtcgccgtcgtgtcctcggcgcccgccgcggaggagtgcctcggcgcgcacgacgtcgcgttcgctgaccggccgcggctgccgtcgggcaggatcctgtcgtacgactggtccaccatgggcaccgccagctacgggccctactggcgccacgtccgccgcgtcgccgtcaccgagatcctgtccgcgcgacgggtgcagcacttcgccgacgtccatgtccgggaggcgcgcgccatggcgcgccaccttcaccgcgcggcggtccgccatggcgtcggcggggcggcgcgcgtacgagtggagctcaagtcgcggctgttcgagctgctcatgaacaccatgatggccatgatctgcgacaagacgtactacggcgagtaagctaaagatcgatcggcgatcgccatgatggggatcctctagagtcgactgcaggctgcagcagagatgtcatcaagngccg

SEQ ID NO: 10157 - DNA, 945 bp, Oryza sativa
  unsure (1)..(945): unsure at all n locations
gctggccnnattangatctcttgtnnnnnnnnnnnnnnnnnnnnnnnnnnnnnnnnnnttattgagcctagaacccgcaaaagtttttttaaaaacttccagtcctcattggctaagccaaaaaatcaaacaaggcaatgataaatcaagtaagcaaattgaattgataaaaatcacactccattattattatagtagcccccgactgataaatcaagggacaacttgatgttaacagtcaaagaggaagatacaaaagtaatgcctaagcataaaaacgacgaagatgttcaatattccaagagttgtcgatatgagtaccgtcttcacgcttgagtcggtaagaacttggccgagtgacttcaaaaattatgaacggtccttcccacaagggagataacttgtgccgatcctgtgtagtttgaatttttctcagaaccaggtcgcgactaaaaaagctcgagatcgaacattgcgattgtaataacggcgcatcccttgtaagtaccgagccgactgaattaaggctgcttcatgggcttcttctagtcggttgagatcatctactcggtattctccgtagcgctcctcgctgaagttacgaaatcgtagagattcaaattccacctcacttggcaacatcgcttctgctccatagactaggaataacggcgactggcccgtagcccgactcagagtggtgcgcagggaccaaagtacgaatgacagctgttctacccacttgccagcatacggatgcagtcggtcgaaaactcgtgcttttattccttgaagtaccataccattagcgcgttcgacttgtccattgctcatggggtgcgctacagaggcatatcaaattttgatgccgaagtcctcannnnnnnnnnnnnnnnnnnnnnnnnnnnnnnnnnnnnnnnnncatctattgtccaggggcgccac

SEQ ID NO: 10158 - DNA, 3463 bp, Oryza sativa
  unsure (1)..(3463): unsure at all n locations
tctatactctataggcttatcattagctggattcgcttatgcatatccacctcgtattagtacatggataatgctttantatacgtatatcttgttgtatagcgtccagtaatactcatcccagtattactcactgttgaatatcttttnnnnncctatcttgtattggagtcagccaaaacctcgataacgaagtagattggttgttggaatttttgaacatggccttcttcttcacgctcaacaaccaggactgtgcttacaacctgggaaggtgccgacacgtataacaacaacggctcttgcggatgtggtgaagctaagactggtggagtagcgagaagttttttgaagtactcaaaggctttttgtgcttcgggtccccactggaaattgttggttttctttaacagcttgaaaaaaggcatcccccgctcgccgagtcgagagacgaaccggctgagcaccgccatgcagccagttaacttttgaacgtctttctaggagctcagcggtttcatgttgaggatggcattgattttctccgggttagcttgtatgcctctatgggacaccataaatccaagcagcttccctgacggtactccgaagatgcacttttcaggatttaatttcatcctaaaagcgcggatgcttcaacgttgcggccgatctgagttgaaaaacatctctggatcatgcgttgataagttgctcctgcgttctttaatccaaaaggcatggtgatgtaacagtaggcctcaaagggcgtgataaatgaagtctttaagcagtcggattcctttagtcggatctgatgatatcccgagtagcaatccaaaaaactgagtagctcgcagctggccgttgagtcaactacctggtcaacgcgaggtaacccaaatggatctttgggacaagacttgttgaggtcggtgtaatcaacacacatgcgccattgccccgtcttcttccgaaccagaactgggttggctagccagtcgggatgaaggacttccttgatgaagcccgctgctaacagcttggtcaattcttccttgatcgcatccttcctatcctgtgcgaaacggcggagtcattgctttattggtttagcgtcatccttaacatgtaaagagtgctcaatcacctctctaggaataccaggcatatcagatggtttccacacaaagatatctttattattttgaagaaaggtgatgagcgcgctttcctatttacaatctaactcagcgcctattacagctgtcttagtaggatcagagggatctagaggaatcttcttggtcttggtgtcgctttccccgctctttggcatcttggtcgcaggcacttctccttcgcttgctgtggacgcagccagttggatttcttctcgggcgagcgtgatctcgcaggtctgggccatctcgcagctttccttgtcacacgtgacggcttgcttgatgtcactccgcagggatatgactcctcgaggaccaggcatcttcatcatcatgtaggtataatgcgggacagccatgaacttggctaacgctgggcgtccgagtatggcgtgatacgctgtctcgaaatcagcgaccttgaaacaaatgttctctgtgcggaagttctcccgagtgccgaaagtaaccggaagaatgatctggccgagtggtgtagtagatagccctgggatgactccgtgaaagggcacattactcggctttaattccgtgcgagggatctgcatgtcgtccagagtcttggcgaaaagaatgttgagtgcactgccaccatcgatgagggatctgcgaagcttgacgttgcgaaccactgggtctagtaccagggggtaccgccccgggtggaccactcggtcaggatgatccgagcggtcaaacttaattgttgtctctgaccaccgaagatattggggcgtgtcgggctgaacagcgttgatctcccgttcggttagcttttgctttctcttggattcataagccaggggtccgccaaagatgtggttgagttccttgcgatggtcttgaaaaccagtcggggcgttgtcttcatcatccttcttctttgacgtgctttgatctccgtcagaggccttgcgtgcattcttggcgtattgttctgcgaactgttgatagacgaagcaatctttggccgcgtgattggagtttggatgatgcggacattgggagttcatgatcttgtcaaaagtgttgacccgtgaatgttgccgggaggatggtgtagtagttgccacaagttcctcgggcttgcgatccttgtgattggtacttccactcccccctgtagtcggcgtatctttcttcggcttccaagtggtgcccgactgcttggacgcggtaatggcatcttcggctttggcgtactcattggctttttcgaacatctgcttgaccgtcctgggaggcttgcgcccgaacttgccgactaggtcatcgtggcgaatgcccttggtgaaggcagcgatgatgacgtcgtcggtgatgtcggagatcttgttgcgttgctcggaaaagcgtctgatgtaatctcgaagggattctctagacttctgaacaacattgtagagatcaaactgtgtactagggcgttcaaagataccctggaagttggcgatgaagtggtcgcgaagttccgcccaagatccgattgtgccacggggtaactcgtgaagccaggatcgggcagagtccgctagggccacaaggcaaatagtttgtcatggctttgctgtctcctcctgctgcgtgaattgcgagaccatagacggtgagccaagattccgggttagtggtgccgtcatacttctcgattccagtcggcttgaagccggctggccaatccactcgacgcagttcacttgtgaaggcagcaactccatccacgtcgtcgtcgtagcgatctggtgaatggtggggaacgtatcctcttgccgcgcggcgctggttgataatatcgcgaagatcgacagggcgcctgcgatgtggggagcgaggtcgttcaactcgacgctccctgtgtcgttcaggaggcgagtggacagatcgctcgtcgtgacccctgctcctgcgactagatcccgcgccgacgacactgaggcttggttggtgatagtcttgagatcgaagagggggaactcggctgccagtcggcgtgcggacgcttgcagagttaaccgggaccgagacggcgatcatgatcttggtctggttcaagatgttgacgacgtgattggcttgattgagtgcgtcttccttgaggagggtgtcgaggagggtgatcgttgcaactgcgttgngtacccacggaatacaaagcccaggnngnggggaggggggaatcataataatgnaacgaacactaantacactacaagaagaagagagaggggatcngtcagaaaacggatgaaatgttccag

SEQ ID NO: 10159 - DNA, 3125 bp, Oryza sativa
  unsure (1)..(3125): unsure at all n locations
cgcttagatctacggggagaagatgcccttgtgttaaagcagcagccaaatcatcggggagtttcatcaggattgccggataggccccatcgtcttgatcgagtcgtgttggagtagattggatctcgttcgagtggtttgaaaccgactcggtggagacgatcttggggtagatcttggccgagtttgggataccgaacggggcgaagatctggcttcttcccgactggttcgaatccgagtcgaggagagaaatcttgacgaggtcgttggtgatgaagtcgaggctgccgaaccggaacgcctgcctaggagggaagacgaagtcgtcgatgtcggaaacgaaacccatcgcattagtcggcgaagtacttgacactacccctacttggcgcgccaactgtcaaaacaagatttcgacaatactaaagggggtggctatcaaactggaaaagtggatggtttaagagacaaggaattttatacaggttcaggcctttttaatcaagaagtagtaccctactcatgtccggggattgatctgccaagtatattattgatcgtatgatctgggtgaaaaaacgtgcccctagaggcacctggaccctttcttatataaaagaaggggtccgtattacaaaatacagtccatatccctaacggaataggtagttacaaataaaaacaaatcgtacccgactaggatcttgggtattaccttaacatacaagtttagaatttaacccaagtcatttaaaagatattctatctaaatatagcactccatacccagtcaaactatacatgcagtgtatgtatggggtatccatgatctccacaattcatttgtcaagtaagtacttcaatagtacaattctgatagtgcgagcatagtcgtgaaatacgacattcacaaaaccgatgataactgctcgaaaaccacaggtatcatcagctttattgctccggctcaagctaaaagttcactaaaatccggtcaagtatataaaaactcaagctaaaacttaaattttgcattaaactgtcatctccgagctgttaacatcaaaaccgacaaatccaaatcctcgaatccttatgggaagcccatttcaactcaccttaaacagtcaatgggcccagccatctatcataaagcccaacaaggcccatgaaagcccatctcaactcagcctagggtttttttccactccgcggcgtctcgctgtctctctctcctctatatataagccttcgccgccgccttctcacctttttcccttcctagcaccggcgacgtcgtcgccgccgccgtcgtccggcgtgccgccttcgtcgccatgggtaagctacaacattccgttcttctctcctcccgctcgcctgcggatctaaccgtgcgtgtgtggtgcaacccggatcaaggtcgacgagctacgggggaagaacaaggcggagctgcaggcccagctcaaggaccttaaggcggatgctctcctcctccgcgtcgccaaggtcaccggcggcgcccccaacaagctctccaagatgtacgcgcttcgcgctcgcgctcgcgctcattctctcctctttctgtgtgcccttgtgattgattgaatctctgtggttttgcagcaaggtggtgcgcacgtcgatcgcgcgggtgctgacggtgatctcgcataaacagagggcggcgctgcgtgaggcgtacaagaagaagagcctcctccccctcgacctccgccccaagaagacccgcgccatccgccgccgcctcaccaagcaccaggtataagatttcataaaaccgtgcacacctactactgatatctaaaactcatgctgatagagattcacatggtgtcatcttccttcaaacttttagcttaacttgggctgttttgttttttttgcatgaaatgtgtacttactaccattgcagtagataacttagttaatgcagtgaattgttctgtactgctacatctgcatgctacaccattttgttaattctattagcaacgccattttgttaactgcgtggggtttcatcattgttggttgcttttaattgttagattgtacatgtaattgagatttttattatattacttgctataaaattgcttttcttaacaaaattgtgagaaatacaatcagttttgtcagattgtatgcatccctcatcgtcaatcacttcacagcaactactaggaaacagataaaaaaatggggcatcattttttcccatgtagaatgtggaatacatgagccctgggatgaatacatattgctcacgcaatatcaagatatatgtagttactttttttgtttgttttggcagttggtacttggctgtgcttgtctgcatatgatatataggaagatattaagagagaagggtagataaaggacttgtttgctgcattctttgaaaaatgaaggctcacctttttcaattcttatagaaacatgaagtcatttgtcatcctaaacttatgttcaattttctagtgtcttgtaatgaatctagttatgttatacttgcatccgtcttctgacattttccatggttgccatatcacagctttcgctgaagacggagagggaaaagaagcgcgagaagtatttccccatgaggaagtatgccatcaaggcgtaggtcagggaacatgagagaatgttatgtttagcacatcactcagtcaatttatctgccctcgagttccttgaattttgatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10160 - DNA, 714 bp, Oryza sativa
  unsure (1)..(714): unsure at all n locations
ctgtgccatagacctcatgctcgctgcctgcaggtcgactctagaggatcccctagagggagtcagtagggggattacagggtactagttaaaaatgagtatgtctaccaatctccatgtcttcgaattatgtccatatatttccaaatctgttgcatatttccaaatctgttgctcgatctggcatagtatttcagagccaagttataggttaatttgtattttgaaggccttatggcatcttcaatgttgacaatagaaggtaagcccgccttaaggtagatctcttaagcttaaggcacctacatgaattaaaaaaaatgtacacctaccttctctttccatacaatgtcgctccactctcttccacagtttttaaatgaaaaacatagaaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10161 - DNA, 1374 bp, Oryza sativa
  unsure (1)..(1374): unsure at all n locations
gcggcnnatagtatcactatnnnnnnnnnnnnnnnnnnnnnnnnnnnnnnnnnnnnnatcattcgctcaatatcaatatttctgtgcatttgtgcttcaagcaaaggtgaaacagagaggttcaagtgtacatggaaattctatacgatttaaaggactccaaagaaaggattagtgatagcagaattcagctcggctccagcagtgttcaagacggccttgtcaaccttgtcccttgccaagaacaagaactcgttgccttcaagtttctcaaatccacagagctggagaaactctatgcctacatgcagattgccaaccctctcctgcattgtaccgaaacagattataagtagcgtgttgttcttgaaaggataacagcggatcattttaccaggtcaatatgtacagtaattattttcacctgaaatgtagcgttggtcagtctgatcttcctgaatttctcctcgtcaggatttttagctacattgccaatgtaggtaaggagtgtttgaaaagccctcttcactttagcatcgtcatcctgttgcaaaaacggcccataattgggtcaaattgaatcccaaacatataatatgattatatcagcattgaatgattccactctaaaactacagggagaacacaatttttggtatagtttcaacaaacaatagaattctcaagtctttacagttgcatctgtattcacatgcaatgaaggatatgtgtcaatctgcctgacaaatatgagtaacatagaagatgatttcaagttaaaactacatgctaccttgttctgctgcttaagatttcttaagcaatccctcatgcgctcggcctttgtggctggcctgacaggtaatgccctctggaaatccatagaacagagttagatggcaataatgatttcaaaacattgtttatttatacaatctgcaattatattctttggcctactaagttcggatctaaaggcctctacaaaagctgttccaacaagaaatccattgactgatgtaaggcataagatctgaatgtttcctgagaaattcagaatcagataaaatttttgctcgcattcatctcagcgatttggttcagttaggcaattcaggttctcaagaccagtacagggtgcaagttcaaactggcagtaggttggtctaaatgactaaatttggatcaactgctaattatgaaaggaaattcggatcaactgctaattacgataggtgtaccttcttctctttaaccggaggtggtgcgcttggattaagagcaacttgatctttccggggccaacccaagtttccttctcccttccagcctggtaatttaaaaggaaatattggaggtttaattgcccgaatg

SEQ ID NO: 10162 - DNA, 2728 bp, Oryza sativa
  unsure (1)..(2728): unsure at all n locations
cgcgacctttgaatgcactggctacccatcaatnngaatatttgaaaaagatccaccaaaattataatattgcaaaggtgtaactggaaaatgccaagatcacatcacatcaaacataaaactggaatttgaggggaacaaccaatgattttcatgctttggtattagtgctcatcattatcttcaaatgaagggcatagcgtaatttgtacttgttgtctagtagaacggagacaaatgagagaaaattttcatctttgatatcaactctcatcagtattttcagatgaaaaatatagtataatttgcacttcttatccagcagcttatatcaaaataggggacagtaggctgaagtccctgtaaagacatgataacgtgacaaaagaaaacagcagataccatctataccttcaactctacatattacagcaacaaatttaagactagctcagtacttcagacataattgcacttccaagtaatcttatgcagatttcttcatacaaattgacaaatttgagatgagatttcatgaaacaaaatcaataagttccagcaaactatttgtgttatgttattgtacaagattgctggcaggtggaatcaaagttacatgaaaatacatcataaagggctattgattgtaatgactaagcataatgcatgtcttttttggatatgctgtgcaagatactgactaaaaacacatctaactgcacagaagaaaccagatatataaatgtgcttgaggtaatcttgattcatacatttctaaatacattaaataaggtaaaaagaagttgagaacaaaccttttccctttctctttccatccttctctcttcttcttttttctttttaccagcacgttccctacaaatcgagtgagtaaactcaatagtttagtaacaaaaagttaaaatcagaatcataccgccagatctgtggttgttccagtgttaatatgacaaacggagagcaaatattgaacaaagttcctgtttaaggcggtacgataaaaaagtgcacaatctgcatattgggggttatcatgtgcaaagaaaatacgtagggaatgtaataaaagtatagaacttcagggattaaatatgagaattctattgtcatttatattgagtttcaagtccaataaaaattatcatttttaaagcagtgaaaaaaattgtcgtaccaatgcatgcgattacaaagcccaaccacatacgacaaagcatacaagtacttaaatgtcaattgaactgatttcaacgaggaaaaggtagtgctacagacagacacaagtcaatgcaattttctgaagatatatataaaaccatcaactcattaaagataataagaaagcaataagttcatgaacacaccttaattcctgagctttaatcttcatttcctcaggagacaaagagggtttattagcctcagttattgtattagccggtacctgagagatgaaagaaggtaagtgtaaagttatgtactggagagcaaaaattttctggacaagtataggtattacacagaaagaatttatctattacttccattggacacaaataattgaacctctgaagtgggaggttagatatattcaaatgtgcaagtttggtcctagatacatgggcatacgcaggggaaaaaaaaccaaaatggacaacctatgccaatttttcaaatgtttgaaatgcgttttcattgttacagtaaatacattgagctgcacaaataataaataaatatagtaaaagttttgggtattactgaaactccatggatagaatgtcagaggtcagacagtgcaattcagtgtagcactacacaagcacgatgaaaataataccaaaataaccacttaatatccaaaacatattattttttcagcaaggggcaatttagcacaccagcataccaaaacaaataaaggtataatcaattaatcagcaacaaaaaatataaattcatcataccagaagcggttcgtcaatatctggatcttcttggtgctcggaaagccagttaatggcaccttcaatagtgctattacctagaggaaaattaaatgggtgcaaacaaagttatgaattaatcatggtttgcttactgaaggtgttatgtttatttaactaatatagatgagacaatcataatatataagtaagactgcaaaacgtagtcttattgacttctggtccactgagacagttttgtccaaaagcacagcaaatagttcagctttcaatgcatatataatgccttgttttttctgtcatattgtaaatttcggtccacaggcactacaatgcagaatgtatgtctaattttgcactcataatgtatcttgttgcaatgcacaagcactagcattatttgatctgcaagactcaatagcaaagcatatactttccaatcgaggtcgttcctttattcaccatatgctgaaatccttggtccagaatttactgtgataaaaagccttctagccgagactttcttagatcaaagtctcaaatagctcagtcgcacgagcgaacatatagcggggtaccaagtgtattcaaatccactctttttntnntttanttatacaacgtaaataacggacaaacatattatacgcattatatantgaagcaaccaaanatatacaacggcgcagangacagcctactacattgtacatacataacaaaaaacacggacagcggag

SEQ ID NO: 10163 - DNA, 1073 bp, Oryza sativa
  unsure (1)..(1073): unsure at all n locations
gtggcccaatagtatctactatnnnnnnnnnnnnnnnnnnnnnnnnnnnnnnnnnnnnaagctctcgcggattcttgacatgtatgaggcacttgcagaggtgatccctgagatgaaggatttgtgcttgggcagttctggggatggtgtgatcagcgatgttcaggcgaatcttgataggcttggggatgccattaggggtacacttttcgagtttgggaaggttttgcagctggagtcatcacggagggcaatgacagctggtgagatccaccccatgacacgctacgtcatgaactatttgaggcttctggttgtttacagcgacacacttgatgccctcttggatgacaatgccgatgaccaaattgatttggcaagagctgaggatcaggatcaggaacacttggagagcatgacccctcttggaaagcgccttttgaagctgatatcttatttggaggctaacttggaggaaaaatctaagctgtatgaagatagcgccctggagtgcatattttccatgaacaatttgctgtacattgttcaaaaggtgagggactctgagctcggcaagattttaggtgatcactgggtaaaaaggcgtaatggcaagatccggcagtattcaaagagctacctaaggatttcctggatgaaggttttatcttttctgaaggatgatggacatggaagtgggagcggcagcagcagcggcagtggcagtgggcattcaagttctcggatgtccatcaaggagaagttcaagaacttcaacctggcctttgaggaaatatacaggaaccaaacaacctggaaagttccagatcctcagctccgagaagagctgaaaatatccatatctgaaaatgttattccggcatatcgtgcttttttgggaagatatggtagccaagtggatgggggaagaaattcagggaaatatataaaattacacccccacaggactttggaaagtcaagctttttgatttggttgagggttgcaccgggcccagccaacactctaaaagaagaacattattcttatttggccagccctgttaaaggtat

SEQ ID NO: 10164 - DNA, 1960 bp, Oryza sativa
  unsure (1)..(1960): unsure at all n locations
ttaggtgaaacatcttgtctagctaaccttatccggaaagccactaagccagtattactcttactgtttttaaagtgtgacgtactcttataatgattcactactttaccttttcatttttgtccttttcaattttattaggatattttcttaagaaaaaaatcattataaataggtacttatcttacattgtcatgtagagtactggttgaaatttaacatagaagtgagttccgagatggttatatttgatattaaaattctaatccatatgtagctttgccagaactgagaatgcaaagtacattcctagcaatttaggctaacaaaatgttagtaacaatcacaaaggtaagctgtaatgatgacagagaactgaaaagtttgagaaaactccatgcattgttcacatatgctctgctgtaccaaatcccattccatgtcatgtatcatatctcaacgaatgtcggcatcactgatatgtgcaatcttaacccaatcatggcctacatgtttttggcatctcttcttgagctcagagctgcagccatagatgtgcaggctggtaagagatgctggcatatctggaagtgtctgaatcttaactgcattgtttatatgcatggactgcagggaggtcaaggttgtcactgcttgtggtaaacattgcagatgagaagcattagtcagaactagttcttcaagggcatgacagttatgcaacagatattcctcaggtaagagtgctaggttaggtccaccagaaatttgaagcctcttgatggtagtgacgcttctcaatggctctctaagtaagattgatgggtggtcaatatcaagttcactgagattcagagataggccagatgaatcagcatcctctggtgacagaatagatgaatcttcaacaagcttgtcacagctagcgattgtcaatgacatgagcgatgcgagaccttggatcccgataagtgaaaccagctctttgcagtcccaaataaaaggtattcaagatttatcaatcttgcaaaggcttccactgttggaaggtgtgcgattgagcaagcatttaacaccatatgagttagccctatcaaacctgcaaacagttgtaaagggagttttgacattgcacaaccatctaaaaagatccgtttcagatatttaagacctgtcaatgagtctagtaacgcaagttcagcattagcacacaatccaaaagtgatggttctcatagtatggggcaacatgatctgtcgtgcgatcagatttgggcacttcacaatttcaagggttttcagggaggaacatgaactgaatgaatcttctggtagacatgataaacttgcacattgttggatggacaattcctcgagagcataaagagaacacccatgccataaagttgttatatacgggcagttggatatcattagcttagacagagagaggttgaacattgatgatgaacttccatcactgctcacaaaaaatgtcggcatagcctgtaaaccagcatgatcaatttcaatttgtcgaatgctagtaggtaaagtcggtagtcttctcagctcctgacaatcacgcactgctagtgtctcaagccgaggaaataagttttcaccctccaatccaacccattccgtgcaaactggcatgttctcaatctctagtaccttaagggattgcaatccagaaggcttctcaccacttccataaaatgatgaatccacacactctaccgacttcatgttaactatgtacagatattgaagagaaggtaaatgggtaccaagtgntaatcaaaantgtnctcaaaactacacattttttttttttatattattatatagtcaaatcataaataacctacaataaataagacgtccatataaagacgcaggcacagantantagcgacaaaaaaacatacacacactactaaagacacacgacgtcg

SEQ ID NO: 10165 - DNA, 14068 bp, Oryza sativa
  unsure (1)..(14068): unsure at all n locations
atggcnnattgattgtcgatcctctnnnnnnnnnnnnnnnnnnnnnnnnnnnnnnnnnnnnttctttgactgggagatctgttcaacaacagtgagacttatcacatcaaggcataaatggcgaatagtatttggaatcttttcagaacttatactaactctggcacattcgttcactgaagctgaccgtgccaattcatgcaaaagatcatgcacaacaaaccgttcctcgtaatattcttcaaataaacgacattttatatcacgactagaccgaggtcttgatttaatctcaaaaaaagactttctggttagtgcatctaaatatcccattccaacatcctctggtgtcatgccatctaccgattgttggattagtcctgagcccatccataaatacactaattctttctttgtgaattcatagtctttatgaaataagctgcaatacctgaaacatgactgcaaatgggttggtaaatgctgatagctcaactttaacactgtcataatcccttccttgccctgttgtatattatgaacacttgatgccaatattctgttccaagtgttactatcccttttgttgttcaacaatccacctagaacctttgctgccaatggagaaccactgagtttgcttaccattttcttgctgatgtgttgcaagtttctataatcatcaggattaactccaaaaaaggcatgtctttctaacagaagaagaagttcagtttcttttagcccactcaatgataaagactggcattctccttgcatcgctcttgcagcaagattagctactgattccattcgagttgtcagcaagatcttgcttccggtcttcccatatcttaatggacttactaaagtctcccaaccacgcagactctcatcattccacacatcatccagtaccaagagaaaggttctggaactcagtttctcctgaagtgccttgtggagagcatctaggccaatcatacctatttctgttctagtcacaccttggaggatctttctcgttagtgtttcaacatcgaaaatgtgagaaacacaaacccagacgaacaaatcaaaataatcttttaccttgttatcgttgcatataacttgagctagtgttgtcttcccaataccccctaaaccaactatacaaaatatggggatgttgccaacaatctgttcagatgcactgttttcacgcttggtcagccactgaactacaatattgctctcctcttctcttccaagtactaggctatgaggcaatgagcttgtctcacgcaaattcttgaattccacttcttgtttaaagttaaccttattgccaaactgattcagaacttggataaatcgctcaacaccagaggcaacatcagctaaagccttgacagcatttttcaacctcttcagtgacccagtgttaaatgtgtgattaaaacgctgaacaatcttgcccttatactgatgcagagagccactcaccttgctacccgcttgtatttttttggcctccctctcaagcttgtagtactccagttcatcaagcgcatccttagccaattcaacagcatctctgagctgccacaaccacgcatccagtgcatcactttggtctccgatatgctccatgtccacagcatccaagaccaccttgatctgagggaggagtttctccagcctctctctagtaggcttcagccctccagcttccttgttatccttcaagtagtcgaatgccttgttgatgacataggtgatgactgatgttgcaatagctttccctgcaaaaaccgcagcaacaccagccatgtttgagtccttgagagatcaaagaaagaaagctttggcacacaagctgaaggcctttttgggcagaaatggagaaatctacttagaaacgcatgtggatcctgctaacaaactagaggataacgctgctaaaccacacaggtggtgagcttgactagtactcctaccacaactaatagtacttgattagtgacaggagtattgactaaatcgacacattcgtgacccaccaaacaaacagttctttaactttggatgaaaaagaaagaatcacacttttcgcaacagaatccttctattctagtcgagttgggtaaattttccaccctgtgaattcgactgtggctggtgttaaagattgcattacggcactgcaggtctgattatcccatcccgttgtatatttgttgcaacaacgcaacatcccaaaccctattcctatttcccaatcatacaagagtatcgcagaaggaggaattaagctcaaccgtaccagactggcgtggcggcgcaagttatccggcacggaagattcaccatatgtcggcggtggcttggttgatccggccgagctcgagcaacacccgacggtcgccgcctcgccggcgtggtggtgagcgagcggcatgaagcccgctccggcatttcgccgaacacctggtaggtttgaggcgaagagaagcacgcgccgtgcggtccgtcgctacgggctacggggctacggctgcaatcgatcagcgtcatgtccatctctgcataagttttgctgacagtgtatttgtaaaatcttaaaaaaggaccaggatgtacaaagccgatcgatccatagactggaggccagggcgatgcgacgacgagggttgcaggcttgcagcatgactcatcatttgttgacgacgccgcgacggcaatgacggtccagtgtttatatatacttaatgctcccgccgcccccatcaaccaatatactggtatttactcaatttaggccatattttcgcaccaaacttcccccaaactctcaattttccgtcgcatcacatcacatccaaaactttcctactcacgtaaactcccaattttttttgtccaaactaccaactgtccaaactaccaactttcctcaaacttcttcccaatttcaggaactaaacgcagccttaatccgaatatcttgtttcacaaattcacacccctatttgaaaaaggcttcaacaagttattacaacaagagtatgttgcagtttcagtataagactcgacctgcctttagcagaatctaagccttgtgcaacagtaaaaaacaatgagttgtattctgatctaaaactggcacctatgattttttttttcgatggaatgggtaggagtttttacatattttttaagcaccacctaaaatttggttggttgttctttgatctaaacataacacagagatttttaacagatatttgtttgtaggttcaattgtatcttgagtgcaatttactcaaagttatattataaaatatgccattctcgtttaacagaagaatgcataattgcatattcatttcaacttcacttgaatttagcgtctcatgtaggtggttcgatcaacctatgacgccaaggagcaaggaagtaagtggaaaacctaccataccatgcgaccatgcccatagactactcactactacttaacctgctaaccagaatgacacactgacactacagtagagacaggctaactgaaactgtacatgatggggtgggctgagatcaacgcccgttagctccagggtagaaggtagtcagacggtaacatcggcaagaagctcttgtagcattgtctacttgtcgccactcggcataactgtgctcagggcgccttcttgtagctcaaaccgctctcccagatcattcctaccacagactccagcatctcctgcagagaattcgcctcctgatcaacagcctggaaaacaacaagacttacaaaggtcattaactcataatgccgtttgctgcacagttgaccagaaattattagccacatattccaattctggttgaccccatgtcggtaaaatgggatcttagatattaacatgataattgatatgcagtacacagcggaggcggactttggatcatagccttattaggaatgtaaactgaagtgtaaatgctgaagaacagcacatacgcattaacttacgagcagattttacttacctccagacttgcagatatgccaattagtttaaaggtaacttcattagaaacctctccagttgagcttcgatggtcaaaccggtcagcatgccttagcttgagcctcaacttctcatttctgaaagctttgtagtttgtatgccacactccaactatgctgaacctctcatcaatcgattctttcccaagaggccatctaagtccacctttgacatcaggatcaataacagcagaagataccaagcaatttattgcatttttcacttcagcctgcaaaaaccaaataactttgccaaaaatgtctcataacataaaggatcagaattttcaaacaaaacccaactcacatctaagttcttaaggattcttttggtagacaacatcagcctcaggtccagatccttgaacagacaggatatatcttccaccaagtggcgaacctggttcaactgaacctgcatggaaaagtatgacagtgtaaacaaacatgttaagccaaagagttcgttcttctattgaataatatatattttaaggatatagcaacgcacacaaagttttatttatcctacacgggtaaaatttgcatttaacaaacttaccaattaattatatgagatgcttttaacataaaatttgcagttcataaaaactgaagaaacaaaaaccactgtcatgaaatttcttcagtagaatagacataggacatgatcacattaacacaggcctgatttgattgctgtcaattcaatcgtcatctaaacaaaatataatgtaacctggtaatagttcaaggctgaatcaagaacggattacattagaactcagatacaaccatccaaggaaagatatgctaggtctactgtactcctagcaaaggacacaaaagatgactctttcaatgaaggaaaaaaggcaccagaccttttctactaatagatacaaatttcttacaattgacaaccaaaatattccctccgtccccaaatgaaggggccagaatctcttaaggatggagggagtatagtgtttggcattggctgtgtaccataggctatcgaattcaacaaaacatggaaaattgaatattactgtgcaatgtggcccataattaggacttgctagttactggttatatttcagcttttcaaaataaaaatttaagttcagaaagttggtgatgattagatagattttatggcacgaacatttcagaaatcccttcaaatatacatacttcaagtgtatgtacagatagcctcattcaaatctaaacctcttcaactgtacatactttgtaagtgcacatacagatgtattgtaagtacactgtacacaaacttcctaagtatccctgtactgatacactccagaatatgtactctccttctcacatgtatgcattgtaaatgggcctccaaccttttggaacgttcaaagcccacttgagcaactccttggcatctacagggcacttattctcaatgaaccaaacaaaaccacatattgcatcacagaattatagttagcatgaaagagttgcccagtgctactgcgaactgacaatgtaagaaaacaattgtgagaagttactatcctaaagaagttccactacaggaaaaaaaaaaggctatgagtaagtgctagatgacaaatcattggaattttgagaggcacatagtatattatcttgcttactgatagtgtaggcttccagtctatagtattggaagtttgtagctaatcgagctaatccatcattagtagatttactataatgttgcatccacaagaccaatcagtaagaactagcgacctcaaaaatgattaaaggcatatattttgggaatcacaacacctggaaggacaaagtagctaataggcttcatctagtaccacaaatgaagtagacaagtttatatgagccagcttctcactttatcaaaaaactcatacgaatcaagatccctatgatagaccggtagctatgatttatgccatacatctcacaaagatgaagcctcattgttcctatttctcatgggtacaagtcaaaatgctaacaatcccaacactctattttcgggcattcagcaatcatactcagaaaaataatctacacaagtagagccaaaattaaaatacaatgtgcaaactactcatatgaatctatgatgcagaacattaataagacaaaaggtaagaggctaaggttagaacgataagcagttaagcacaccttatggatagcaagctttccatcttcttgcacggtgcatttgcacgttattgtagaatcactttgacgcttgtcaaagacctacaattcatttacaggccccaaagttaatttcacccaactataaacccaaaacatcgtaattgacatgctaccagacgcgcaaaccttcacatggtagtgctctttggaggaatcaaactccagccccatcttctccgcagcggatccctccatatcatccaagcactcactaggcacattggtatagaacgatttatgaagattgctcctcgagccctcttctcctgctttcacggcttcgcggagcgagttcatggagacgggtgatccgccgccgctacacaaaatcaatcaataataacagcagcaactctttgtgatcaacacccaatcattcttccacgaatccaacgagaaatggtagatgggatgggagaaattaaggagactcacgacgattcgaagagcaccttccccaccctggccacgacgctcagcttcacctcctcctcctcctcaggcacatcgcccgccttcgccctccaagccgcggcgaggaggtccggcaagaacctctcggtgacggtggatgcggcggccgccgcggagcagggggaggaggcttcggcggcggaggaggagacgagggcgaggggcttggcgccggtcctgcgctcgatggggtcgcaggggaagggctcgaggcggagcgacccgtcgtcgtcgccgtcgtcgtcggggaagggcgggagcgtggaccagcgggagacgcagccggcggcgtggacgatcttgctggaagggcgggtggtggcgccgcggtggtggcggccgcgtggggaggaggagagggagagcgagcggagggaggaggagagggagggaggaggaggggccggggtcggggcgggcgtggaggcgttggagtggcgcttgtgcggcgggaggtaggccatggccgccggcgacgaggttttggaaagttggtcagtggcgactgccaatcaagtggagaagtggagacggctgaaggcaggagaataaacaattccgtagggttttatttaggatttttttcccctactttaaaatagagaaacaattagatacatatttttggaataaatttcacaaaacctacgtatatatcgtatatattttgactaaactatcacgaaactacatatttaatactccctccgtttcaggatataacacgaaactacatatttaatactccctccgtttcaggatataagactttctagcattgctcatattcatatagatgttatgtctgaattcattaacataaactctctccgtttctaaatatttgacgtcattgacttttttaaatatatttgacagttcatcttattcaaaaaatttaagtaattattaattctttttctatcatttgattcattgttaaatatacttttatgtatacatgtagttttacatatttcacaaaagtttttaaataagacgaatggtcaaacatgagctaaaaagtcaacggtgttaaatatttagaaacggagggtgtcggtgacatgggatcgggggtatcatgactagaggcttgggcagccgcagtcacccacgtggcctgaccccctcggggggggggggggtcgggcccgagggagacgtggccaccccctcctctgtcttcccgaggggtcgggccgctcctgcttcggccccgagggctggggcgccccgaccccctgtggtattggcgccatgtttgtaagttaggtgggcacagcggcgctcaccaaaccacatttattgcggaatggacaagcgcgccacgccgcatttaatgcagcacggcgcacgcatatccggtccgtgaccggtcgcagtgtgtgatcggtcacagaccggtcagatcgcgggttaggtggcagcaggcggactgtcacacgcctcgccccgtcccgtcggaatgatgagagcctcttggcactcgtccctagctggagccagcgtggtaactcctggagttagcacatcagtcccggctcgattcatgccaggcttcatcgcaaccattgcaaggaagtcactgtatgaagaagggcagatgtgtggcatgctaaactgacacgtggtggacaagaatgaccggtctgtcactggtccgacgccggtcacgtcatcggcagacaaccgtgctctcatgttgcatcagcttccagcggagtggaggcaggtatgacccatcccatcggagggtcattcggacagcggccattgcaaaactccgcccattaatgaagaaatgacagggtgatcccctgtgtctgacgagtgacggcgctgggcatcactcaaggacaggcgttgatttagcttccaggcggaggtgcgtgtcaagatttggtcaagatagggtgggtccccacccaaaagaagagtaggtagaagtggtgcatgtggtatccccttgagatataaaaggaggaccttgcccacaaagaaaaggggggacaactctgagaagacttgagctgggggaggagatcgagagaaaaaagaaccagaagagaaggaaaaagaggggttctagagcttgaactctcttgctccccgactctctgtaactcttcctcacacatatccaccagaacacaggagtagggtattacgcttctcagcggcccgaacctgtctacatcgcccgtgtcttgtgcgtttgctctctcgcgtacattccacagatcgagggtgaagaacctcacttagcgcccccggccgaactggcaaaggggggcctgcgcggtctcccggtgaggagccccacgctccgtcagagggagtatatgaatatgggcaatgctagaaagtcttataatatgaaatggaggaagtatcaaatttctcatataattactgatttaaggcatcatatccaaaactacagatttactgatgaaattataaaatatctatagattttagagtttttatccatatcatatttaaggctataaaagttgtagttttgtgataaaactaatgttaaatttgtatttttctaatatgatacgatactttaagtctgtagttttatgaaaagtattaggttaaacatatagcatataagtatatgtagctttatgaaatttaatcagtattatgaattgttcttaccgattatatctacctattatattatattatgtaaagacgtaaatattaagaaattacctaatatcaaataattataatggatgagcatttgaatccaagtcgtctagctcaccaccttgtgtagctaaccggaagatccctcggtgtttcttattacgttacgtgatattagttttatacgaaagatgtaaaagagttacagttttcatcgcggcatataaattaccactttcatcgaaaaaaaagaaaaaaaatgcaccggtgaaatatggtgggtacaagtataagaacgatctaaactgatctatataattttacataaaataaatatactttttcagaaatagagcaatagtttgagataaaatatatttgtatttatcgaaatagaagtaacaattgtgtgttagaactaattctatttttaaaatctagctcctaacaaaattgtcactaattgtcttcgaagtttatcaccaacatttggtggctaaacaatttaatcagcgaaatttttttattgggaagaagcgaaggtatgccaacggacgaattttgatcagaattcatttaaccttttgcactatagtttaggtcttgtttagttcacaccaaacttctcctaaacttccaacttttcatcacatcacatccaaaattttcctactcatataaactctcaactttttttccaaactaccaactttccctaaacttctccccaatttcagaaactaaacacagtcatgtcatgatgttgtcatgatgtaaaagccataaatatggtagacaatgaggcaaggataaccgtcaagccagcgcgagtacaaaatacttgttgttgctccattgccaatcgagttttaacttatactaatattagattacttaaaccccgtgggatctttggaagattaggggcgccacgtcatcagtttggttcggataattaaagcgcatatgcatttagcaattagcagcgatagtgcgcagcgatatattagattctgtttaattggttttagtagcacaggattagatgcgttcctattgggccattttcctgtgccggcccttccttacacatgggcttttacctttctcattgctcagcccacgttctatttccgtgtttccgtgcttctgttccacacggagcggcgctagaaacaccgcttgccgtgtaagcgcacgccggattggccaccgtctcctgccgccgtacgtggtagtggaggatgcttggtgaagtctcttctcggctgctgcgcacatccctcctctccccattctctcctcttcggttttcttggtgaggtcgccggcgatttctcctcctttctttttcctctttcttcctgctgagtagcagtctaatccagtgatttctccctttttttttcttcttccccagggtttccttcaccgttcggctgcgcattgccttcccgtcggagctacttgcctcaacggtttggtcggccgcgtgcgctcggtcgggaggccctagggcctccactttatctgggaaggtgatccaatgaaagccttctaaattacctccgatcccatcgctccaatccctatttcagtccgacctctctcatcaagcattcgcctcctccaaaatcccacaatatggtgtgccgctgatatgattttcccctccctcctcactagaaatcgtttcttccattggtgaccatggacctcctcacctcctccacccttaggtaccttcctagacgctatcctcgcatctttgaccaatagccacaaccagggtctgcatcacggcacggggacctagcctcacaatctaaggtgaagcaacagccatggctgctattatgcgagaggaccataggtcagtacgagtggggcttctctcccttctgcttgtgacatgctgattaggtctctgttctgttttggtcgtatgctaccctccccatcctacttttgttggcatcctattctatctctttgatagttatctttaatgttctatgtttactatgctaatttgtgtgtgcatgattttattcttaattgcagctgtaactgctgaatacattactgccttgccttttctggtatggtaactgctctggtaatcaggtataatattcaaatcaatgattctatagtgtgttcgcgtttcctgcttttttctgtctcagttagccatatcttttagtgagatctgcttccccctccattgtttagtttggcatggaatacatttggttctagcttctcatacactatttccttttgttagagaaaataggatgcagacagactcagaacgccatcttctcgagcacatgatctacacaagtagccaattctgcacaaagttaagtaaactctaaactatatacattgaattttgcttcccaatagcagtgtagaagataatagattttctaattgcttttctttgtatatgctcattactgtccttggtttgtccttattcataacaagattgtttgcccatcctttttctctacaagatgggcacatttaaatgaactatttatcattaatccatgatggagataatgcgttgaaagctcagttagtctgttgcttattaatttaagttaaccatttttcttaggtcaattattatcttacattaacacaatagagaaaaattttcacttttgagaggattcaacacaatgtttcattcaaacaagcgccttcagcaactgttcatagaagtgcattcttcttccggagcaatgtacaatgatttaggatttgacaaagtaattttcaatttatcagaactgatttctcataattacatcttcatttcatattggccagagcattgccaatgagcgcgctataactgtggtatcccaatcagtggcactaagttttaggttgactgcaatgctttttctctgcagttgctcctaactgcaatttctttttgtcaagcctcattgatgtattcaacaagtatcagttgctgaagcaagttctgctgcagcacaaatctaacagtgtcaggttctcatgttcttctggttatacttagcattctttaatgtcaatttatcacatttctggttatagtttcttactctttttttacagcatctgtatgaaacaacaacagtcatttcatcattctttcctgctggtaggaaaaatgtggactcataacaaatgtccaaaattggtgtgtttcatttgacctaaatagtaaaaagataggcattagtacagttagacatggcttgtgggtaattaggcttacctacatggtcattaacttagctataaagttgttgttacttgacaagatcagttaacagtgaattgccagaactaaggcttacaactggtacatcacttcagagaacatacttacttaaacccgcaatttgcatgtaccgtattcttcaaatacgttatataaaatagggtcttaattcctttacatgcaataattcataaagtctgaattcatcttcatcagtgctttggtcacaaccaattgaagcagtagttgtagatatttcttaccacacacattttttattgtagtgttcaaataaaataaattcactctaaatatttgcttgactaaaactcagttacctttattgcatttcaggattttgttataacctgaaacatattttttcgaccctttataaagttacatgtccatattatatattcatattaatattagtttattccaaactacagtacaaataaagaatttaaccgtttggtagtaatcagttgttgagcaaagctcccaaatagcatgtgtaatcaagttctattgtgttgtattcatgctctcaaatggtggttacatctttatgccacattaacttagctaagcattgacatttgacaagtgaagtccttacatgattacatatgatttaatctttgtatagataagttatatagcatatccataggttttagttttgacttacacaaagaaactgctatatttagtcactgattaattcatttatttgttgagttatttctctcctgttgactgcactaataattggtgctttattcactaggtcaacatcttctctgtttatatataccttaccttacccatctttacggaatcagtcactgcacttgcatctttcccttttctccattgatactatcctcaatatattagtgtggtaacaccggtatatgttctatcgaattgtatgataggtgatgccttgctgaatgatattggcacgattggaaggataatagagcaaagatttaccttttgtttttatggtgtcctggccatggccaaacacgggagctctccatacattagttaattttgcctaattctaataccaatgtaattgcaagttgacattgatttcagacaccactttgtgtaaagatattctgtagaagttcttttatcctacttcnnccttnncgngggtncaagcagttgtcttaatncctctgctgggggggggggggggtcagacaacattatntactgtctacatcgatancaccgtacgatccagtgatgagaggcnancaaatatatcttcctacgagaacgagaattgc

SEQ ID NO: 10166 - DNA, 3076 bp, Oryza sativa
ctgcgcccatagtattgtctatccttgtctgcctgcaggtcgactctagaggatccccctgtcttttggatgccgaaacgaggtatgtctttatagagagactttgtctatgcttattctatgcttgtaccaaatggaggcattacttgttatctagtacatgcatagttgcttgtcaagccgatgttattagacacatgttgcaaaggccaattctaagtgggagaattggcaagtgggcatatgctttgatagaatatgatttggcttatgaaccattgaaatctatgaaaggccaaattgtatgtgattttatagtggaccatcatgtagatattgcttatgaggaaagggtttgcttagttgaagttataccttgaaagatttattttgatggttcttcttgcaaagaaggtcaaggcataggggtagttttgttttcacttaatggcatgtgttatgaagcatcggttcgtttggagtattattgtacaaataatcaagccgaatacaatgctctattattcggcttacaagttatggagatggttggagctaagtacgtggatgcttttggtgattcggaattggtggtgcaacaagtcgccggagtctacaaatgcttggacggatcactaaataggtacctcgattcatgtttggatattattgccaattttgataattttgctattagacatattgctaggtgtgataattctagagcaaatgacttggcacaacaagcatctagctataatgtgaagaagggattatttctgatattagaggagccggtgcttgcttttaaatctttgtgcgaaattggcgaaactggggaccaggggcggtctgaccggcattgcgtggccggtctgaccggtgaccaggggcggtctgaccggccacatgccgccggtctgaccggcgaccccgagcggtctgaccggccctgtatggtcggtctgaccagttctgggcagagcgctggggggcacgtttcaatcaatttagaggccgaattaattgtgaattcggacatttgtgcctaggaagcagaagaagattggagaattcctttgattcgatatttgaaagatcccacgcttaaggttgatcggaaaattcggcgacaagcgttcaaatacacattgcttgatgaggatttatatcgccgaaatatagatggtgtcttgttgaagtgcttagatgaagatcaatctaaagtgactatgggagaggtacatgaagggatttgtggaactcatcaatcagcccacaagatgaattggttgcttaggagagcggggttctatggccgaagatgattgatgattgcttcaaatattatagaggatgcgaggcttgtcaacggttcggtaatgttcaattggcgcccgccaccgtgttgaaccctataatcaaaccatggccgttccgaggatgggctttggatttcattggtcaaatttatccttcgtcatcaaaggggcataggttcgtgctagttgctacggattacttcaccaagtgggccgaagccgtgccgttgaagaatatgactcatacggaggtaattgactttattttgaagcatattatccatagattcggtattccacaaacattaactacggatcaaggtgcttcttttatatctaaagaagtgaagagttttgccgaatcttatggtattaaattgttgagttcttctccttactacgctcaggctaatggacaagccgagtcgagtaataaaacgttgttgaagttagtgaaaaagaagattgaggaatacccaaagaagtggcatgagatgctttctgaagcattgtgggcacataggatatttaaacatggtgccactaaagtcactccttttgagttggtttatatgcacaaaaaccgttttcaccaggggaggaatattggttctcttcgcgatatcacacgcaattatttgtcaagtgaagatttcaagacattgatgggagacaaccttgattaagtcctcgaccagtgattgaaggcattggaagaaatagagatagagaagaagaaggtggcccaggcgtacaacaaaagggtgaaagcaaagttgtttcaagttggagatttggtttggaagacaattttgcctttgggtactcgatccaaggagttcggtaagtggtcttctagttgggagggtccttatcgagtatgcggtattgttcgaggaaacgcatattttttggacacacttcaagaggagcgttttcagtgagtaatcaacgggaaatacttaaagaaatacttcccgagcgtttggcaagacgcttaggaggtactatggtcggtaattggattatcgtcctaagacccaaaacatgttctatgcttttagattcacgttgttcatcaaaaaggcaggggggcatgtgtttactcccaaatttggcacctagaattaaaataggaaagattgccgaaatttggaagtttgccggtttcctccgagtgggccggtctgaccgccgtgtgttgggtggtcagaccgccggttcagggccggtcagatcggcggtgtgtggccgatctgactggcaggtccgagtccgactgtgtttcgtcgggtctcgaggtttccttgctcgagaaggcatgtttcgggtttcctttagtttctaccccgagttggacgtggagaagggcctgtagagggcaagaccaacccctatataagggacatggccggttcattgtaaaaatcaatctacaatcaatcaatcaaatcgtttttcatattgcttttagttttctcttagtttgtccatctttgtcggtttgcaccgtaaaccatccgccgccgctgcgagagtgcgacatctctttgtaggtttgtcctgaaaaccttccgttttgcccacgaggcgggtagttatctagaaatcggctccgctagccggtttagttatcaaaacccatctaggtttagctctttgctagatcgaggtggttggcgactctaggatcaccgcaaggcttaaggtgctgtgatcgtgctttgtaaccttgttaaaaaaaggttgcaact

SEQ ID NO: 10167 - DNA, 5036 bp, Oryza sativa
  unsure (1)..(5036): unsure at all n locations
gtgggaaatcggttattgcagtaagtaggaggagtaagcatatgaggaggaaaatcaacgtggcggcaacgctgggtttggcccgatgaaaaaaccgcaaaaaaaaatatagcgataaaagaaataaacagaaaaattggtgaaagaaaaaacggtgaaaagaaaatatgcaaaaaggggaaaagaaaacggacaaagaaaaccggaaaatgggtgaaagaaaataaaacggaaaaaaacaaaaaaaaagaaaacgaacaaaattagatgggaatcggatacggtagtttttttttattttcgccactttcttatggggaatcggacttttttattttaggtttttttctattttttatttagacggacgatggaagcacctcttattttttaagtagtatccgtgtgttgcaacgggtgaagactattttaatcttattattgttatatggtttagttaaaatgaaattcactgtgttaaattcgcttggatatatattttgttagaaaatcataagcagcaattaggagtccgatcgtattaaattagtatgcgagttttttaaagagatttcttatatgattccttctgtattttcaaaagcgaacgaattcaaaaactaactcaaatatggaattgtatttctaaaagcggaagaatttaaaaactaacccatacacgatgacgtaccaaagtaccatcaaaaacatcttggaaatcatgaactgtaattaggagttcgaacgtctcaattagcatgcgaattttttaaagagatttcttatatgactccttttgtatttttaaaagcgagcgaatttaaaaaccaacccatacacggatgacgtaccaaggtaccggcaaaaacatcttgaaaatcatgagctgcaattaggagtccgatcgtctcaaattagcatgtgagttcttttaaagagaattcttatacgattccttctatattttcaaaagcgaacgaaattaaaaactaactcaattgcggatttgtatttccaaaagcgaacgaatttaaaactgacccatatacggatgacgtaccaaagtaccagtccaaaagcgaacatttaaaaaccgacccatatacagatgacgtaccaaaataccggcaaaaatattttcaatttttcgagaagtctttttcgagggagtcggactttttttaaggagtcggacgtttttttttctttttttagggttaagttttttttccttttttttgtcgccttctttttctcaacggggagtcggggagtcggacttttttaagactcgaacgcccttttatttttctttttttttgcgacagatttttttctcttctttttttttggtttttctctcctttttattttccatcgggggagtcggatttttttttatgttttttcgcttttttttatttaaacggtattttttctcggacattttttcccttttaagggatccgatcttttttttccaaggggaatcggactctttctgttttgtttttttttttcggtttttttatttattaaagggacgaaagaaaacgtttcttaaaaattttaattttaagtagtaatatatatatataagtagaagtagatagtagatcaatctcaaactgtacaaatatccaagaaaaacacaaaacgtagttaaggtatccccgcaggcttaaaaaaaaaaaacccaggaggctaaccagatggagctcgatggccatctcccgcaagccgtcgctgctgcagctgaacagctcctacgcgccaccgcgggagcactcactcgcgtgtcgtcgtcggtgccgcacatacgcgtcgctgcaactcctgcatgccaccatttctgcacccgtgcactgtcgttgccgaagccctttcgtccaccactctcacatcccgccactgtagcacccgtatgccgccaccacagttcttgagcgccgtcgccgccgaagccctctgtgtgcgccgcttccgcagctcgcgccaagcgctatctccgcagtccctaccgcgcggcgcccgccgttgcagccccgccgcgtgccaccaccgcaactcccgccgccaccgccacagccgaagctttctctgtgcgccgccaccgcagcccccaccgagcgtcgatgccgctggaccacagctcccatcacgagccgccgccgccgtcctcaccgtgcaccgcctccgccgaaccctagctatgccgccaagaaggcacgggatgagaaatttgaccgtggggtgagaaatttgaggattgatttagtgttcactgcttaggggtattttagtcagtttatattataaaatgattttttttgtctcctttaaaaaaaccctaatggtggagtggaaagagggtcggacggcagtttcgattttggaaagtagggtcaaatgagcaaagtttaaaaagtaaggtcaaattagtagttacacttcataacatggtcaaatgagcaattgtcccttgtgtgtgtggggatgttagtgttgttttgatgcagatacaatcaaatattttaagcagctttgggctctccaatatctctctctgcgactgcatataaaggtcatgtgtattctcaaaataacaaaccaatgatactccatccgtttcaaattacttaaaatatgtatcttttaccgttaacttttataaatccgtgtagtttaacatgagaattacatgttatgaaaattattttcatggtaaatctaaaaacctaaatcttataatgttgaacaatatgggtttacagaaatttatggttaaaaattaaaatgtttgacttatgagttatgtaaaacctatattgacaagtaatttgaaacagaggaagtattatatttgtaatttttttctcaagattctttcctaatagttatagactactccatctttttgtaaattactgtcctaatcgttttgacttatgagttactacaaatcgttttgactttttttagtcaaattttcaggtttgaccaaatttatagaaaaatatagatatattttcaatacaaaacaaatataatatcaaaatatattaaatgctaattttaacgaaactaatttggtgttgtaattattgctgttttttctgtaaatatgttcgagcttaaaaaggtttgacttataatatatataaaatggatagagtagcttgtaattttaatcaggcaacattatgaattactccacgccctttattaaataagggttgattggaaattttaaggatggttagaagtaagattgagtaaattagatgaataatactctacaagtccttatattttatatttttatattttagaacaaatcttaatttctataagtagccaactagccatatcttttatataaaaaaagtagtcatatcttgagctgaggaaatatagttaattagttaccgaaattttactctcgaggccgtgtctaacaagatgaactcacgaacttctgtgcattactgaccactagctacttgacctgatcgagcttgattaattgttcttaggccccatcattgatctgtccattagtttgaatcattattctcgtctggtttgtgacatgtgctgatttacagtcaaatattttaagctatcgttggctatccgtatctcgatcgatgtgttatagtgccttcataattcgatcgatgagtagaacatacggagtattactgaatgtttcaaaaatatattcatgagagtgatccagtgattcatcgattctgtgtggttgaaattttctcggtagggttggcgacactagtacgtcactcgatctcttccactttgcatcagtgttcaaacatgtatgaacctcggcacgactccatttaaaacacgtggtcaattttaacaaatttggcttagaatcttgaaaattggcaagctatttcaggtcattgttaaactgtggattatagcgaaggatgcaaaatagtagagctttactgtacttttgtattttggtgtctaaatcaacacaggaaatttccaaaactgaagcaaagctcactacatcgatcggaccaccaacaacatatatgcctaccattttgcttctacctccgtcccaaaataaatttatttttaagccttcttatttgaaaaatttaagaagaaaatttaaaaaaaatagtcacacacataaagtactattcatattttatcatccaataacaataaaatattaatcataaaatttttaaataagacgaaaaatcaaacgttgtatccaaatactgaaaaatgaactttttatgtgatagaggtagtatgccagtgagtctaagtagcttcctagggcggttaggcccctaggtccactagagttgtaaatatatagccagttaaccagcgtataaaatctactgaattataaaatctacttgaacttttgggttgaaccggctcctacatgggccaaaatctttccttatcgacttataactttgggttgaatggacacacaagaaaagttgttgattgaaatataaatgtgctgtccgtccttccacatcaatataagtttgaattgaattgactcattatattcttcctcactcatcaacttaatcttttgactaaactagctggtacatgtaactcaataacatctgtaggagtttggggagcatgtagttcgacagcaccaccaacgatgacacacacatgcatgactgcagtagcaagtcaccctacggtcgcaattgagttgcagctctcaacaattgaccacgttttggagatcgaagatcagttaagcgttggtttttgcctaacgttttggagatcataaatgtcatggagaaattttggtccagcatgaaaatgacagtttattaattaccggaagactttgtgctcgatttcgatcgtttcagtcatgtgtgtttttactggttaattatatattaagatgggttgacgatatagaaacgtgcaaattatcatgtttgtctgaaacgcagnnnnnnnnggnnntttgcagcaggggatgcattacg

SEQ ID NO: 10168 - DNA, 2910 bp, Oryza sativa
ccgtgattttcgtggtaactgcgcagttaccgcggtaaccaccttaccgcgggggtgcggtaaccgcgctaaaaacggtaagggaaaccctggtagtaagaaggctattccattggacaagttggtcatacttgccgggtatttgattgagggaatggaattgatctctcttttttttttttgagaaccgaattgatctctctagcgtttggttaggacttaggagacagttttgtcagtgaaaaatcggtatagcttcataccgcatcttgaagagattccgtacatcctccataaaaaagactcttagaatatctagaattatccatagaaattaatatttttgatggaggaagaggttggaaccagactatgttccatacctctatttcttctctatctctatctctactattataaaaattaaagatgtttttgtcaagattttggtaattgtcatccgaatccttttacgatttctagatctttacctatactttttttaaaataataataataataatgattatctactcattattctttcgtttgttatccgactctatctatatgggttcgcaatgcacacgtggtagatgtccgactcagtccgcgagaacatgatgggcgcgtgattgattcagaacgttgtagatgtaacgcgagattggcagctccctattttgtgatcgattttgctacatctcaatcgaaatattttttttcttatctctcacttgattttcccacttaaatatacagtgtattttcttgtaatttacagtgtaatttataaaacttacattgtaacttttgtaagttacagtgtaatttttgaatcttcgtatgtaagttttgaaatttatattgggtttggtctttttcttgaagatatggcaattagtatccattatggtgtttcttagttgctttttgtctttttgctgtgtctattggattttaatctaaagattaaaaatctgtgtgatatgatgtcatgggctttgggccgggaatcctagacccattggatagagttagggtttgttaggattagattaaggagtcctccatctatataagtagggatcctattccagattggcattagatcaaaatttatcttagtgcccatcggcctgccttctcagtgcgacaaagagcgtctcgccgtttacgttcaggaccgttccttgttatttcatttactataatccaatctatttcccttcgtcccttttcatcccaaataatcctaacacgtgataacttggtatcagagcttcggttccgtgcccatgggtgccgagatcgctgtggttctcaacattagcgaaggccttgccgagatctcgaagaagatgatggacttggtggcgcaactctaggccttggcagcccagtcagccgagccggcggccttccttgaggatgccgaatcatcatactggcatgtagcgtccttgcgaccacgagggcgcgtcttcaagcggcacggatggtggcagtaatcggcggtgacgccactccatggcaggccatcgccgacaaccttctttacgtcatttcgtcgaccatagggcgggatcggctgcaggttccatcggcgaccaactatggcgcaactgggtggtgcgctgctaggattagcatcggtgatgcctcttgcctccgccactcacgcatgcgcagcccagcccaccgtccggggtcgtcggcaatggcgttctgcaaccatgcgggggtggcgtgactcacggcgaggcgctcacgcttcctcgagcggcggcgcaagttccgagagtggcaggtacaatttggcgcgggaagatagcgacatacatgcggcgtgaattgcgggaacggcaggtgggcgagcaacctcggcctcgccgctgggcctagcgatggtgccgtcgctgttggcgccctcaacggagtcagagaagacgacggtgagttccacttcgatggcgacacaacacggcgacggttggagcagagccagccggcgtatggcggcgcgattcactagcgcgacgggtgggcgcggcattcgcttgtcgtgatggcgcagatcgcgccgggtccgcgagctggttcacgaagtttgcggctcgaccacggctgagtcgttcctggcggcatgtgcgcgttgagaactgtggacgcggcagttgtgcaaggacttcaagtcgaagttgggggcgatttcttttggcgtggcccaacttctcttctcgcggacggcgctcctcacgcgcatgttgttggaggcagcgctatctacgggaggagcaagggtttctcctcttttctcctcatctgggcaatttaaatgggctagactggtgggctgggcttcgatctgcagctgatccatgttggcctagatatgtttggattctggcatgggcctcactttcctttcaaggcttctgggtggggtccacctgtccatatctatgatgacaacataaaagtaaaagtagggttgttcacaacagtagtattaattatataggagtatatatttcagccgagatgtaaaaggcttgtgaatctttgtttaggctatggtactttgtttgagtctagcggggtgtgcctcgagctgcttaaaaagaggggagtaatgtcatgggctttgggccgggaatcctaggcctattggatagagttagggtttgttaggattagatagggtttgttaggattagattaaagagtcctccatctatataaggagggaccctattccagatcagttaggcattagatcaagatttatcttagtgcccatcggcctgccttctcaatgagacaaagagcgtcgcgctgtttaagttcaaaaccgcttcttgttatttcatttactataatccaatctatcctcaatcatctcgaatc

SEQ ID NO: 10169 - DNA, 2154 bp, Oryza sativa
  unsure (1)..(2154): unsure at all n locations
cgactggnncaattagatacacannnnnnnnnnnnnnnnnnnnnnnnnnnnnnnnnnnnnnnnttaataaaaaaaatatgacttagataaaaaaattaaaccataatttaatatttagcgtaattttattttttttcccgttgcaacacacatgcatttagctagtctctactattataaaaattgaagatgtttttaccggtattttggtacgttatccgtgtatgagtcgctttttaagttcattatttgcatttggaaatacaaatccgtgtttgagtcggtatttgaattcgttcgcttttacaaataaagaaggagaaggagacgtataagaaatctcttttataaacttgcatactaacttgacatgatcaaacttataattgcagttcccaccgtgaattttaccttagttaaaccgttcaacaataatatgattaaattagccttcactcgttgctacatacgtgtattttttttcaagtcatctaataaaccaaacaagctgataatccatttttgcttttcagaaatatgctaattcaatttcttcttgtgccccaaccaagcactagctctgaggcgaggcaaagcttttgcctttcttttaaaaaaaacacccaagcactagctaaaaggtgttcacacgaagcaaaacatatcaaatactcctatctctcacaacgtagaataaggaaaaaaacactgtaaaaggtatggaatattcttaacttgttgcaaggaactgatcaaaagcataacctttttagccaaatgcatgatcatattgttgtccatttatactagtacaatcttaacaaacctgtaataaattttggacaaggaaaaaaatattatccatgaaatttgggtgttcattaccatgattgtgactttatgtcaacactgaaatcaaacttactaaattcaacattttctagatatatcgatctctttttagtataaaaaaatatagttacgtgcgtttataaggttgagtgtacgtatattgtgagcgcatacatgatttatatcatgtttcttattaaaaacagtaatcccaaccgttgatcaataaaccagatccttcaatccgaggagaagatgagcccttcccgttcggaatacagtacgtacatacgtatactccgtaacaaatcaggttaattaatttcctctctataagaaatataaaaaattccgcttaataattacctgatctggactacctgagcgacttggtctcgtctcctcgtcttctcgccgccgccgcgagcggaatccccctctcttcgtctaaacctcgccgccgcggcgaagcaaaagcacctccctcttcgccgccgcccgccggcaatggcggggctgtcgctgcggtgcggcgactgcggcgtgctgctgcggagcgtggaggaggcgcaagcgcacgccgaggccaccaaccacgccaacttctccgagtccaccgaggccgtcctcaacctcgtctgcgccgcctgcggcaagccctgccgctcccagaccgtgagatccccccatccccctccccaccttccctttggttttcactttctcgatcgaattccgccggattcggtggttctcgatccgattttagtctcacctggttggttgtgtggatctctgatcttgcgcggcgcaggaggtggacctgcacaccaagcgcacgggccacacggagttcactgacaagaccatggaggcggccaagccaattgatctcgaggcggcgccgccgaagccggccggcgaggccatggatgtcgatgcctcggcaagcgccgagccacaaggtgaggtggttgttgttgagatgatcgaaagggttatgatctgtggccgcctttgggtggcaaagagtgttgaatcttggtggctttttgcttccggcagagatggtggcgccggaggttaacaaggagatgctggcggacctcgaggcgatggggttcacgacggcgcgtgccactagggcacttcatttttctggtatggtgtagcaagatagtatgtcttagttcaacatttgtaccatgctgtcaagttctttctccaacttagattttggggatcctctagagacgacctgcaggcatgctaccaagaggttattcagcaatcaagccccat

SEQ ID NO: 10170 - DNA, 967 bp, Oryza sativa
  unsure (1)..(967): unsure at all n locations
ccgtgccnatttgatagtnnnnnnnnnnnnnnnnnnnnnnnnnnnnnnnnnnnnnnnnnnnnnnataatcgagctacttaaagaatatgttgattgctttgcatgggaatatcatgagatgccgggtcttagccgtgagcttgttgagcatcggcttccaattaaaccgggttttaggccttataagcaaccacctcgtcgttttaatcctttgctatatgaccgagtcaaagaggagattgatcggttgttgaaggcggggtttattaggccatgtcgttatacggagtgggtttctagcatagtcccggtggagaagaaggggagtggtaagattagagtttgcatagattttagagatttaaataaagccactcccaaagatgagtatcttatgcctatagccgacatgatgattaatgatgcctcgggtcataaggtgattagctttctagatggtaatgccggctacaatcaaatctttatgacggaagaggatatgtacaaaacggcttctaggtgcccgggatttgttggtttatttgagtgggttgtcatgacttttggattgaagaacgccggtgcaacatattaaagggcaatgaatttgatctttcatgatttgctaggtattatcttagagatctacattgatgatattgttgtcaaatcggatagaatggaaggacacatagccgatttgaggttagcttttgagagaatgcgccggtatggtttaaagatgaacccacttaagtgtgcttttggtgtgtcggcagggaagttcttaggattcatggtgcatgagagaggggggatcctctagggtcgtctgcagggtggtccacgattctaaatccccctgggggggggggnngngatataataaagcctcttgttccgcccccattttcacgttgcataaggaaagaagtttcaaccaccatcaatttagctgctccttggt

SEQ ID NO: 10171 - DNA, 3225 bp, Oryza sativa
agataacagctatggtaggcgccaaaagcctttttccatcgggcgaaaattaagggttttgatcccccagttgacgccttgtcccgccaggtatcagcaacccgcccacccttccccgcggggggattcgggttcccttcctttcccctttctttccctcccaggttccagtgaaggttagggcctttcccgccggtcggtggcgtccccgaagtccggaaccgtcgcccccaatgggggtcttcacccggcgtcgccaacggaaacaggcgcgagatccggcgtctggaatacccccgccaacgggagtgggcgccgacaccggccctcgcctaggtcgcgcccgccgttttgattttggggttttggttttgatttttcttttgtttcatctttttattttcccatgcaacggactgcccgcgtgcgggtaaggtacccgcatgcaaaaatcggaattttcgcagacccttcattacagacgggcgaaacacccgcacgtgaaaatgagtttcgaccgcccggaaaaatagttagtgtagtagtgtactatattgtttcctttacgaaacacaatacagacgcatacatcatataaatgtgtgtaccctcacccatatataacacgcgcacacacatctgttgacattttagatcaagactacggtatttgcatgatatggggatcattggtaacatggtatatgcgagattgagataaaagaggcagagacaaggatttttatacaacttcgggccccttattcatcagaatcaggtaatagccctacttctattggccaaagccggtgttgctcttattcatcataatcaaacaagtacagcatttaggataacctatttagtcatcgttgacttggcggcatggaaaaccaacacgtagttgacgacggggtagtctttctccttgaatatgtactcgtcgagatcagagatagtgctaaattcctcttattggcctctgtaggcgccagattgggtatatctaggattatctctaatatcaatatttgcaggcctgccttggtgtccacgtcccctctcctcttatgaggtcttgtatttatacccatagatgtacccttgtccaagtagaactagggagaacaatatggatataatccgagtagtccttatagtttccaatagaactctttttgtaattttttatccggaactccttctatataagagatatgattccgtataagacttggtatatggtggtctcgccgagtttagtcgattactattgggtatgtgtgtatccataaccctgataacatcctacccctataaatgcctccaagaaccaggccctacgaacgcctacacgtacaccttaactttatgaggacatgccaatatattttgagattcatggagtcgccatggctgtaccttaaaaaatatagcagacatatcttgagattcgagagacattcgaggactagactgacataccttgagattcacgaagtcactatagataccttgttatcgacagatatatttacaactagtggtaaatgtaaacatccttgtcaagtctaaaatttaaatcatgatagcaggtttcatcatcagaaatctaacaagttgacactctcttgtagcaactattttaattccctttactttatgaattagtttgttaacaaagggtggggcatttattcaagtgaaatggccggtggttagtgaaagataaaaggatttttataatgactatacaaagttaattaaattaattaatataaacgagattagtctacctagaaaccttttaaaaaactgtttgttttcatacacgataacgtggaaaacatacttagggcttgctcagattgatgtcatttcaaatcatatcgttttttttagagttgtcaaatatgttcatccattattttctggccaaactttaataaatagataagaaatcctgctaaaattttagcaatttggcaatattgccaaaattttgtaaagtttattttagctacaatctgaacaaccacttagaaatcaatgaaactactcttttttttatcatatttcatatttgacctattttttttaaaaaaatcaacgattataacacatgggttcaaatttcttgaatggtggggaagcatcagtggtagttcaataattaagaatgtatgatccaaacaaaaattaatatgtgattctacttcttatacagctactatataacgttttaaagtcctcacaaccaacatgtgaaataggcgcacaagtagggacggatctaaaaaaaatagtagtgaggctgaataaacttcatcaatataaaccgaacctccagtcccatatcctatgaatctatggaaaaaaatttaatgggagcttaggaggatctccactgtcccgaggacggtagtccgcccccattgtgaatccgccgctgcgcacgaggaggtcaacataacttatttctttacaagaaaaaagaattgcaaaaggagtgagcaatgatttgtggcccgttgtccacgttgctgccgagtgtgaaaacaaaaccacaggggtagtacaatataaacaacacgtcagagatcagacacccacctctccacctccctcctctcctctcctatcgtccccacgcgcactccaacttgcgggcgatttgttttcccccgatttcctctcgtccgatccctccccatcacgaggccggagcgccaccccacactgcctccgctgctcccaaggtatccctcccctgccctgccctgccccctccacctccgccggatttctcagccggcgtagagcggagatccatcagtggtggctcggatttgttttttttttcctttttgggtggtgatttgactccaactttctcggaccgtgtcgagagctttgctccgatcttctttttgaatcgctttgggcgatctaagcgtagactgttctctctgtctagtccgcccattttgtttcggattggtttggttcgtgcctgcgaggtggtggtggtgggggtaggtgtggcataaaggaacaaggagaaaaagagggagggaaagtaagaaactaaaagcttaaaggaaaggaggacgcaaccagaaatggaggaacgaaaaacaaaaagaatgcaggggaacgaccaaaggaaacgaaggaaagaaaaaaaggaaaaaaaagccacgaaagggaaggcattggaagagg

SEQ ID NO: 10172 - DNA, 2935 bp, Oryza sativa
  unsure (1)..(2935): unsure at all n locations
ccttcgacccttcaaggaaaaaccattccaaagtcttttagtattggatggcatttgatgcaccaagaattactaaaacagagacatcaaagttgaagaacctcatttcagcatcattcaaacccttgtctcttaccatccccataggcgacggtttccatgaattgtttcctgtgggtcactgtcatttatagcagataaagtcttatagataagccaaagtttttcatttctgttggctaacaaggggaggcaaaaattgagttgcgctctcaagagtgtacaatgcttacacttgttggcacaagagattcttttgctcagtcacaggcacaactttgtgctggcatgcagctcaaggctccaacaagggcgaaatattcccaaggctttatgcccataggagaatccgacgcatactgtgctctaatacctggcttacctgaagatctcgcaaagatatgtcttgctcttgttcctcggagccagttccctgttatgggttcagtgtccaagaggtggatgtcattcctcgagagtaaggaattcattgctgtaaggaaagaggttgggaagcttgaggagtgggtgtatgtcctgactgctgatgctggatcaaaggggtcccattgggaagttttggggtgttcagggcaaaagcacagccctcttccacccatgcctgggccaaccaaagctggttttggtgtggttgttctagatggaaagcttttcgttattgctggctatgctgctgatcatgggaaggagtgtgtttctgatgaggtttaccgatacgattcttgcctaaacaggtattgttggcttttcataggcatcaataagtctatgcgcagacaatagattttgctaatttaaagacaatcattgcaatttgcgaagactttaaggcttatattaacatgctccttgtaatctgaatacaaacagtacttatttacagaccatgaaatgttcaaatgcaggataataaccagggttttgatatttcgaaatattggactgacccatttgtgttatttgtaggtgggttgagctttctaagatgaatgtggctcgttgtgactttgcttgtgcagaggtcaacggtatgatatatgttgctggtgggtttggtcccaatggtgatagtttatctagtgttgaagtttatgacgcagaacagaataagtggacattgattgagagccttcgccgtccaaggtggggctgctttgcgtgcagctttgaaggcaaattgtatgtcatgggcggtcgttcgcgcttcacaattggtaacacgcgttttgttgacgtgtacaatcctaatgacaactcctggggtgaggtgaagaatggttgtgtaatggtcacagcccatgctgttcttgacaaaaagctcttctgcatcgagtggaagaaccagaggtcactcgcagtcttcaacccggctgataattcttggcagaaagtcccagtgccactcacaggtagttctagtactcgtttttgtttcggcatacatgatgggaagctgctgctgttctctctggatgaagagccctgctataagacactgatgtatgatcccgctgcaccaacgggatcagagtggttcacatctgagctcaagccaccaggattatgtctgtgcagtgtgaccatcagagcctgatgctttctggcttgtatcgccttaccatcatccttgtaggatgccatccgataccactatttactgcttacaatcagagttgaactctcatttccagtgtcgtttgctcaggtattttgatatcaaataatgctccagggtgcttatgctgcattcattcgattgcagcgttgtgccaggatgcactttgtttcatgtattttactgctagttgtagttcacatggttgttgtcgttgtactggacgatgaatagctgataggctgatatgcaactgtagtgtttgtggcgggcaaagaggctaattgtcagaaaagatttgtcagctcttgctgtatgtaaaccttgttgtctgaaacattgtcattcgctatttctgatgctctgtttttccatatgaaaagtgggttcttgcttctgtttgcttgaggaatccttggacctcatttgaacgccttctgcatatcctctagcctttgaggatccaaatgactaactttcaattttttccatgggctgcttgtaccattcacgcaagtttactgctagtggagttcaataaaaataagttaaatttctttctgcaaaaaacaaaaagaacacccttcaagtgtgcagctgcagagcgtacaatacaatgatactgtaccatctacactctttctgtttgaatgaaaggtattagctgcctttgagctgctttattagtgtataaatcaaaaacgacttctattttatgaatcagagtatctctttcttcccaaagaagaaccctatatataaatgtgacagcatcatgcgttcttcgtgaaagcagataaccacgggccacaccaatttcagtaggcggacggttgaccatttctagcttctcaggcactgtaaccacgggccacaccatttcagtgatgccgtcccaataatctggctaatcagttccccgtttgaacatcaaatttggcacttcataaattcatagtagctacgtttgttcattcatcaaatagtaatactacaagtctaccgtagaattatgtaggaattgcagtaccttagcggtatatatttttcaatgatcgatctggtactaactgtggtggnnnccctngctctccgataggagttgatcaacaccaaattgtnangcnttcatatcatatacactttcgcatacaattacacattcggataaattatccgagaacctaacatataccaaatcacnataacactatacctatacacctatgccattatcgg

SEQ ID NO: 10173 - DNA, 5189 bp, Oryza sativa
  unsure (1)..(5189): unsure at all n locations
tggactgattgtgacaactatgctagccgcctgcggtcgactctagaggatccccaaataattaatatggttttaaagtaactcttttatatatatatatatatatatatatatatatatatttaaaaaaatactatttaatcgttaaaaaatgtacacgcaaaaaccgaggatcttttcactactacataacaccacatcaatgccagttgggaaccccacacaggaaccggcacaaaagaggcggcactgatgtgaatactcaaagatgccggtttaggtcccaagaatccaaaaaaaaaaaagggctcaatgcatcggctcgaacattgagtcgttccccttcaccccgagacccgtcaccccgagagatccaaagcaaatcacagatccctcaacaatttcatagaaacaatcaccgttgccgccacgtcgccggatccgtcgcgggagccaccggcgtcactgcttcgcccgccgatgccgatcccagatgcggctccgcccgccgttgccaccccagccacctcggctcgatttgggtgtcgggttttaattaaccgacacctataacatattataggtgctgatntttttaaaaaaccgacacaatatataataggtgtcggtttttattataattgcttaaagggtggcagttttttgcgatttcaacccgggaggtaggaaaatgcctatatgccgggtttaacactatcgacacctataggggcgacacctatttaatggtttgtagtaggggttcttgtctatcgacagtctcaaacaagtggtgaagaaaatggtacagaagtggcagggtgattataccggtcaagggttaaataacgtacacccaacatcctaattatttttatattttaacacagcattcaaaatggtactttgagcaaatttcacaaaacttcatatattttaaccaaactattgcaaaactatagatttaaagtgatacatcacaaaattacatatacaaatgtatgggagagtatcgtaaaattacagatctagtaacaaagcaattacaaaactacatgtttattatcaactaaatcacaaaacttaaatgtttataactcaaacataatattaatattagtgctaaggatttaaacatactagtacgaagatagatagatagtacgtataagagtatagtgtacattatgctgcatgtttcatgcaattgaaagaagagatgattgggaaacaccattaatagggtggtaaaattatgagtccacgactccacctactattaggaaacaacttatcaggtttaaatcttggcgtctataaatattatgcacgtgcgagtgcgttttcaatggaaatttagtgaagtcaaaaatttatcgctggtcttcgtctcgttaagagcattgtgtgtgtctgattgcggtgtgcgtgtgtctcccgtgcggtgttggcgcgcccccgtcccccctatccttttgggacctttgaccgtttcccgagtttcaacgtggcatccggtctacccatggtcccgcccgcctggtctccctcgcggtccttgtttcctcggcccgcccaagcacccgtcggccgtcgctgccttctcggccttccccgtggcgtgggcggccgccgcccttggccccacacatctcccaccaaaccacccaccccaacgccacctacaatctagctcctcgctccgatcgaccatccatggggaccatcaccgccgccaaagcagccgcggcggcggccgtcttccagtctccgtgctcccctgcgcctgcggccagcttccccgcccgcagcgtccggccggatcgccgccgcgccgtctcgctctcagtctcaggtaatgaccgtttgatttaacgccttattattattgatgatgaaagcagagaccatatgacccacttgtcgtcgtggcatcaacatgatgggataatggcaaactgtgactcactcaagcagtgctatgactatgtctatgttggcaattctctgaaaatgtaggtgtgttcgtgataattctattaagtttttgtgttgtggaaaacgcaccgattatacggccgttaatacgttgacagtgattagtccgtcacgtttttgcaaaacggtcttcactaatcgtttcacaacgaaaaaaatctcgtcattgccgattaatcttcccgtttgtgtctaatcggccgcataattggcctgatcaaaaggctgaaccaacccacaacgactaccctatcccatttgttgttttctctagtaggagtataaagctagctataccagtacgtgaattcctctagagtatctgatgccgctgcaacctggtctaggatgtgcacgcctaaagtttctctctgaagaacataagataatccatgcaaaatatttttccaatgcactaatactagacagatttctatatctgtataatagctctcatggttttcaccttttcctaattgtagcatattatatatgtagtgaatttccaatatatgagtctacaatatgcataacaatatttacatattcacaaccgttaaatttccgtcaaattccgattaatcgtccgtattccgattaatcgtttggcggtacccactctgtccaacatccgcattccgtcttccacaacactagttttgattatgttttcttgtaaggtttttttctatcaaattttctaggtttctcttgtgatgaaacttatattttgtatcattggtgatcattaccattaaaaagatgtgaacattagagaatgacctaatatcaaataattagtaattaaaaggggtgaggcttcgaacccaggtcgtttagcccaccaccttgtggagctagccgaaagacccccgggtgtttctcaatgatcattaccattcaacatcatggttcaaaattttcgaatttggattttcccacgcccaacagggattacttttggttgaaaaattttagtcgcttgaatttagcgggaatttgttcaaagtcagcaaaaatctgttcgaattttaaaatacagcactgaagtattttgccgagtcaaacactgtccaaatgcccacatgttcatgatacgacattatttttagttttaccttttgttctttttatcttttaccaacttcgacaacttcctttttgcttgtcaatactagttattcactcttacgaatatgaaggaaaagttgaatggtttgacatgccacaaatttgcttttaaatgtttaaccaatcgtaacttcctatttctcgtagaacttggctacattgcagttagcttaatttaatttcgtttaggttcggttggtgcttaaagtggagttgcgtgggaaatgtgaactggtaatggtagttcacatatactatatatatctgttattagacagcataaacttatcttgttgttttgtattttggaatatgtaatgcttaagatttatatttatactgtttcagttaatcttcttttgcgaaccaaaaaaaaaaagtgttactcacctaaactatgccgtttgcaggtgtaagaactcatgttgcagctgttgaacaagcagtggtacaagatgctattgcacagtcagaggctccagttgttgttgttacaggtgcttccaggggaattgggaaagccattgcattggcttttggaaaagccggctgcaaggttaacacttagtaattgatttatgcttatacatctatagaaattttatcaaaagggctgatgcttatctgagccactgcaactggcttatctgagttacagcaggctggaaacttaaatggttaatttatatattcaataggatcataggagtatcccaaatgactgttattgacaatctgaatagatgaattgatgaaaactttagttgcatgctaccctgtgaaagaaatttaccttttatttaccttcaagtttcatgattgtgaatcatgtaggtgcatctagaacaatacaaagaggattgtatctggaaaattgggttcaaatatttatctgttgcctagttgttatgctgaactagaataatttccctgagtataacacaagttttacaatcaaaggggaaaaaaaaactctacttacctttcaggtcttagtgaattatgctcggtcttcaacagatgctgaagaagtctgcaaagaggtaaagctttgtgttgactagttactttgttcatattttttttaaagcagcataacgtagatgatttgtaatacgagaataccccgaagcattaatttaaactaaaactgcgttatgttcttatctaaagtaaagagtaaatttcacaaaaccataaataatcaaaggaaaatacaattgaatgttgtttccggggtgcatgtgttttgaaaattttgttctgttgttctgccttaaatagatggaagaagatactgaggtttccgtattttacagattgaaggatttggtggtcaggcaattaccttccgaggagatgtttctaatgaagccgatgtggattctatgattaaagcagtaagcatagtccattcgtgatactctgtgatactggttttctctcttcaaatttctgaccacgattaatcatccaggctgttgatacatggggtacaattgatgtacttgtaaacaatgcaggtactcctaggggaatattatatcttttttttacacaaaaaaaacaatttattttacttttaagttttaaccctgaccattctgatattcaggaatcacacgggatacattgttgctgagaatgaagaaatctcagtggcaagatgtagttgatcttaatcttacgggcgtattcctttgcacacaggtactaatcacacattttctcatattttgtacttaaaatgctttatgcatcatactgcaaatgttttttttgcaggctgcgacaaaagtaatgatgaagaagaaaaaggtactccatatagttcatttctttaccagattgatatttgattgttttttaatatttttatattttttttcacgctgttctgtactgaacttcaatacggcaaatttgcaatatagggaagagttatcaacatagcatcagttgttggccttactggcaatcttggccaagttaattatgctgctgccaggggatcctctagagtcggcctgcaggcatgcngccagtgatctcatggcgcg

SEQ ID NO: 10174 - DNA, 742 bp, Oryza sativa
  unsure (1)..(742): unsure at all n locations
cgtgcgccaaagttagaacaaactcttgcatgcctgcacgccgactnagaggatccccttgatgttcatgttccaatcctgtgctatattgttctagcaaattttagactcaaatgtgtagatgtgaaaatttttggatgctggaacttatgggaggaggtttgcccggagccacaggccttctgaccgtgggtcagccgccggtctgaccggccggcaaccgtcggtctgaccggccaccagtgggcggtctaacttggctgatgccgtcggtctgtccggccaccatgggtggtctgaccggcctgatgccgtcggtctgaccggccaccatgggtggtctgacttactggctgcggtctaaccacccctccactggatataggcaaattttcacctctccaaattgtttctagaattattgctaatatcctatcatcctttgctctttttacaatgatgcctccccgcacttgccatggtcgtcgtgcgcccactccggatcccgtgagtgagcctaaggaatcgagcggagaggattacgctcacaatgatgaagaggttgaggcaaatgttgagggggctagtgaggtggcaagtggagatgatgtcagtcgtagtggggaggatgaggatgaagaaagtgatgatatgcactttgatcccttcatccagtttgtggtgaacatgaggaatccagtacagtatacctttttgaggctttatgaacagtttttgaggg

SEQ ID NO: 10175 - DNA, 5282 bp, Oryza sativa
  unsure (1)..(5282): unsure at all n locations
gccggccttttgtttggcattgtanaaacnnnnnnnnnnnnnnnnnnnnnnnnnnnnnnnnnnnnnnnnntcatcgtcatcatctggcagtggttgggctgcagccgctgccagttcagcctcgtgcctgcacattacagagcaatcagaaatcgttcaacaatttgaaggcataaattaaacacccctggtagagcaatttcgtaagaacactcactgttgctgggctgctagatcaattgtgacatctggaggagcaagagcaggtgtttccacaaagtggaggttaccatcgctgacaaagacagagaacagagttggtttaatccagtaattgggttgctgaataattaaagattgatgataactgaggtcgttacccagcaagtttcctggcaaggtacaggaatggcttctcaaagttgtagttgctcttagctgacacctcatagtactgcaagttcttcttcctatggaaggtaacctgctttgctttaacctgcctgttcttcacatcaaccttgttaccacagagcacaattgggatgttttcacagaccctgtaattaatcaagacctattagtttcaaccatcagtttgtggtaaatgtatttgctcagttccactgatatacctgcataaatcacggtgccaagttgggacattcttgtacgtcagccgagaagtaacatcgaacattatgatagcacactgcccatggatactacaatgcggaatacatgattacagttagtacaaaataaatagaatttcagagctttgttacacacagcatacagtaactttacccatgagtgcaatcaaacagcagaatgccacaagataagaagtcttctcacaaatttagtagtactaaagttgtataaaatgcatggcatatgatgctcaaatccagcattcatgcatattatgagtcaaagctaaactgaattctctccataagcatatatcagcatcgtgtgcatcacaaattgttatagaacacaagaactaaacaaagaactatatatatctttctaattcacccactaaggcactatcaacaaaatccaggattcacataaagtgtcatgagaatacaatagttaaatacaggattggaaaggatcaactaaaatcacagaaatagtctcacacaatagtaaaattctaacagtgcttatattcctcatacaaattacaatgtactaggctaggcatagcaaagaatgacaaaatggctgaagatcctaaataactaatgagacaaacttcaaattcaatcgatgtaataatacttactagtaaccatccctgagtccaccaaatttctcctgaccagctgtatcccagcagtagaagcggatcttgccgcagttagtgaagaaatccaaggggtggacctccacaccgatagtagctgcagcaaccacagtcaaattaacacgaaaaacacaatgatccaccataagaatacatgataatgcaaaataggagcagatactcacgctcatacttcttctcgaactcgccagtcaaatgcctcttcacaaaggtggttttgcctgcaaatcaaaaagattgcctggtttcagaacagacagaaattttcgagcctggcaatttcgagcacaggaaacaagaaatttttaatcctataaattttcgaaaataaaaaccagagagttcacattcatccgtgacaaatcaaatctaacacagtcctcccttccccaccatccccttcccgagtcccaatgctatgtactcgaagaggagcgagtctgccagattaatcggtgccagatcaaaactataataacacagccttatttctctatctctaactataataacgatcttaatttatttacaaatcaaaacaaccactacaacgatcttaatttacaaatcaaaacaaccgtggctgtatctctccgttcaatctatctagggttcagcgaaccattatcaaggtcgcatcaaccaagcatcaccacacctataccgcaacctagaaccaaacagatcgaaaaaaatcgtaagagaggggagggcgatcgcgaggctaacccgtgccgccgtcgccgacgatgacgagcttgaagctggggtagtccaccgtctgctgattcgggagcgcctaaaaaaaagtaaaaaaaaaacaaacgcaacgacggtgagggtgagattggggggagatcgaaggattgatagggcgagagaggccatggaggggagcggggcgatcaccattggcggcggcttccgtgcgctcgagattggggggaggcacgcggaggtgtgggggattagtttcgattcgaaggtggcgaaggcgagagacgaggagagggggggttggtgggatttatgggggaggggaaggcgccggcgaaccctagcggggctagtagcttctcgacgtttggactgttccaacgtcaaagggcttttttttttcttttttttccctttttttctttggaggcctttttctccttttttttaattccgtttttccttttgttgccttttaataatctgagtacattacttttgttgccttttaattatgactgcacttaaaatgagacaaagagagtatagttttttttggtgatacgaaatacctaagagattatatcgggctaaactaatatgcatgcttgttatttccctagtcgcctgactttaggcgatctttctaatctttctatgggagaagttaccatcacttatataatatgttattttaaacttcttgctatcaaataaagtacataagttcttaaaaaagataaacaaactaatgtacatccactaataataaggtaactaaggaaatttccatggatgatggtttgatgtgggtgaatatcatgttgctcattaatcccctgatgaggcacgtgtgtcctctgcaagatgcgaggatcctctaagggacatgggcctagcctatgtggagcgacaacatagatggggtgtgaggatctcgtcatgttgttgcactatgaatgatctaagtatgcgcgaataaaaatctatgagaaaaggtaaacagagatagttggataaagaaaagagagaatccactcactaccactgagttcagcatagttcaacaatatgccactgattttatcaacattcataatataccattgcctttcacttaacctctacactttatcatcgccgtccacagtctgtcagttatacgccgtttgtactgttatttttttcccgtaatgaccgaaataccctttgagccatctaaccctagcactgaccaggccgccccaatcaaccattctcgagcgccgccatcttcccagcgacgccgcggcttttttccgcccgccgccatgccgcatcagcgcccaccgcgacgccccatccgctggctgcccccaccgacccctcgccgctatggccagccctaatcctacgggacagccgcctccctccccatcgtcggcgcggccgccgtccccagcgtcgccccgaccaccgtccgcatcgtcggcgcggccaccgtccccagcgtcaccccgaccgccgtccccatcgtcggcgcggtcgtcgtcgccagtgtcgccttgacagccttcttcagcgccgcccctgccgtcctcagcgccgcccccactgtcatccccagcatcgccccgaccactgtccccagcggcgcccccagcaccattcccagcagcgcctcgacttccgtcctcagcgtcgcccccaccatcatccccagcgtcgccacaacccactgtccccagcgacgcccccagcaccgttcccagcagtgccgccccctgctgaagagccgtcgtcgcagatgggagaagacgccccttgtggagagcagccgttggtgctgccgtcgtcatcagcgccgccgtcgcaactcgcaactaagggacggcttcccttctgaagagctggtgttgccgtcgtcgtcatcgaaagaggtcgtgccgattgctgtgccacttaacttgtttatttagccatgtgttggtttctgtcctggaacatgttgtggtcgaacttggttatgccaaacttggacattggattttatgcactgttctgtcaaattgtgctatgcaccttccatggatgattttccttccaaacccctcactgatacactactttgtcctatgatgtgagatctcatatgatttagttgcacaatttttatattgcacacgtgctgtacataattcatacttaaaatatgttgagctatccctattttttacatgtttattcatgttgtagattattctttgtatagttattatcactctcagtgccctacatggcatagtctcagtgctaatggttttcacgttcctaagggcatacttgtcttttcctcgttgcaaactaacagtgtgtgacggtgatggtaaagtgtagaggttaagtgaaaggcgatggtatattatggatgtcgacaaagtcagtggcatattgttgaactatgccgaactcagtggtaatgagtggattctctctaaagaaaatcatagttctttctcttttttacggaaaaggaaaccaattgtctcaaaagtaaaaaaaaaaaatcttaggaccaaatcaattgtgataaatttagcaaactggtactccataatacaatccaaagtttcttaggccctgtttgtttcaacttatgattattataatctagattattaagccagattactataagctggattataataagctggcatagaataagctgtgagttgtttatttgtctggattattgaaggcatggattattgggtttgaatggctaaagtctataatgccctcagctatctgttcggttgatggcataggtgggtaatttttctcaagtatgtaggggtagtgggtctttagccacttaataatctgaaaaaagctcctctagagtagcttatcagattataataatctgacttatagattataataatctacttgtttgtctcagcttactcctaataaactagattataataatcctaagctgaatcaaacagggacttagcctacttctgttattcatgtatctattactacaaacaacaaataggggacggccctataggtgtcgggaactctagacccaacacctataagccttccccgaactcctaacaccacatgtgggtttaaaattaaaaaccaatacatgtagctctttataggtnnnnnnnnnnnnnnnnnnnnnnnnnnnnnnnnnnnatgagatatcatgctgtcc

SEQ ID NO: 10176 - DNA, 2104 bp, Oryza sativa
  unsure (1)..(2104): unsure at all n locations
cgtgggcattgatagtctacnnnnnnnnnnnnnnnnnnnnnnnnnnnnnnnnnnnctaacaccacatgtgggtttaaaattaaaaaccaatacatgtagctctttataggtgccggtttattaaaaaaaatctatgacaaaacggtgtagtaaatatttgtacctgcttttacgataaaccggtacatataagaagagatagaaaaatcgacaccacttatgatggagccaagcagagccgaaccaaaccgagcaagccaagcttgaccacagtgcaacatggatggagcttgcgcaaagtctgaactcaagccactcggcgccagtggcgtgtgtcccctcttgtttccagttacccgggttttgggtggggatgaaatagatgtatagtgaaggtggtccaagatgcaaacaaagaaaatgttatctggtccgaagtaaaagtatagctaaacaagcgatccaaattaaaacttttctaataagaaaatgtggctaaatataaaacttactcttactttcatacatcatttacacatgtttaagttcgtttccgattgattttcgagcatagctcaaatgtatgactcaactttcaaaaaggatctggctttttagaacagaattaaaaatacacaattgacttataaaaaagtgagcactagtaatgcttcccattcataatgtctgatggtgcgtttaggttggcacctccggttaagttgatcaaccaaaccccttgtgacagaccttgcaccacgtatcacctctcctcttcacaacaaaacaccaaacgagcgcagctccaaagtataaccatgcaacgcgcgcacacgcgtacatataccagagtacacaccaaaaccaaaaaaacgagcctagcaatactacccattttagcacccaactttggtcgtgccaactgcccccaagtttaaccgcgccttgtattcatatattcatagaatggagggaatgcgacggcgttcgatgccacgcggccgttcgtcttacaggagcagccgccggccggccgtcttcttgcggaggccgacgagggaggcgtcgtcgatgaccggcccgcagagcgagccgtcggtcatggtgtggtagaacgtgctctggaacacgacgcgggtgcggttggcgatggcggcgaactcgaggacggcgcgcttgtacccgccggtgcccttggactcgtacggcaccttgatggaggccctcgccgcgtacgcctcggcgaccatggagcccgcgcacccgtcgcgcgcgtcgcccacggcgaacgacaggcggtacgtccacccgggcacggtgcgcacctcctgcaccagcgccgactccttgccccccaccagctccacggcgcgggcgccctgcggcacggcgaagtgcgcggcgtcgacgtacttgacggccttggacgacatgatcatccacgccgggagcggcgagtggtcgtcctcgatgttgggcgggacgagcaccccccacgacgcgttggggaggaagtaggggccctcctcgaacccgccgttcttgagcatgttccccttggccagcgtcggcgggtacagcgccctgatggcgacgccgtcgatgagcgggccgcacgccgggtcctcctccacgcccgggttgtggatgacgagcgccacctcgtccatcttcgccttgaacgcccacgcgtacgagtcccacccgttgctgccgtagatggtctgcatggggagcaccccccactcggggctcaccgacacgttgagctgctccgcctgggcgcaggtgcgcgccgcgctaaacgtgacggcgtagtaggcgcccctggtcacggcgagccgctgccggatggacgcctcgttgccgaggcgcacggcgtgcgcgccttgcggcaccaccagcagcatgtccccctgcttgtgcccggactcgatgtactccacgaacccggacgtctcccaccccgggatggcgttcgcgccgcgcaccaccgtgccgttcaccaggtccgacttgggtgggccctcctcgaagttgccgttcggcaacagccctgcacaacacacgtcgttgggtacgagatagacatcaaaannnccca

SEQ ID NO: 10177 - DNA, 2241 bp, Oryza sativa
  unsure (1)..(2241): unsure at all n locations
tattattgcatactactagtccagaacactggaccagagaacatatctgattatgcatctaacacgttcacgactagtactaaaaagcaagaatagtttcttgcaaatgggctgcagctgcatatgctttaatgcttgtatagttgtactactactacttttgctcggtcggcatctggtgctgcacaccacgacaccttaataggagattaactatacgtgtacttagtttactttgccagccatgcaacatgtagattgtgattatgcatgcatgccccaatgcgatttggccgtgtggggttaaccaaactacagtataccctgtatatggtactccaatgatcaacgcatgatcgagttcgtggcttcatgctatgacagcgaccgggggaaacatttcgtcagtatatggataatggagggacccgggtgatctatcctactattcactccatgactccaagatcgtaaatcatcacggggcaggcagcttagcttgattacgagcttttagacactaatggcacatgccgcattgccgctgatagataggatcgatcagaacagcaaaacagcttatacagaaaccgcagtaacttcctaacagtatgctacataaatggatgcttgaagtgaaattagagctgagcctgcgcagtgattatcgagcagagttagcgagcaagctaggcactcaccgtcggtgacgacggcggcggcggcgcgcgccgccgcgcaggcgaggagcagaacgagcaccgtgacgcgacgcattgcgctcgtcttacttccttctcttctctcaacggtgaacgcgttgctctctcctctcctctcctcccctcccctgcttcagttcagctcgaggctgctgtgccgcttgggatgatgaggccgagcagggcagagcagcaacttatagaccaagctgccggcgaaacgggcctagggttggtcgattactaccacgaaatgccacgggatcttccgccgtacgcgtgtccccgatcggcgattcggctgagcggatgatgggctccctctgccctcgtggcctcgtaggagacacgccctgcgtgcggtcacatggccccctgatccgcttccgtttcctaccgcgcgcaccggctcgtgtacagtacgtgcggcgcgccgtctctctgcacgcgcacgcgactggctttcggcccggtgaggcggtgcacgacgaggggcagtttcgccatctcgtccgcgtttttttcgtcggttacgtatgcctctgcggttcccgtgataacacagatgccgccgtatgtaatcaagttggttaatggttagcgttcatcatgggattttgcgaggggacaagcatcgtagtcgcacaaccgggcaccggctggacgctgtggcgtgccggtgtttaggaatctttcaccacttttgtcactgagtgagctggttaccatggcacttggaactttcttttttccctttgcggtatggaccatttttcgtgatgtaggagtaagttgcatactcgcatgcaattcgaacggcttcacgtgaaaattcttgtggcccgaggttgtgaagctcagtttaatcatggaaatcgtaggttcagatcgtgtcatcatgtcatcacatcatttccaggatcatgttgtaggctggaaggccggacagcatcatgtatctggatcaaaccctgacaaggatactcaaccgacacatggcgcccatgtgtgcgcgcgtcttaagtatatacgcacttgattgcgcgaggaaacccaaacccccctcgcaaattgcaatatacatgtaccgagtatataccgcgactccgcgagtccgcaacaagattacaacacacccgaacaggggaaatcgtaacgcaagacaaaactagaaactcgattccacccaaaccagcacgcgacccagatggccagatcgacccnaggatgtgtgtgtgcgtgcaaggcgattgaccggcctgcgtgcctcatgcatgcacgcctgttcgtgtgaccgaccgagctcgagtctgcctgactggacgcagtattcgcagcacggcgcacagcaccaaccgtatctctcccctgcaatctggacaaaatttttccctggtgcagagagtacaaatgtacaattccagaccaatcgtgatgctgcaatttgcatgcgcgtacgtgggaggggatcctctagagtcgacgtgcaggcatgaaaggatagtcactcaaggccaca

SEQ ID NO: 10178 - DNA, 2119 bp, Oryza sativa
  unsure (1)..(2119): unsure at all n locations
gcgcgccctttgaatttganattccanctcggtaccctttacaccctgtcatatcgaacgtttgaatacatatatgaagtattaaatatagactaaaaattaactaattgcacagattgcgactactttgcgagacgaatcttttaagcataattgctctatgatttgacaatacgggtgctacagtaaacctatgctaatgatggattaattaggcttaataaatttgtctcgcggtttactgacggaaactgtaattatttttttattagtgtctgaacaccccctgcgacaccctatataatacccgatgtgacacgccaaaactttacacccctgaatctaaacaccctctaaacaaacaaagttgcctctctccctccgcccgtcgctgcctctttctctctcttcaccgtcgccgatgatgctcctcttcaccgccggatctactagggcgaggggtggaagagaaaaatccagggtgggagcagtgcccacgagctactcccctagccacggtgcgcccaacgcggagcccggttccgtggctcgacgaaaaggggccaagagaggagggaggcgcgtggcgcctcgcagctgggttgtgcccctctgctgggagacagctccggagtaaaaccccgacggcatgagtaggggcacggatcagggatacccattgcacatgctcgaagttgattggctgtgcgctagtgttgatgtaaaaacacgaggcctaggagatctgcttaactccaatgcaggtccaaaagcttgcctttaggtgtgtgagcatgctagttgatttgatcctgcaatcaacaataaacaaagacaaagaaaccgcggttaaattcataaacgatagccgattggctagttgccgatgacgtatcatttatctttgagccgatgtcatatgtagatcgatcggcagtcatgaataagtaagaaagaactaaatctactcgatcggctgtagatattagcaatatataattcttatgtcgatatatacttaaatcaagtgattgagttagatcggtcgccatgccgagatagtataaatcacttagatcgaaatatatattaacaacaagattatatatgttcatagcatagccgatcagatagatatagcatgtatcggctaatactccgataccactccatattaagatatcaaagcaagtggaatataccaaacaaaagcctaatatatttaaatgcaacgagattttaacataaagggcagatttaatatatcaatcaagtatataagataaaagtagttaaatcagataagatcggctgaaaccccgatgctaccctaatcagcaaccaaaagcagactagagattgagattctaatcacgacttataaggtcaaactcaactgatgcagctataagtatgaaaagaaggacaatatctagacaatcaagccgttggatgtttcatagagtggtagatatcctatataatctaagtcaacgtcagtatttaacctgatcggttgccttctagtaacagacgttagccgattggaggttagatagcaatattgccggagattatattggatatatgataattcgacgaattacataaacaatattagagtgtcataaagatggaagcactaatcccgagaacgcaagccgccataataagttttacctctagttgaagatcgaaaccgatgtagctcaacccgaaagtaagaactcgtcgaaacaaaacgaaaataaagggtggcgatgcgtcgagattgtattgaacgtgtgttcgattgattaaatggggctcggggtctatttatacccgagattacaaaatacgtccatgtcggacacgactcttatctctaacaaactctaagataccacaagtctttgcggcagacttttgcccaaacatatctctaaggaaattacataaaatatcctaattaatagatacagttgccttctcaggactcaatccgtgcacggcaatcttcatgaagcacattaactcaacctgacaacgtataccgtgtcacattgtcggattcggctcannnnnnnnnnnnnnnnnnnnnnnnnnnnnnnnnnagtntgatctatcaatggcgcgc

SEQ ID NO: 10179 - DNA, 3932 bp, Oryza sativa
  unsure (1)..(3932): unsure at all n locations
tgtggccccaatgagattcgaatctcgcattcctgcangncgactctagaggatcccccgaataccccctgaactattgtggtctaccgaattacacccttgaactcaaaaaccagacattgctcactccgaactttcaaaaccggacgaataacccccttgatccaatctaaagcggttttgtcctatgtggcaatccagtcagcaattcctattttaaaaaaatgtgggacccacatgcatacctccctttcccctcttcctctctctattctctctctctcacacacatatgcacctgatgcaaggggcaggaagtgggcgcctgggcggcggcgtgagcggcggcggcgccagcggctggcgactagcggacggcggcgcgagcggcaacggcaaggcgcggctggtggtgagcggcggcggacgggtggacagtgtgcgggggcggacggtgggctgcttgtctcggcatctgatgggcggtgcgccgcggcacgccgggtggacaggtggcggacgggcttgcacaccccatgagaggttggggccggggactaaccgatgggcagtggcgcgcgcggacgagcggttggcggttgtgcactgtggcagatgagcagtcggtgcgcgggggcagcagcggaacgcggggagggcgcgaggtgaggcggcgtctccggaggtagcagcccgtggctcgcggtctgcttcccctcaccaggactccctctctctcgggcatgggcacatgtcgctcggcacgggaaacgaaggcggcgggcctgttcaagcttgttcgcgtcgtggcgagcgagcagcacgttcgccttcggcatgaatgctcggcttgtctccggttacatggcgcagttcgtggaagacagcgacgatgacgatgttgtcgaccatgaccgcatcaagcccgatgccctggacgacgagtcaagcagcctcgtgatgttgtaccgcgtgtggcggatggcggagcacgggaacgtcaacggcctcctcgccaagcggccctgttcgccgccgcccattccgccctcaccgccgtctcgagcgacagtggctgccggagccctttttgccgccgcccactccgcccacaccgccgtcccgagcgccggtggctgccggagccctcttcgtcgccacccactccgcccgccatcgtcctgagctcctctagccgtcccgagctccaccgccctcgtcgtcgtcctcgaggtgagggagggagaagagtgaggatttgggagagagatagagaggtgaggggtaaaagagagggtgagagactgacatgtggggcccgctgatttaaaaagaaaagaattgctgactgggctgccacgtagaccaaaaccgcttgtaaagctacttgggggggagggggtttcgtccggtatagatagttgagggtgaaaaatgactggtttttaggtttaggggggtaattcgtactcactcaatacttcagggggataattcgtactttttcctaaatcatttgatttttttctaagtcaaactttttaaatttagccaagtttgttaaaaatatatagtaacatctattatattattaaagcatacttgaaaggaggcaccacgttcgttgtgggggctagaaattccaagattaatcagagaaaaagaaaaaaggagagtccaagtagaaatacaatttaaaaatagcttaaattcggaattaaaaataaggaatattgaaagaagagtcgaaataaaaacccaatacgagattaattaaaattcggaataaaaataaaacccaaaattagaaaaaaaaacaaaagaagatttcaagggggaatacaatttaaaattagctgaaattcagaattaaaaataagcaatattgaacgaagaatgcatataagaacccaatacaagattaattaaaatttagaataaaaaataaaataatatccaaaactagaaaaactaaaagagaattcaagtgggaatacaattctgaaacaactgaaattgaaaattaaaaataaaaaccttaaaagaacacaatacggggttaaataaaatttttgaaaaaaaaataaattatgaaattagaaaaagaaaaataagatttcaattaggaatacgatttataaataactaattttggtgataaaaataaagattattgaaataaaaaaccatttaaaacacatgataagataaattaagtaacatgcctataaatgagtagggtggtggcggttgatacgacatataaaaactgttaataaaacaccaaataaaatcctaatgacgattaaaaggagggacgacaggcatgccgtgaagcaaacgtgcaaggcggttgccgggacttctagaaagtaaaaaaataaaccccattgataatcatattcgatttttaaaatctcaatgacaataaaaggagaaccagcgggcggggtgtataggagtatagttgcatagcccggacggttggcgggatttctagaaaataaaaaataaattccaatgatagttatgttcgatttttaaaatcccaatgacaataagagtaggcgtcggatgggccgtagaggagtgtagtggcagcgtttgatgggacttctaaaaatcctaaaaaatgaaacccaacaagataataaaagataataaactctaaaaactatagtatccaatttttaaagattcgggacttcaaaaaatgaaaaaaaaacccagtgataatcatattcgatttttaaatctcaatgccaataaataaaggaggtggcggacgagccatagaggagtacactggcaaagccgctgacggtttggtgggacttttagaaagtaaaaaaatgaactcaaacaatcactatgtttgatttttaaaatggcaatgataataaagagaagaaacagtggataggccgtagagaagtataatgttagcgtttgatgggtaaactctaaaagttataagatccaatttttaaaggttccaaggagaatgaatagaaatagtggtagatcgagcaagcaaataaagaatgagatgacgaaagtaaggggtagtaactggtatgacttttaaaacctataaaattagaagcataaagatgataaggtttggactttcaaagtcttagtacaatgagatagctatttaagaaattttaagtaaaatcatattaaaaaatgtataattttgtatggtgctagccgcgcaattgtgcgggccatctagctagttttcaatataaaacaaatatatttgcaaaatatattcaatgttaaatttaattaaactaatttagtgttgaaaatgttactaatttttcctataacctggtcaaactaaaaaagtttaattaagaaaaaagtcatactaagaaaaaaagtcaaatgacttataatatgaaatggatagagtaatggatagagtagtatatatcaatatatgcatatccaaatgttcgtttcatcttactctttacatgtaacccattgtcaatatatttgtgtgtaagttgttactagtactaaaaaaagagcatcttaataggtttgcggatggacaaaacaaagcgaagatggtgatcccgtttggtatggggagaagggggtgcccgggagagaatttggcgatgcaaatggtcggacttacactagggacgctgatccagtgctttgattgggaaagggtgggggaagagctcgaggacatgggtgagtcctctgggattacaatgccaaaaaagttgcctcttgaggggatctctaggtcgactgcggctgcagatggatatcattcaaggcgccctgggggggggggaagagtattatttcaccacgtaattgatagcgcgtatttatgggaggcgatctttatggacganttatataagaccgacatgtaattaattaaccaccatttt

SEQ ID NO: 10180 - DNA, 1657 bp, Oryza sativa
  unsure (1)..(1657): unsure at all n locations
gtgctgcccattgannaatgnatnnnnnnnnnnnnnnnnnnnnnnnnnnnnnnnnnnnnnnnnnnnaccgccaaatcaacatggacctaataacatggaggatataattagtgagattattaggaatagattcgggattgaaactaggaatcgtgctagagtttacaaaaagccgtatcctgattattatgataatgtgtcgtttccccgtaattatagagttcccgaatttaccaagtttagtggtgaggacggtaagaccacataggagcatgtaggtcaatttttggcgcaatgtggtgaggctaatagtgatacttttaaattgcgcttgttttttttatctttgtccggtaatgattttacatggtttacttctttaccggcaaattctatcatacttgggctcaattagaagaaaaatttcatgattatttctatactggagaaactgagcttaggttatgtgatttaatatcggttaagcaaaagtataatgagcctgtcattgattatattaagagatttagggatgttagaaaccgatgttatagcttgaatataactgatagagatttggctggtcttgcttttaatggtttaattgctcctcttagagaaagactagatggccaacaatttcttgatgttagtcaacttatgcaaagggctctggctcaagaaagccgggttaaggataataaaaaacttcttagatcatatgacaaaaagcctaatgttatgattgattaccctgaggctagtgatagtgaagaggagggtgatcatgatatatatgttgctgaatggtcatggactaacaaaaacaagccttttgtttgctctaacctaatgctgactcctcgcaaagatcggcaaagtgaggttaaatatagttttgatgtggctaagtgtgataagatttttgattatcttttacaagagaaacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctctaagatgaagcttgatcatgatccttttccagtgaatacgattaatttcaatgataagaaggtgttgatccggccggagcaagccgaatctactaagggaaaaggagtggtcattggcgagccaagacctaagatgatagtgccaaagaagccggagattggcgtttggaaggagaataagagtgaagcttcaacttctaaagcccctaggaagaccaaagtgacttttgatatgcttttggagaagtatgagaagcaaggtggtgagaaggctcacaacaaaggaaaaagaccaagatcacctcctagggagtgatttggtcattcaccgagacgatcgcattcacctccatatcatcatctacaagacatgtcatggggttcttattcaatgccgccaccgggttatccttatccttattatataccatggggggcaacaccgccaatgttcaaccatatgcctccaatnnnnnnnnnnnnnnnnnnnnnnnnnnnnnnnnnnnnnnnnnnnnnnncaattntcaaaagggcacaca

SEQ ID NO: 10181 - DNA, 764 bp, Oryza sativa
  unsure (1)..(764): unsure at all n locations
tgctgggccccataganaatcgagtnnnnnnnnnnnnnnnnnnnnnnnnnnnnnnnnnnnnnnnnnnnncaagacaacgggatggtttgcaactcctgagccggtagatgagtttgtcaggcgaaaaattgacaaccctcacatgttcgcacaattttgtcagcgtcggacacggctgtgggccaaaaaaaaccttgccggtaagccttgccaacgatggttcgtgcggtagcgtgattgccacagatgcctgaatgtatatcctttatcaattgtcttccctcctctaaagacacacagcgttgcaggattcctgatggacttttcttgtacagctcggtctcatgtatgacataaagtctgctgcacctggagatcctctcggcttcatctttatcttgagggagttcttgttttgtcaaaaatcttatgaggggctctctccagtcgacttcaatcatgcttatgtcttgagtgtccgtggcctcgattgtttctttccttggtacggatggctcgtagagatgttcaacaaacacgtcggaaggagctgcttctcgttttgaaccaaaattagccagtctatcggttgcctcattattgtgtcgaagaacatgggtgagctcaagtccatcgaatttgtcttccaacttgcgtacctcctgccggtaagcagtcatgttatcatcaaggcaggaccactctttcatgacttgattaataaccgagggtaccgagctcgaattccgcctatagtgaggcgn

SEQ ID NO: 10182 - DNA, 1030 bp, Oryza sativa
  unsure (1)..(1030): unsure at all n locations
atggcngctttgacattcgattgacaaacctctnnnnnnnnnnnnnnnnnnnnnnnnnnnnnnnnnnnntgccgtcccagacctggatgagctgctcggcggcgtcgaaggccgcggtcgatatctgcccccacagggggttcccccgttcgtcggagtcagcggcgaggtcgggggaggggaagaggtctgaggtgatctgggagaggcggttgtcgaagcccgagaggatgcggatcatgtcgtcggcggcgttcttggatgtcgccagcgacttgacgatgtgctgcgccgcggcgagcaccttgtcgcctccgccggcggcggcggcgaccggggactccggggggggaggcgggggcgccgccgacatcgccgaccaatcggggggattcggtggggagggagcggaggtaacttgggtgttacgctgctttgcctagttgccttctctgctttgactgctagtgtgctagtgcttggtgttggctggcttggatcgccgaatcgtcgggtcgggtcgggtcgcgtgtccgaccggtcgcactggtggtggactgagaaggcgagctcaacgctcaacagtggcgatgattttttatcttttggggttggggttggagttggacggccgggggagccatgccccaaggtcgtgtacagtggaccgacgaccactgctccactaccaccagcagtggccggccggcgtgttgccccctacccatgttgcgtcttcttctattcttcttgggtctcagtcttaaatatatctctcaactagatataaaacatcctccaacttaataaaccgtgtaaaagaggtccttcaataatattgtacctggttttggctgacttgacgtctgcgtggctcctttgactttgactggttcttcatcgtacgtggtgttgacgtgtcacttagtgacaattgggtccggaaaaacaataaagcatatgggcccacatgtcagttttacatacacaataataatagggtaccgcgtcgcatntcaaatgggcgcgg

SEQ ID NO: 10183 - DNA, 1308 bp, Oryza sativa
  unsure (1)..(1308): unsure at all n locations
agccccatgatcgtagtagccctggcaccccacctgatggccgtgtcccagtgactccaggaaggagcaggttgaagcaaggaggcataggctttgaacctgtacagttcttcacctcatctcgatctccatttgcaaattcagaaatgatgtgcacattgtgtgttagaggttttctgaataaagtgcatttgcattctgagttttttttctttttcaggctttagatgaagtgactgtacctccatttggtgattgggatgatgctaatgcggcatctggggagaagtacaccggcatttttaacagggttaggcgtgataagctgaccccaaactcttctgtcaagcagcaaccaccatcttctccttctggtggcagaagacaggaacataaagtgcaacaggtatctgtgtgctgtccctaactatacgacaaatcttttgtgacttatcccacataatccatatgggagcattactttgtagtatgattcttgctcaggttataagattacttatggagttatnnnnnnnnnnnnnnnnnnnnatggtgattttttcttggcatctttaggtgcatttgttttgtaatatgctagatttatgtgtacagatatatagcgaagtaacttaaagatgcattaggcagtccctcagtaagtaattctgctgtcccactaatggaatataataaggaccaatgaacatagtgaaaattttatatatcatggttttacttttcgattgcacttctggagttatgcattgtcccctgttctagttcaactctgtttctcacaaagccatgaattactatcgacactacaaaacatgcaaaaattcatttgaatatttgatcacccagaagtcataacagaggtatatacaagagatgcaaattgagttatgcagtttgtatatccatggaatgtttgacctttggctatgtacacctttgggtgtagatgccagaagtggtttgcttccattatctaaaaaagaaatgttttgcctaacaagtcttaatatttgatgctttcttatgtacttggcagattaaaatctgaacaatttcagttttctgcttttaaattcttttgattagttatatcattgggtctttcaaagtgataaactagattgatacaactgagttgggaaatctgaattcatcagcagaattttcagtgcaacactataatgaaaatgtaatcactgatctctttccctctcaggcctggtggggatcctctaaagtcgnctgcgggcagcagcatgagtttgtcaatgaaggtcaaggccggcc

SEQ ID NO: 10184 - DNA, 6066 bp, Oryza sativa
  unsure (1)..(6066): unsure at all n locations
cgcgccatgagatcgctgctcgctgcccgcggncgactctagaagatccccctggatataggtgcatagaaaatatagaatgcgatacaggtctgtaacatatatatatctaagtatataaatcagcttctacagtttccctttcctatcttggctttgtttctcagcatcctgcactagtccatgaagaatgctgatgatgttttacctgtaatctggcttttgattctcactcatgtatctatttatatcgtgtcactggcgacaattttcagtcataaatttgccagttgtaagatactttgtgagaaatgagtattgtcttcatgatgaagaaacttcagaaattcatggaggctaatgaagagtgatcaaagaaaccaacaccacatgcatgattttttttctttcatgtaccatatcaagttatcaacaaaggacaaagtatacacattttaatttgcaagatcacataacaattattagacttaaagctattttatgtctttctcagcaactggtgttgtcagattttctttctgtctaaacacaaacttggtactgtaataattaccaccgattcagtcagaatcagagctgcacctgacggccatggatccagctgaacggagcggcggcggcgggcggcgcccgcttcgccgcctcctgcgccctcttctccatcctcctgaacctcggcccgaggctgcagacgaagtcctgcgcgcgccgcccttcgccggaaagccccgcggcgaggccggggacgccccacctcgcgacgaggaactcgatgatcccggcgtagtcggcggcggtgtacacgccgaggcgctgcgcgacggcggcgaagcgggcgaagaggcggtcgtcggcgccgtcgtacatgaggcgcgccggcatggcgaccttgcggcgcatcatgcgggcgaaggccctgaccgtgtagtccgggtccacctcgaagagcttggcgacgatggcggcgtaggcggcctcgtggcgcttctcgtcggcggcgacggtgccgcagacgcgggccagggcggcgtcgccgtggcgccccgcgtggcgcgccgtgttgccgtgggagatggaggtggcgcgctcctggaacgtcgtgtagatgaaccccatgtacgggtcgttctccgttcgtggatccttgcaagttgcaaccaaaaccaagcaaacaacattgaattgaaatctagccaaacattttgggtgtgttgagtaaaactttctagatgcactgcagcgagtggtgtggttttaacctgaggtctcgggtttaattcttaacacgctcataatttaggtttgaaagatgtgtcagtgaacattttccatgtctaccacagttttatttgttaaaaaaatgtatgtataatttcttcttaaaaaatgtgtgagtgatcgcttttcatgtctaccacagtttcatttgttgaaagaaaaaaaaaagaccctttctcaactaacaaaacaaatgagctacaagagtactaactacggttctataataattgatgctttggacaaggttgaggtcaaacttttataactttgaccataaataactttaaaaatatttggtttaaagaaactaaaacaacatttatagatttatctttcaaagcactataataaaagtaaacatgcatttatttattgaatatattataatagaaaaataaggtcaaagatatatttcgtagaccgtgtcattatccaaaatgtcaattaaaatgaaaccggagggagtaaacaaatgaaccagaatgcctacgcaatattcgaactttttagggatcatgagaatttcacgaaattctaaccattagacatcacgatctaaattgaactgttcggataactcccctatttttcttatccccttctaccttgcttgctcaacctagtttgtttgaagaagcttttagtagaaataattctcccaaaatatctaactccttcaaacaatcatattcttacctagattctgaaaatatatatttatagaattcaaaaaacgactttgaaaactaaaactagaaaaaccaagtttttctatatatttataagctagctaccaacttacagcttctaagaattttaaaacacccgttaacaaggccctaccaacgacctgacaccattacattaagatattgtnttcgtcacctagcaccccactaccctttgtcacaaccggcatcacctcttgcgctaaagagacatgcaagaccatgacacccctctcctcatacctatatcctccctgtagccttatgttattgcttcttctccatcttctctagctctaatgttccatgtaactgcccttctccatcttttacggccgtcgacaccggaccactacataaccaactaattccttgacaccctcgctgcctccactatcctcctccccatacatggcttcggtgacgctattataacctcgcaacctctccactgctgatatccgctgttgtttctttatcattgtgatcgccctctaaataagggaactcctccaacttttcgatctcaaccctaaaacttaaccactttaaaggttacagggctttcacggatggatgtcagctaactaaaccacgaatcgcaaagcaaattgtagaggaaaaaaaatcacatgccgccaaatctcatctgaatgtcatgtcctattaacaaatctgtaaatgtaaaccagcaatcttatagtagtatatacaatatgtaatattccctccgttgtatatcgtaagttgctttgacttttatcttaatcaaactattttaagtttgaccaagtttataaaaaaatataataatatttttaacacaaaacaaacatattatcaatatatattcaacatcagatttaacatattcaatatcagattcaatggatgttattgatattggcatattgctaatattttctataatcttaattaaactttaaaaagtttaaatagaaaaagaaaatcaaagcgacttgtaaggtgaaacggagggagcaaatgcttaccatgccggagccaatgaggtactgtatcgtcttctcgacctgcctcatgtcgaccctgccggtgaggtagaggtacttgttcatcaggtcgccgtgccggttctcctcggcggcccacgccctggtccacacggcccaggcgctgccgccggcgccggtcttgtcgcgcaccccgccgtccatggtgttgagcatcgtctggtacgtggggagcgcctcctcggtgaccatgtcgccgacgaggcacaccaggtggtcgtcggggagccccgccgcgcgctcccgcagcgccggcacctcgtcgccgaacgacggcgagcgcgggtccgggaggtggtcctgcggctgccacgactcctccacgggcttgaggtaggggaggatggtgtccgccgcccaccccttcagggagtcgaagacctccttcttctccggcggcagcgtgtgggtcacctggggtggcacctcgcgccacggggcgaagggcttcttgcctctcggggtggggttgccgatgccgccaacttttcaggttcagaggaggaagaatattcagaaatggcgactgtatggtcaagatgatatatgaaccgaatgttttgcatctggatatgtgggattggattgttgaaacatcagtgaattttacgataaattaaatgcagtacagatgatactaatcattgctcgcttcgttacatacttttagttgttttgactttttccattcaaacttcttttatgattgattaagtttataacaaatatagtaacatctacaataccaagttaattagttttatcaaaactaacattttatatattttgataatatatttgttttgggttggaaatattgttatagtttttttataaatttgattaaattttaaaagaaaatcgactagagaaaagtaaaaagcaacatatgatataaaacgaagtagaacgtacagaaatgatggcaacgaggtaatctttctgtaaataaatcattgtcatgttgagatcacggttttccaaactgctgagtccggggttaccgcgtcccggcggtaagcacggttaccacagtaaccgtgaaaaaccatgcaaaatttattttttaaatttatttgaatttaagcccagtaaccgtggcatttatattaccgtacccccacggtaaccgcgcagttaccggtggtaacgtaaaccctggttgagatgctaagcaagtactctcttcaaagcacggctgcatactactctgttaaaaaaaaagataaaccttagctatgaatctggatatgcatatgtccaggttcgtagctaggattagggtttttttttacgaaggggtacacttgcagtgaaaaggaactatatgagagagtaacacgtttttacttttttttttttgggtaagataagctggtcaaattatcacctaaattggcatgactaggctaaatatgaacatctgactccatctgtattttatttactaccttcatcctaaaataattatatttcaactaaatttcagacatatttaatgtggtgatccgaagcaattagctcacttgattagcattcacaaattaattggctgggttctacctttgtacaaatacaacttttttagaacaaaatttaaatggtagaaatacaattgtcttgaaacagaggtagtactttatattggccgtggaaatcaacagtaattgtgaaatctatttttttccccttctagaactaaattaaaggaaggtgtgccagtctgaaggcagtggcactttactgaactgtatctctaggacttcatgcttttcggatgctacaggcgggtgtcttgaacactagaagaactgtgacaaacaaactagcataatcaaacaaactacttcattcgtttcatattataagactttctagcattatccacattcattagaatctatataaatatagataatgctaaaagtcttataactaaaagtaggtagaacaagcgaacagtattttattttatttaggaaaggcgcataagaagaagtgaagaacttttttggttatataatgcaattgaccagtattattactagtgtacacatgaaaatataaaagaccagagccacacaataagaaggaaaacatgcaaaaaggaaaaagaaaagagagagaacagcttgaagctaaaaacgaccaatgcccctatgcgaacaaaggcgcaaggcaaccagtaaaaacgatcaagaaaaattcagaacgaaacaaaggatgacacaatgtagatgacgagatcaggggggcagttcaacaactatagcacgggcgaatggccgaaattgtttgaagtgaaactcccaatcaacaattttcaacatacaagatgaagaacatgcagcaaattaattaatccctttagcctaatcaaacccggcaaaattcgaggcgagatcaaggtcgacagaaaggaaaatgaaaatgaaatggatcaaagcgcaccctgccgtggacgccatcgccacgacaggagagacagaggctcctcctccactggttctcctcctcatcgagcatggcggccgaggagggaggcatcccgtgagagacatggccgccgctaccttccttcttcttcttcttctcttcttgcttgcacgcgcttgcagagtaagaggaatactgaatggactatagtgaagcagagtagaagaggagcagtattgcttctgtttttggcttcgacctgtcaggcaaattttctggttcacctgacttcgacatcctgtttgtcccggaggttccagaggtttccaattttacagatatactttctccgtttcatagtgtaagtcttttttttttcggggacacaatcattctaacactacccacatttatattgatgctaatgaatattatatatatatatatatgtatgtctagatttattagcatcaatgtgaacgtgagaaatactagaatgacttacattgtgaaacaaagagagtactatccttttttttactgtctgg

SEQ ID NO: 10185 - DNA, 826 bp, Oryza sativa
  unsure (1)..(826): unsure at all n locations
catttatcgaaaatctcaaaangcattgcaatctcctacatgcgtacttcctattacacaattatctctaaacttatatttattccncccccnnccgggggnttgttggacttgctggcacccgccgaaaagccaacctcttcttcctcctcctgtcctgccgccctgaccgagcggcggacccggggacggccggagctgccacaccggaaccggaggagttccaggtgcaggcctctccttgcgagccacacggtccgcaagctgaaaaagctccgcggtggtctggggctccttggaggcgatcttttcgagcatgcgattgtgccgcacgccccccctgaacgcgtagatcaccacgtgtgcggggatgcacggtatagtgttgcggacttgacagaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtgtaccgacgcgggtggcaagttcatcagccaaccccgcgcctgacctttcaggaccatggggaagaaattcgccatgaccctgtcgtcacccccggcggcctcaatcccgggcgtatagatctggagaaactcggcaggggtgacgcttccgtcgaatttttcggggatgggggccggaaccttgggggccaacggacgttccgaaggctcgccacaaaagctcgacagccggcaccgccaaccggggacatgggaggctggcccccatgcccggactgaaaaggcgctcccg

SEQ ID NO: 10186 - DNA, 1212 bp, Oryza sativa
  unsure (1)..(1212): unsure at all n locations
gtggccctttgtgaacttttgaatccagctggtaccccccaaaccgagcagtgatgcccctgatgaatttaagcgcggagtgcttatcgatcttgatgaccggataagcctcgggccacttagtgaatttgtcgacagcgacatacagatactcgaacccgcccggggcccgcctaaacggacccaagatatcgagcccccagacagcaaatggccacgaaagaggtatgatctgcagggcctgggccggctgatgggtttgcctggcgtggaactggcacgtcctgcaccgccgaaccaagtcgaccgcatcgttgagagccgttggccaatagaaaccctggcgaaaggccttcccaaccaaggtgcgtgaggcggagtgggctccgcactcgccttcatggatatcggcaagaagctcgacgccttgttcccgaggaatgcacttcaggaggactccgttagccgcgcgctgatagagggtcccttctaccagcacatagcgcttggagatgcgctggaagcgttcactcccttcgcggtcctcgggtagagtcttatctatgaggtacacctggatctcagtgatccaagcaatcgatctaagggagctgggagcgctcccttcaggtcccgaggcctggactccgacgggcctcgggggccgttcaggctcgtccgtctcccctagggggtcgggtcgcgccgacggctgggcaagcctttcttcaaaggcgcccggtggggtctgggctcgcgaggaagcgagccttgagagctcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccagttgggagtcgcctaacaccaggaggcggcggatccccagtccagctgccaccctgagtcccgcaaggagtccctcgtactctgccatattgttggtcgcccgaaagtcgaggcggaccaggtatctgaggacgtctccgctcggcgaggtcaatgtgacccccgcaccggcaccctgaagagacagggacccgtcgaactgcatcacccagaaggcgnnnnnnnnnnnnnnnnnnnnnnnnnnnnnnnnnnnnnnnnnnttgtctatcgaatgtcaagngcnccaca

SEQ ID NO: 10187 - DNA, 2221 bp, Oryza sativa
  unsure (1)..(2221): unsure at all n locations
ntggccccgggcccatcctgggggtccgggggcgctgtcccgttcgaccaagcgggcagagggccagctccggtcgtcgggggcctcgggccccccgttgggtcgggggcctcttctccctgctctctcccgggtcgaggcgacacagggcgctctttgtccgagagcccgcgcggggcacactcggcttctgtgccgacgacctcgggggtagagggcgacaaacgcggccttcccgcagtggccccggggccatcctgggggtcgggggcgcctggtaccgtcggacaagcgggcagagtgccagctccggtcgtcgggggcctcgggccgccgttcggctcggaggcctctcctccctgctctctcccgggtcgagtcgacacagggtgggggtgtgcggaacgagggtcgtcctcgtcgcgctccacgaccaacgccgagctgaccacctgcggggttgccgccaggtaaagtagcaacggttcatctggtttcggggcgactaggaccgggggagaactgaggtacgccttcaactgagtgagggcccgttcagcctcctccgtccaagtaaacggcccggaacgtttgaggagcttaaataggggtagcgccttctctcccagcctcaatatgaaccgaattagggcggccatgcaaccagtgacgcattgcacatccctaagtttgctggggggggcgcatccgctctatagcttgtatcttctcggggttggcctcgatgcctcgggcagtgaccaagaacccgagaagcttgcccgcaggcacgccgaacacgcacttgtcggggttcagctttatgcgcccccagcgaagactttcgaaagtttccgctagatcagagagtaaggtctcttggttgcgcgtcttctcaaccaagtcatcaacataagcctcaacgttgcgtcctaactggctacccaaaaaaattcgagtagtatgttgaaaagtaggacctgcatactttaacccgaacggcattgtcgtataacaataagttcctatgggggtgatgaatgcagttttttcctcatcctccctagccatgcgaatctgatgataaccagagtatgcatctagaaaacacaaaaggtcgcaccccgcggtggagtcgacaatctgatctatacgtggcaagggataagggtccttaggacatgccttgttaaggtcggtgtagtcaatgcacatccgaagcttgccgttcgccttgggaacgacgaccgggttcgccagccactccggatggatgacctcacggatgaatccggcttccagaagtcgcgccacctcctcgcggatgaaggcttgacgttccggggcctgccgccgtactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgttcagaagaccaccgattcatgtggtcttagacaggccgtcacccagggcaaccttcttgaccgggacctcgtcgcacgtgatcatccgttgcctcggggcggccgggacggaggcgctgagcctctcgtcgccaccctcgggcttggacgccgcggcgagctggttcgcgcgctgctccatacaagcaagcgcgacttggaggtcgccatggacggtgatggggccaccagggcccggcatcttcatctggagataggcgtagtggactgccgccatgaacttcaccaacgcgggtctccccaggaccgcgttgtagggcagactgagatccgccacatcgaagttcacccgctccgtgcggaagttggcggaaccaccgaaggtgaccgggaggtcgatatgacctagcggccaagtgtgccccggcgtcacaccgatgatcggctgggatggctggagcaccatccctggggccttgatggcgccaaaggctgcgggggaaaggatgttgagagctgcacccccgtatatgaggacatgccccaacttcacattgcaaatagtgggggggtgccagctgantatcaaaatggtntcaaatccatcttttttttttttaatttacataaaaagcaacatatataccaccctatattaacgacatgaacaacgcttattaaccaaacaataaaaaaatctactatatcagcct

SEQ ID NO: 10188 - DNA, 1091 bp, Oryza sativa
  unsure (1)..(1091): unsure at all n locations
cacaacgcggcatcttatatttcttccggtcataccgcggggctctcaaaataacacacttctaattatgtgttttcacacaccacccccccacccacaggcgcttttgattgcaattcactcgnccccaacgaattgggnnactatcctctgcaccttcagtgcttgactatatttggctaagagtagctagtaggcaaaaaaacacacgagatccattatggactacttggtcggacttaaacacacagtatgtacttatcctatctacgttttaaaatgttttagattagacacatggaaaacagtatctgtatgtttgtctcaaaaagtaatattataattttattgggctctgtaaaaattttgtaataaactactccaaagttaagtcactgcaccttaaagaccatatccatgccaaaaacggcgtgtcttgggatagccatatccatatagcactccatgatctgaaagatgctctaagcagctactactcctatcaacctttgaatttaaggacaaataacgtttgctcaataccttcacagaacagccaacattatgccaaataatacacccaacattattgattcagtaggcctactgaaccaattttataccccaaaaaaatcgcatatcatactccaactagcaaacagccagttaaggcaccgaagcaagcaaaatgccatcactatatcagtcatagaatgcccttgcacagcaacaaatttaatcacatgtgtctaaaaaaaaagaaataattaatcacttggggacaacgtgtcaccgcctccaccggacaagatgtgtccttggctagccctatcgacagtgatgaggtgagccggtgtctggacaccggagagccccgcacggctcgcccaccgccggcgacgtcagccgctcgtcgccgccgcccaaaccggcgcggcacatgcacatgccgccggatgacttcatttattttttacgccattgcagcagtataaactcatgcacccaccctgcgagcaaacgaagcannnnnnnnnnnnnnnnnnnnnnnnnnnnnnnnnnnnnnnnnnatgcgacattcaattccacgg

SEQ ID NO: 10189 - DNA, 1151 bp, Oryza sativa
  unsure (1)..(1151): unsure at all n locations
cgcgccattgagtacttctgcnagcacgccngcaggtcgactctagaggatccccgatggagacgctccggctgtacccgccggtgccgctgctggcgccgcacgagtcgtccgccgactgcgtcgtcgccgggttccacgtcccccaggggacgatgctgctggtgaacacgttcgccattcacagggatccccaggtttgggatgaaccagaagccttcatcccagataggtactgtactatttccccctccgataatactcgttggttttttttaaaaataacataatctaaaaacaaatttaatcactattttctattctaatatatatagaaaatataaagaaatttatggtttttattgaagtaggatatctatatttctaagacaatactttagaaattatttatatttaaaaattttaaagtttgatattaatctatatatatatatatatatatcacatataaatgttcttttcaagtttcatcatgttctttacatttactaaaattcattcacaacttgttatgaactactaagaatatatcttaacaggtttgcggatggaaaaaacgaagggaagatggtgatcccgtttggtatggggagacggcggtgcccaggagagaatttggggatgcaaatggtaggacttgcccttgggacattgatccagtgttttgattgggaaagggttggggaagagctggttgacatgagggagtgctctggccttacaatgccaaaggagttgcctctcgaggccctctatcaacctcgagcttccatggttgatcttcttacgaagatttagtcagcaccataaaaaataatttgttgttcaacttttgtaatgtaaggaataatcgggcaagtgcggtttcaaagataattgggctgttcatcttctttaaatttccaagattcacctaaacaaattgtggctttgtcaactagaaaattctggcaagtacttaagtggatcctattatcgtgnctggctgntgcgtgggttccangagnagtctcatntgctctgcctggggnnnggntggagnatccacgcgaaccacgttcgttacatgtatgatagatcagttgatggttgatagaataaagtatcattacaatcaaagcggacgtaat

SEQ ID NO: 10190 - DNA, 1625 bp, Oryza sativa
  unsure (1)..(1625): unsure at all n locations
caaaagtctggcattttttgcatacaagttaattcctatcaaatgggttccgattaaggcctgggaataatgcgacgcgggacttattttgtttctccaaagatttaccctgttgcgtccagttaaggacaaatgcccgaaaggctatcatcatttcagaaggacgaggcagaagggtgtgaccagtccgcaatttgccacataaccccgaatgtgtccggtcggtgtcggatcacgcattgcgaccggtcttgaaccggaaatgcgtgcgccgtgttgcattaaatgcggcgtggcgcgcttgtccattccgcaataaatgtggtttggtgagcgccgctgtgcccacctaactcacaaacatggcgccaataccacagggggtcgggggcaccccagccctcggggccgaagcaggagcggcccgacccctcgggaagacagaggaggggtggccacgtctccctcaggcccgacccccccccccccgagggggttaggccacgtgggtgactgcggctgcccaagcctctagtcatgatacccccgatcccatgtcaccgacagtagcccccggcgttatgccagggcgatcgcccccctcgaggaaagcgctcgggcgtgacgccactccttaggtctggtgacaggtgggaccggtctctacaggtgggcaggaacccagcggtcgcaaatcgcgcgcatcggctagggaaaaaacgaccgataataatgagtggcctcttcaagaccgctacatttctcgaaatagcgcgcgaatcgggacgagccggttcatttcgcctggagatatgatgatggcgcttcggtcggcgagcgtagttaacgcgcgcacgatatgtctcatctcgactgccacggccgcacatccgcctcgtgcgccgcaaaagggcgagtgggattagtggaggcgtgggcgcgagaaacgagggggcgagatagtgggcgcgggaaacgaggagccgggaatagcgttggcaagggtataagggcgccaaggaagagattcgtttccttcctctcgccattattccccttgccttcgccgcttgcgccctaactccttgtttcctgtgccctacccttgccgcactcactcgttctcaagttcctcctccgccggcgtcatggcacggggctccgcaccgctcgacggtagcgtgctgccgccttcccgcatcgtgagcgagaggcaggccgggctgccgcgccgattcatgccggaatctaccgccggtcgggaggtggtcgagctgggcgagggacgcccggcaccacactacccggggcggtccgtcttcttcctccctttcgcaatggcagggctggtcccgccattctcttctttcttcatggatgttctggagttttatgatctccaaatggcgcacctcacccccaacgcggtaatgacgttggccatcttcgcgcacctgtgcgagatgtttatcggggtgcgcccatctcttcggctgttccggtggttcttcaccgtacagctagtgtcgccgccgtcggtagttggtggctgctacttnnnnnnnnnnnnnnnnnnnnnnnnnnnnnnnnnnnnnnnnnnnnttatncagccaatcaatggccac

SEQ ID NO: 10191 - DNA, 1713 bp, Oryza sativa
agggcccctgaggacttcaaagatagtggtccaacgggtgctgaatctcagctccgtggaggcatccctcatcccccaaggagtcctccccctctgcagcgatccagatcgcgccaccatcctgaccatcatgcaggcggtcggggcgtcggaggagcgggctcctggaggccacgatggcgcgggcgggagccgcaggggggaacaatctaccccgggagggggtcgtgcttctgggccccgcgacgggggcccggggagcggccgccccgccgacgcccgggggaaaagaaagcaggaaggaaccccttccccatctcctccccgagggggcggggcggcgcgtgccagcagcaggcgcccggagggtgccgtgccgtcgtcgcagcccgagggggagcgaaagaagaagcggctccgcaagatgggggagaccgaaccatgccggggaaaccttatctcccccccaaggtggtcgtttagccgacctcctcgcaggttcgtccccgcgcccactgcggccgtattcattctcccatctcccaaggcaagttttcactcacccgtttctttttgtcttctggtttttcttctgcctcagcgagattccatcacgcccccccccccgccattccaagtccggccagtccgaggccgtggagacggcgaccgcggaggcccgaaggcgggaggctgaacggcgagaagccgcagaccgcctccgagaagccgaggaagctgcccaggaggccgtccgggttcgccgggctgaggaagccgctcgggagaaagccaaactccgccgggccgaggattccgtccgggagccggagaaggcgcgcgcacgccaagcggcctgccaagcccccgacccgactccgcccgaggcgaccacgacttccgaggccacccacgacgaggccgcgggcgcactgctcgggcccgacccctcgggcgacgcacgggacgtgccagcttcgggggacgcccccgagtccggcacgtcgattggcgggccgtgccacgcggcgcccgcaccgaggcggctctcccctatgccttccgctgccccactgaacgcggagcccctcctgcaggccttagccgccgcaaacaccacggtgctggacgggctaggtgcccagatggaggtcctgcaggcagagtggacatagctcaacgcggcgtgggcacgcgtcgaggaggggcggcgctcggtggaagccatggtggaagcgggccgcaaggcacaccgccgacacgcctcagagctcaaggcccgtcggagggagctggcagagatcgccagggaggtggaggaggagcgggagactgccctcatcgccaccgccgtgctcaacgaggcgcgggacgatctccacctccaatacgggagccgggcggcggagctaaagaagaaactcgatgccgcccggggagtccttgacgccgccgctgcacgggaacggcgggcggcggagaacgagacggcgtcccggcggcgcgaagaggcccttgaggctcgtgccaaagcgctggaatagcgcgcacgcgcgagggagaaggacctgccggaccgcgaggccgccatcgccatccgggagacaacgctggcggcgcatgaggccgcctgcgccgaagaggagtcagcactccgcctccgcgaggacgtgctcaccgagcgagtgggagtcggagtgcattcatggcgcg

SEQ ID NO: 10192 - DNA, 906 bp, Oryza sativa
  unsure (1)..(906): unsure at all n locations
acagcgacctagccgcccgcctcgcagctgccgaacacaccatcgccgatctgcagggcgcgttggactcgtccgccggggaggtcgaggccctccgcttggcaggcgaggtagggcccagcatgcttcgggacgccgtctcccgtctagaccgcgccgggcgacaggcgggcctctggggcgagcggaccgcgaagtatgccgccaaccaggggggcctcgcccaacgcctttcagagatggccgggaccctccagcggctccccgaggagctcgaggagacgatcaagtcatcctcgagggacctcgcccggggggcggtggagctcgtactggcaagctaccaggccagggacccggacttctccccgtgggcagcgctggacgagtttcctcccgggaccgaggacgacgcgcgcgtgcaggtccgggacgccgctgaccacatcgtccacagcttcgagggtacggccccccggctcgcgttcgccctcgactccgatgaagagggcggtgacggcggtgacgaggccggcgacccgggcgtgtcggaatgagctcccaggcccctgccaatctttatatagttttttctttcttcttccgaggccttcgggcccccttcttgtgtagactaacttaatctgcaatcaaataaagaggaaattttttgcgtcaattctatttgttgtgtgtatgagacgaggatggtctgtgccgcggtccttctgtgtcttggcttgaacaagggctcgtgcccaggtcccagctcgagggtgcgagtagagatcaacaaagctcttgctggggggggagannaggaaaggagggatacagaacagcgagatacaggtagtgagtgtagcaganaggagatactaggtgacataaaaaaatgtatcacat

SEQ ID NO: 10193 - DNA, 3084 bp, Oryza sativa
  unsure (1)..(3084): unsure at all n locations
ccgggcctttgatatcggaacttagccgnctcnnaacccccgnangnaggnntnttttcaaggcaacatactagctctgatgttgggttcaactactaaagtgtgttgaagaaatcaagtcagtgaaagctgcatgtcgtaatcttaagtcaatggttatcagctactcgctaactttggatgtagattcacaaatagaattattcaaaatttttgtgatttttttatgttgtgtgagtttttattagtttgtgtgtgcttttgtttatttaggtatgagtttttgttgaattggtgtaataattggctgtagctatttaagcaaaggccgggattatattccattatctggaaaaaaaagtaaattgtatgtaagttaaaaattgagctggctgccctggtacacatggtttaaggtcgtgggtttcattccccgctcgctgctgcttcactattgttttatagcacgaatcccgggctatagaatgtcaagaaaccgacatatattttttttcgcaataatatgccgccatctttttttgcaactccgttctaaatgacgtttcttttttactttcttcatcaatgttgctttaggtaacttttttacgctacttgttatttataatatataatatatttgttatatgcaattgtccaaaatccacttgatcatctaaaaaatttaagaacgggcagtatatctactactagctcaacactacggttaagttctaatagcaactcgaaacggctacttgatttgttattctccatgagcacgttttgtaatctacattaaacaatacaattcatgcatgcaaaagttttctatataagtttcctaaaaatcaaataaatttatttttaaatttatggaaatgctacagaacggtatcccgttcgaacgggatgatacctgggtattagccgataccaaataggtatcatgtaataccttcccgtccgaacaagatatcagctgatacctaccacgtatagggatggatagaaagctcgtggctcgttagctcgctcgactcgtgacatgctcggctcggctcgtttgaatttcctaacgagttgagctggcattttagctcgttagagataaagaaccagctcgagctagctcgcgagctttaacgagctaggactccatcagacatccgcaaagacccagcccaatacaaaagaaagacccaagcccaagacaaatagacaacagcaaaagtgcaagcaaaaccctagtcctcctcggtcctactcctcactcctcatccaccgcacgtggcacggccgcaccacacgacacatcgccagttcgccaccaccagccgctagggccactgccgccgcctcactgcgctgacggagctgggtgatctgcggcgggaggggaagacgacgcgacggcgtttcgggcacaagctccagttgcttcaagctcctccaccacaagcttcagtcgctcgccgcggcgacgggaggagaagacgacgcggcggcgttcggggtctcctgccgcgtggccttctccacggcgtcggctccagggacctccaagtcgaccccaactccttcctttccgtccgcatcttcctccccacctcgccacggcacccgcacagcctagggctccgcccgtgccgcgccaagcaagccaccgcccaccaccaccatcgccagccgccaggtccctcctcttctgccggctggatggtttggatgggttggctcgcgagcctaacgagctagctggagctttcaaacgagccgagccgagccagctcgttatcctaacgagcttgaccgagccgagtcgagccggctcgctatccacccctaactacgtatcgggcgatatctcagaggtatcatcccattcaaacgggatacaaatcccgaatgaactgccgtcccgtactcaccctaaaactaacaaaatgttatcaatcaaaacattttaaggcgaatgaaagaactttgctcgattctataaaaaacaataccatatatcctatggttacacttcaaaatatactacccagttaaaatctcttttgtattttaggaggaagaaattaccccatatcacgcgatgtagatcactctcatgcggaattaacagcacaggatgtctggatggatccgttgagcaaagcaggtagcgtgcgtgtgacggcgttgatcccctgcctagccactgggtcatcaggatattagatacgcccgtatgcccacgacgatatcagcacaaagcaagttgatatgttgggtagttgtagtagtagtagaaaccaggtgcgtctgcctactagttcagtgctaccatatcatgggtcttatctggaaaacccagcttttacagattctcagaaattggctacccaactagttgcgtctcaaatcttataagctcccccaaacagaccccatatcactcttatctaaggaaggtcacaaccaggggacgtactgatcgagcttcaatactcaatagccgtggctccaatctttcctgccgttccaatcggattcgtcatccatattggattggtttcaatatattctttccttcgtgtgatctctgaaactggtcaaagatttggcccaagattctttcactctcaatcatataattcatattcgtgggttgcgtggttccgatcacggagagcaagtatattatagccatacatatgtattctcttcgtcggtacggggttgggaccgtatgtgtggcactactagaaaaccaattttcccaagcggccaaaacttattttcgcaggtgagagagaggtccgcctgcaatacaacgactgtgaaaatcggtggttttcgcggtcggggctgcggtccgcctgcctgtgtgctnttnnccgnnctnantnnngntgggtnccaagtgntttatnccgntgtccatcaaactccatcttttttttttttatttttttgtaaaactccccacacaaataatgccaccacctctacacacccaggcaaaatataccaacccaccatntanancctccactctcattaaatcacacacactccttattaatcgacgccgcg

SEQ ID NO: 10194 - DNA, 4551 bp, Oryza sativa
  unsure (1)..(4551): unsure at all n locations
tagtatcggtctatattttttgtacttatcantcgctanctcctctattatcgtttattaacacgatatttttgcttagttctgatttattttcctcccccccncccccggctgtcnatttagacaactgctcggaacccgcgagagggagagagagagagagttgagtggtgggaggggtgggaggagaagataagggtggtttttttttttgggtttgtacgatttttgcagtcggagcacataaggttcgcctgcgaaaatctattttcgcatgtgccgcttaagtagtccgccagcgaaaatgattttcgtaggtgccgtttaagtggacagcgaacttcaccccgatttatatttttgtaggcggttatttggttataagaatcatgtccgcctgcgaaaaaaagacccttacgttgggaaaaatgtgttttctagtagtgtggttagttgtagatagttgcgaagacataaagatttttaaatctgaacataacttaactatatcaaccatttcttatagaaattatattgttaatccttttaactgttaaaattttaatgaaacatttgacggtaagtctggacggttaatcgtgctagccgagcggagccgtgatggctattttaagaggaggcattataagaagatgaagatggaactgttacgggaaaaaaagaagcaaagtggaatagagtagcatcattttcacataatggcttcggtagattcatccattttactcctctgtttttttttctctctgtttgtttgatgagaatttcatggatggttggaaataactggcgaattgaagcccgtacttgctggaggaggagaacctggggggaggcattgtgtatctgtgtggtgactgttgaggaaggggaaatgtggtccacggcgcatacgcgtttgagatgagacgagagagagagagagggtgatcagcgttatgggtgtgttcggcacccaagtttcccaaccactctccatcttttttcgcgcgcacgtttttcaaattgctaaatggtgtattttttttaagtttctatacaaaagttgcttaaaaatcaaattaatcctttttgaaaagaaatttatctaatacttaattaattacgcactaatggatcgctccgttttccgtgcgggagagattatttcccatccacggaatccgaacacagccacgctatatggaagatatgaattggcaaactgcggatagtgaatactccagctgctaagagcacccacaatgataaagtaaggtgctctctataaaacatgtatatctcagcaatagactagattaatagtaaaccacctcaatagtatgtctacatgggtatctatagctctctaatgcattgcctcgtttttctctatagactatctccagattagtagatagttttgcgctctctctctcttcatttaatctcttccaagtaggaagatatgctaacatggatctcttgtaaagagtctatagataaccattgcgggtgccctaagagcacccgcagtgttaaagtaaggtgctctttataaaacatgatcttagcaatagactagattaatagtaaaacatctcaatagtatgtctacatgggtttctacaattctctaatccattatctcgtttttctctatatactatcttcaggttagtaaatagctttactctctttctttatttaatctcttccaaatagaaaaatatgttgacatggatcttttataaagagcttatagataactattacgggtgccctaagcaaagatggatcacgcaatcaacctcgcgtttagtgagtacacgctgataacctttcctgcttgtctcgatcccagcctagaaaaaaaaattaatctcgccatcgggcccagtccatggaacgatgttcctcagaggatggaaaactaactaactcatttgcacataattaattaaatatcagtttaaaattttttaaatgttttaatatgattttttaaagtgattatttatgtatttcttttaaaaaacagtactgtataacagcatttcagaaaatatatgcgtgtaaaataaaagggcagaaagatggaactcttgcgaagtagtgtctcatcacgcactgcacgcggtacccacaccaaacacacagtggaactagaaaacggccacgaaaaaataataacctaaataattcccgacaattttggttctcatcgtttggcttattaagtcaaacgacatatttacaaacgaaacataatttgtgaataaaacttttatatatgtgttcttagcgatataaaaacaaagactgaaaaataaactccgatgaaaaaaatctcaaaatcaactttaaatttaagattaaaaatttaaattttagctgataagtataggtataaacgaaaagatggagctgttctttccttatagctagctccacctaacatatatatatacgccgctttcctgccagtgccacacctcacctttttcttacgagaaacgtgcgagcgagcgagcgttgatccaatgttttcccctgcgacacatacgcgtaccacaccaaccgatctttcaacacagcatgtaagcaatcgactagtgcgatgagcaagcgcctgggagatggtagtacgtttctcccagtccgtagctagctaggctcatgacacacacagtgcgtgcagtagtatgccggtgggcggccgaggtgcgtgtagtcataggtcgaactcggaccacaaactgatacagcattaagtttacagcaacaaataaatcgaataaagtcaataaatcatgtataaagtgatagatattgtatagagatatgtcggctaagacagaagattagacctaaccgagataatcccaactaaacacgatgtgtcgacgggggatacccgtagaccggatataaagggtactggggtacgctggtacgaggatctacgtaatacgacatcaggcaaacagaaaacaaaaattatactggttcaggccccttgataggtaatagccctaattcagttgatatgggattatatgatggaaaccacatattacaaagggaatagcggaactcgatgataccgacgagatcataatcgaacatgttcgattagatctcccggcgacttggctcctgtaggcttcaactccgtaggctgtggtggatgtgttggctatgagattcgatgccttaggtcctcccgggggttccttttatatcgcaggtcaactggtcttcaagtaggactcggagacatcggacccgacacgatacaatgacgacccagttcggtacgagtaggactccttccatctgtgaactccgtgatgaatttccttaacgtatgccgaaaacgtccgtatacgcgcaagtataccatatcgatatgtgacatatatcgaagggtagagggtataccttacccataaccctgacacgatgcaactaaagatagaattgaaatatcgggtaagcaaatataccaattgaactatagcaatccaagatattgaagcgatgcagtcttgaacaacaccaatataaccgataacagagccagtggaacttaggacttatcctttcgccggagatcgaaacgatgcagccggtgataaaaacctcggaacagagggtggtgatgtgccaaaagttgtattgatcgagagatagtttacaataaccccagtgtacatatttatgcccataggctgtttagagtcctgattcgacactaaacacactttcttaaatattaaaaggaaaattagtaagccctgcctaattaatagataaatcaagctgccgtgtgtcttcacgattaattcttgaacttgatctcttttagataaagttttcattggctgattgtattctttacatatccaaatccgctaaagaatattactaaatttggtgttaacagttgtattcgattttgcggttcggagacgacatttaaactcagcgacaaatggagggacctaaaagtgaacttaacctaaaaagatgacatgtaggtgacataccaggcccaaggcccgagcctcaaaggccccttttcatgtaggaataagtctgttttgcctccctctactcatgcccctagttgaatcactccctgagcggtttcgtaggcggtttcatcagatgtgatagttgattcgctgagtcataggtgggacgcatttgtcggcagcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10195 - DNA, 4305 bp, Oryza sativa
  unsure (1)..(4305): unsure at all n locations
aggttgggacagagggggcagagaaaaatagaggcccagaggtttgttgctaaagtgactggttatttgttggaaaaaggggaattttattgttagaacgatatatttcaggcagtacgttggaaagaaggtacgtggggataagtatggtaaccgaagattgagaaggacaagtatttgattcggaggggtttatagtagcaagtacataaaaaaggtttagtggagcagggcgctagattggtgagggaggataaggggaatacatgtgatatgcccccaccccatctcacccttcctcccctcttccctctccactgcgcctccgctctcgtggcaccacgccgccgttcccgtgccgcacgcgccgccgctcccgttccgccgcgccaccgttcccgtgccgccgtgcccccccgtcgccgccgccgttgtcgccgctgcccccgccggtgagccgccctcctttcccctggcgtccaccgcccccgccgctcgggtgggagagagccgagagagagagggatagaaaaagagaggccgccagagagaaaaagagagatagagagaagagaaagaaagagagagagagagagaaaagtaagaaaaagaaagaaaaaaagaagagaggatggagaaaaataaaaggaaaaataaatagaaaattaggaagaaattaaggaggttaatagtttaagaaaatctaaaataattagaatttaattatagattaattatggtcatagaattgcaaaatttaatataaattatagattattcttggtaatttctaaaagaaatcaattcgcggtagtagtttagatgtaaataacgactaaacaattagatgaatttttatagactattacagattagttttggataatctctataagtaatcgattcacggtagaagttcggatttaatcactaggaattttagacgtatattatatttaatcggttagtcataggctaaattaaatcgtataatattataagataatttttggatttcgtccgatatttagctcacgatagaaaatttctaacctattatatggatataatgctcgggtagattaaattaaaaacttatgctaacaaaatatttatacccgcaaaatagtttaggatgtataaatcgaaattggatttgccctagttcgcgaatagtaaagttaatataaaagaatcaactttcgcattcgacttccatttggatttatttggatctttatttgaattttaaccgaattcaaatcgtttcttcgcacgtaattttagagcccgagggagttgcagatccaagcgaggaccaagaaccgcaagactttgagcaaggcaagtcatcactatcccttgaacatgttgatcctaattgtgaaattatttcgtttataaataaaattacatgcaatgatgaacatcctacttgtgtttataccatgccttgattattgtttaccccttattccttcgtaaccatgtttacgtatgagtccctagtcaattatgacaattgcttagaaatgctattctagaatcatgcatactcatatttatcaaatactaaatgcttgggcaattacctttgggaaggtaattgagatgtggcatgtggagacatgagcgccacattgccatgaaattgatgacatgatttgtgaaaggaaaataaagtgaaaacaattgttttcgactggggcggacggaggatttgggtggtatctagaaaaggctagtaccgtccccggtcaattaaggaccgagccatgaagttaagcatgaaacgacccccgtacaaccgcacttctcgtatgggtatagacctagcggagtagatagccgagcggaggcagtatccctgcatagatggttcacccctgagtgaggcaggtgcgctacggtgggacagccgttgaggtaggaccgagaggcgtgccctacatcggtgtcaccattggtaggactgccatgagtgtgtgagagagagaacttaacttgaaccataatttaatatgtgtgtgagacttctcttttccgggagcgccagaactcctctcactgctagaaacatagacgcctagagtgcatgaggatttaagttcatggagcgggtactgtcaatgcgaggttatcgaaaagctttgccatgacgcgtctcatgtgttgggacgaggctcatgtgttgggcagtcgcggagtacgggtaaagtgtacatccattgcagtgtgagtaaaccaaatctattcgaatagccgtgctcgcggttattgagcaccgggacatgtattacacttggctagactctaaattctttaacttgtgtgggatgggatattacatgatgatttttatgctgatggagccacttcctgagaggcgggaatgtggacgtcctcagaaaaccatgacgactcaatggcgggaagctatccttgggatcacaatggatggtggacagaaccgtcattgtttaatgggaacactgatattaaaacttgatcagtctatgctaggtcttaggcttgtgaaaagaattacaaaacttgctttgtgcaaaagaaccatagccatcctttgaattcctctgtcatgtgcattattgctgtggtggcttgctgagtacggttggtactcacccttgcaatattcaaacttaattagtggccggagatgaagcttcggaggatccctatgcctattaccaggagggtgatgagaacgatggcgctcagtaggtcttagttacggtcgttgcctatggcaatggcgtgccgctgccttacctacttctgtttttggaatgtattccggaccgctcggtccgatgatttaagactgtgcctgcgggcttatgatgtaataattcgtactagactctcgtgtatgtgcacttgatatttcagctatgagtttgtgtgtaccagactacttgatccagggaaatggtactgtttacacgattgattcctgttataaaaacgggggtccacagatggtcagtgatgttgggtatggatggagttggggagaagacggaaaggaaatgaacatggtaattactcttggagttatttataatttatttcttcccattgaagtacaattcgtataatttgggatacatgtgtaaataatttatgtttttctaaattataggagtgaagcacaattaaaagaggccaaaattaaaaaaaaagttacataggcttgcctaggctatgcctacgtacattgtaaatacacggttgctttaatagtggtttcaattgcttttgcctaagtagaggttgaaaccactagtcgagagttgatacttttgtgtattgcccatgctattggagtgcacaaggatatgaagagataatcttttgaaaagaaaatattctccatgtcgagaactaaatttaacaacgctcttggttttttagatgctatgaaaaataaaagtgtgtagacctaaatatggggccaccaagcttgccccggccgagccatttacatcgagcctgaatccaaaccccatacggcaactcttcatcgtctctctcccattgaaaaaattgagatcatgccattttgtcaaaagtgtgtattgcccaaatgccattttactaaagggattcgataaaatattactctcaacatatggctatatactataatataatctaggacaaaaatgcctttgagctcattcttccccatcttctcttcttattctggctacccctcgctgaacaccaatggaggaggcttcctgagctgctcgcttatgaaggcttggtgcggttagtgctaggcgacgtgctaaacatggtggggttaggcgtcaccgatgggacgtgctactgctggtgtgcagagagccgtggagctcatccgcaacgatctggagatgtagggtgatgatgctcgtcctcttcggcggaggagacaatatcacgctgttgatagtgtcgacatgaaggatggccgggatgaggaagttgccactgatgcggttggtgctggtggagttgatgtgggcggtgagacatcaaaattgattgatcaagactgcatggcaatactcgacgtgctggcgaggaggtacaattttcggcggcgaatgaaatggatactcgagcttgatgcagttgtcaaaatgatttatccacctcactagaaatttctctcttaaaaaccattactatttgtcatgtcatgtatgccaaacttttcctattcactnnnnnnnnnnnnnnnnnnnnnnnnnnnnnnnnnnnnnnnnnngatntatatngcaatcaggctcg

SEQ ID NO: 10196 - DNA, 5742 bp, Oryza sativa
  unsure (1)..(5742): unsure at all n locations
gggcccaggttgactncgctcgtaccctccgcgtccgtactgagaccaaaccacaaaaatctcacctcctcctcctcctccctctcccaccgcggcctcctcctgctacctgggagccacgcgcccccggcctccacctcgccgccctcctcgccggcggccgccacgcgtgagtcctctcccctcttcctccccgccgtcccccgtcactgttccgcgctggatttcgctgcgcggccgcgcgtggttccgcccccaaccccccaccggggaccgcggggctccggtcgctggagagcgctccgcgtcgccccgtcgggctccggggccgctggtcgtggtcccccgcgcgcgcggcctccggttgcgcggcgcgggcgaggaataccggcgcgcgtgcgggcgggcgggccgaacgaccccggtcgaacggctagggcgctaaattttggtgctcgaatggaggtgtccttgcgaggttttgggggatttcgtgtgggggcgtcgcacgttcggtttgcgtttcccccgtctagggtttggggtttggtggattcgtcgtcggtgtgatcgcatttagtggctctagctgctgttggtggtaattttagttctcatattatggattggtcatgtcaaaaccctagatgagttccctggaacccgttagctcacctcatgggtttgttcttcgtcgtgctggacaccctcctttgctcttgttctaaaaactaaggcatgcatgacgatccttgttgcggtggtactgttttatatatgcttatggttaatggtgagcctattagtaaggtgaaacagcggatacgaacatgtcagttgaaaaagcattcatgtttttatttcctaccctatttaagaacacacgtttgatcaaaggcgctaactgttgccttttaggttgaaaacagggtactccaagccattgttgagcctcaagttttatgcatgtactatgtagttactcctctaatggccttcttattcaccatgagcattcatgaaacttattacattttctttactcctgtttagtgagcatgtagaattcatgccaaccggaaaatgtagcagattgatttgtccaaaagataaaaaatcgaacgacttcctgtgggattttattccagcataacctaaaatgtaactaatcagcatgacagatttatttatcaagcagatggatctgtacttccattatgtttgcttatttaccgcgaatattttggaactttagaataaccacagcctatccagaaaaataagaattaattaggttggtttaaaatgcatcaccatgcagcaatcggttgcaatttcatatctttatatttttttatgtgttatctttgatgttcccgcatgcattcagctgtagataaaacattgctacattcagttgcaaaatagggttcagctgtgaaataggacttttcaagaagtctgagagaagctgtccctttctttgttgagaaaataacatctgctgcagttaatatttcatctttctcaattcattaaactaactaatgtatatacagcgtattagctaggttaactaatcttgcaaatgacatagatttgctaggttaactaaaatgttaacaactcaaattcaacatgtgtgaagaaactagatttacgattttcgttatgaagcgaatgtctaaattcacacttgatacggtaatagtactattagtttgtaagcatggtttgtatgtttgttggccacctagcataaacagcacaattaacagacaccaccctttcgagcttcagaaactacgtatgttctgtgctaacattatcaatagtcaagtctgatgtgttgatattgcctaatttgatctaaagtttgacctgctgattttatcactctaggcttatggtgagtgcacagtgagctacaagttaccattatcagaatggatggtagtaatgagaatatccaattctcatgggggaagaagagagcaaaaggtggtattaagatggatacacagttttatgactccttcacatttgacaatgtgaagtactcactgtatgacaatgtatatctttttaagagtggtgagtctgaaccttacattggaaagataataaagatatggcagcaaaatcaggctaagaaagtaaagattctttggttttttctcccggatgagattcgaaaacatttaagtggccctgtaatggaaaaggagatatttcttgcttgtggtgaaggcgttggccttgctgatatcaacccactggtaagttcatatattttccccttcgtttttgaattggttttcttgaatatcattttaccttatgctttcttgcaatatatttaaatattttcattttgatcactcaatggacagataatcactattatgtgaacactatatcaaatttgtttctaattgtgaaaagtcattggatgggcaatagtgtcgacattttgttaattccaaatatctgttgttgagaagccatatcggtagctagaatcctagagctacaagttaccttatcaagttgtatctagtactagttgatgtgaggagatcatttcccacttttttttgttgggaatcgtccaccttgtatttgtggtatatttagttattcacgcatgacatgaataattcgaagttagagttttaattctcatgtatttaaagtgcatcacaattttcaaagagcaatatttaaattcacatttttggaagtgaaaatgcagtccaactgagttagacaagagtaggcattagcgtgttacccatttgcatgacctgagaagagccagcttggttgcgacaatcaacttgaaaattgagatcatttctagctggtacagttaaacatccttttgagctaattggcataccattttagtagagcatggttaggtattaacagtcatgatacaagattgaaactttcctgctattgtgtattacctgtgaatgttaagtcatttgccttttccatccttttactttttctgagaactaaaatattataatacccttttgtttattggtcacccaggaagctattggtgggaaatgcactgtgctttgcatttcaaaggatgagaggaatcgtcaaccttcccccagggaactagcaatggctgattatatcttctacaggttttttgatgttaacagttgcacactttctgaacaattacctgagaaaattgcaggggtgaaaggtcagcaatatatcagatttcatcagtgcattaaattgcatttttaatatggcaaaaattttctccaccntcagtatcaaaattggtatttaattatttttcttctggcacaggaatctttttgcttattccaaaagttgagcaagtgacatcctgttcagaccaggaagtgcatggtgttgatcagaagatgcttaatgtcccagttccccttccccagtcaacggttatggaggatgaaagtccagttgctgcagtttcccttcccccgtcagtattcaaggaggaaaatgtggcttcagccattccctttccccagccagtggtcaaggaggaaagtgcggctgctgccattccccctccccatgtagcactgaaaaaggagagtgtgtccaaatctacagagaacattaccaaacctgcacagaaagttctccctggggagaggccaccaaagagggtcaaattttctgaaaatgttacagtgcaaaatgtgccattagatgttcctgaaagaccaagtcgcactggacctttggaactagcaggtagacaagctgtaagtatctgaaccaacactgaggatacatttccaccttatcaatgaatagctttatgccattgatgttatgatatcatgttaaactttaaacattcccccaggtaactcagttaatattatctccacaactcatctgcatctaatctgttgtttgtatataagtaaaataaaacagttaacctggactggccctgcaatcttcccataaaaaaggccagaccgagctcctgggctgatcccctggacctgtccagcacaagggactatatgagcagttgacctgggaaaatctcagtgcaactgctagttttttttccccacctgggcaagtcattctatcctctatcgaccaacggtgcccctatgtggcatttggagttagcaaaaattacatgaaaggctggcctgggaacccaggaggccaggatgtggtacttaaagctctcatgtgaaacctacttgtatgcattcttaactaaggtataaagtactatatgtgcctcatgcattctgattgtcaattgagcagttttgccgactgcccagttacccaatgcattgaatgggttgatttacgatctgggtctaagagcaatgagtaaaagggccacatgttccttcaattatttctgttcaagaattttattcggctgaacatcatctgcttttactattaaggttcaaccaatttctaagaaacaagccataatcaaaatgttctgggtctacaantttcctactgatagccgtgtttacttttgtgtgcttacacccttttctgctatttaacaggacagaagcaaatggttcaagattgtgagtaatcatttttcctacattgtctcttctctcttgcgtatatactatgattgtacagaagatttacatctatgcttcatgagtcaatgcttcaaaactattagaaaaacaaaaatatttcagttgaccttatttgtgggtgggtttaccttttaaatggaaatttcagccatgggataccagactacgaaatgctgatgagcaagggacacttgtgtacattcaaaatcttgacatacagtttgcagctgctgacatagaggtattgtcttgtctatctggttgacataaagcccaaactgctttttttattatattcttggcttataatttatcacttctttactagctttgctatgttctctgttgcacaaactttgcgatttgttttcaatgtcttacacctcttaatttccacaaggccttgtatatgagaatttgtacagggaaggatttcatatggctcgaaaagaactcccgtccgagtttccccagtgctgtagatttccctcttcatgcgataaacatgacgctacctaataatactaatatatatatatatatatatatatatatatatatatatatatatatatattgggcaccacttctgaacgggtgggcgaatggatgagcaaaagatgcaacaaagtggggattatcccgagtctaaagtgtcatttttatgtaacctatttgtttttttgttttctctgctctataaagtaaaaaaaaagatccacttttactatttttctctcgatgagacaatggtacatgtttctctattgagtgcgcctttacgtacgcgtttccgctacccactaattttgaaagatgtataaattggaaagaatgtagggagcagtaaaaaagagaaatgttttgtttacaggaacatatttgattttagaatctgttttaatcttttttgtgctttctgtttcctaatttttgccaattttcttgggctggtgtagttaacacttttgctataaagagattaaaaatattggttctacaacatcactttctacccctaatttcagtacctaagagaggttgagtannnnnnnnnnnnnnnnnnnnnnnnnnnnnnnnnnnnnnnnnnngatctacggtccct

SEQ ID NO: 10197 - DNA, 2814 bp, Oryza sativa
  unsure (1)..(2814): unsure at all n locations
acggcttgataaactctnnnnnnnnnnnnnnnnnnnnnnnnnnnnnnnnnnnncagctttcagttttatccatacagaccttaaattttgaatgctcaatttatatctatagaagcataaagatgagaggaagacctttgcgagtaagatgggaaagtaagtggcttccatggatttggttaagcgatgggaactgtcctgttccgtgcttatcttggagtcctctactgagtactgactatcattcctcggagctttatgcactttttgcctgaagcaacacttatctgcgagtttttctgctgcgcaagaatgaaatgcaacgaccatttgagggggacaactaactgcaccacactgactctgctcatgttccgtagagcattatttttagaaaggaaagaattgtgccatagcttaagaaaccaaagtaacattggtagaagtagcccttgcagcaagttaggaaagccagaggctgttttaggttaccccgcacatcaatttgatctcacatggacacatcagttagatctgttgctccatgttagatagcaaatcaacgcgtgccgtcatgaaatgtgtatgtatatatttttaaattcatgacctggctattagttcattcatgtgactgcttatgtgtcttgagttacaagttacaacttgactccgttccatttgtgatgatgaacaacagctcctgaatgcagccaccggcctcggtaggttaaaaattgacaccgcaaattctggtgatcgcctggtaggtattgttggtatagctaaagatgatcatgtcttcgttttggatgctcttggtgaaccatatgctggttcttgagatctagcttcatgagacatgcatactcattcttgaagtaaatcaatgtacacttttgagttgtcttggaccaacatgtgttacctgctaaagtctaacaggagatgccctgctttccttttctcccaaagtgaaaggaataagttcatctgaggtcccttaacttatcaacgaatccgattttcgttcttcaaccagaaaaccagattcaacaagtccctcaactatcaaaaccagtgcacatgaggtccctcgacggttttgacaaccagtgcacatgaggtccctcggcggttttgacggtggttttggcggacatggcaactacgtggcaaatttgacttggtctttatctgatgtggcattgacgtggcgcatacgtggcaattagatccggaaaaataataaacttcatgggaccttgttagtatcacacataaattaataaaaaaaatggtggggcccacatgggccccacatgtcattctcagcatctccctctctttaactagagcccctcttcttcgtcctctctctcccttctcccatccccaaggcgtcgggcggtggccgggcgagggagggtagcttgcggcggccgggagaggagggaggcggcgtgcggcggctcggcgaggagggaggcggcgcacagcggccgggcgaggagaggcgacgccgttcggctgggcatcgcgggcggagcagccgacggagtgtagctatcgcgctcgccgacgacctcctcctcagcctccttctcctctagcaacctctgccacccccggcctgccgccgctccccgcgaggacgaggaaagccgagaggaagagaaaggagagccgagagggacatgtgggcccacgtgggcccccaccatctttattttctttagctgacatgtgggccccaccattcttttattgatttatgtgtgagactgacatgtgggtcccacgaagtttagctgacatgttttaacaatgctaaaacctgtagttttgtgatatattgtgcaaagtatatataattttgtgataaacgaagacactgaatctgtagttttgtgaaaaaagttcttaaatctgtagttttgtgatatattatacaaagtatgtgtatgtagttttatgaaatttactcactttattatttacatggtagtaaagagatgcccttattaagcacgattttaggtgcccttaataaagaaagcagagcacccgcttgatcaaactgcaatggcacgcaacgcaaccattcaaccaacccttccgattcactgcacgacgggccccacaagtcagtgacgctacgcggtagaggcgaagcggcaaacgaaccgaaaaagggtttttggttgcgagagcgagacgcacccgccgccgctgccgccgcacatctccctcgcatcgcaagctcaccggagaagcgcaagaagagagagagagagagagagagagagagggagggtaagaggaggaggaggaggggtaggcgagggagatgggcgccggggaaggggatgccgccgcgggcaacaaggagaagggcggcggcggcggcgtggaccggacgtcgctggacggcgtgcgggacaagaacgtgatgcagctcaagaagctcaacacggcgctcttccccgtccgctacaacgagaagtactaccacgacaccatcgcctccaaggagttctccaagctcggtgcgcgccctccctcccttcccaaccttttccttgttcctccatccaccctccctctagcgcgccgcatccgacacacgccgggacgagctcgttgcctcttgccggttgtttcttgtattgggatgtattttatgcgttttcagccctcggatctgcggacagggtcgaggaaagcgagttcttgaggcggcatcgataggggatcctctacaatcnncctgcngggttctncatggacnctttaggngntttnanngcccat

SEQ ID NO: 10198 - DNA, 1393 bp, Oryza sativa
  unsure (1)..(1393): unsure at all n locations
ctggacntttgattgacactcgctccctcccttttatgacagaagacagtttcagaatcaaacaaagtgtagcattgcgccaactatggacctcatgctacaaaatcttctgtcaacacttgagttcatcttaagaaaaaaaaatggattagcattatctatctgataataaagtctgtcacttttaaaaggttcctatttgcctgggttttaatcgttgtcaagtggatatgaatgatgggaggttgagcagagactgataaatcagtattgatgctagcatactagataagggtgcacctgcagcgtggcactgatatagaaggggctttttggttatttcttgatgtcaattgtgcagggataccttgtatgtaacaggtaggccacacaacgatatcttgacattgattctttccaccttgagccacacatgaagacccggcctgttggtggtgttgaatgccgtcgataaccgaattattttgagagaccattttaggaatgaaaacactctatgggccacttgtacttgccacttggaaatcgtcaaaatgctgaagtcaataactcaatattttgttttaaactcaattttaaaaaggacaaaactagaacatttcagctttgaacagcttgaaaatttagaatggggatgccagaatttaagcgaacaaatcagcaaaactagttgcacagcaactatgttctatgttttgtttgctactagcctactagtaccacacaacaatttgaaacctcactttttgtgaactacccatattgaaataacaattcaaaaacttttatagttttgaagttttcactctatgcatagtaatggatagtttgcatttggaaatatcattagcttttttagggccatagcatagaagatatgtgtcttataattgcttcgtttaattttcacaggatcgaagctgctgaaccatgtgatagatctgtgtgagaagcagaacatccctgagatatacttgcatgttcagacgaacaacgatgatgccattgctttctacaagaagtttgggtttgaaattacgaagacgatagaaaaatactataaaaacatcacgccgccagattgctatgttcttaccaaatttattggtcaggctgctacaaagaaatgagcaaccgccaacactctccttttgtgacaataccaccaccaccaccaagtcgtggggagatagttgtgatcttgtcgcggtttctgctgtgttttcacttcatgggtgctaacattattacaaaacactcgagaactatagtagcctttgctacaagcactgaggtatcattcacannnnnnnnnnnnnnnnnnnnnnnnnnnnnnnnnnnnnnnnnnnnnnnnnnttcatcaagcccatca

SEQ ID NO: 10199 - DNA, 3636 bp, Oryza sativa
  unsure (1)..(3636): unsure at all n locations
cggccattgattagcatagctatgcnnnnnnnnnnnnnnnnnnnnnnnnnnnnnnnnnctcctcctttaagtaatgttgtcaatacatactccttcttgaacaaatataagtatttttaggattcaaattctattactcctatatagggcagctctagctccacctcttctggagttagaggtccgccagataatttcagctccatttaaaatgggagcggagttaggtggagctttctcactccagatccaactcatgtagctaaatttaggagtataaaatataaacatttttaggacgctgattctaatgtataggaatccaagcattttcagcccatcagatgtttacaggagaggaaccaaagcaattcaaactttgaccatgagataagtgaagagaatctttcagtttatctttaatctttacttaaataacttaaaaatattatattagtaagaaatgcatgctttaccgctgcatgctgccgtatcttatccttttattcattttatttttcaacgagtttttttagggatatgttttcaacgagttgatagcatatatacgtgaaaaatgctaatgggtcaatttagtggaagaacaaggtactcctgtttagtgagaggaactcatgataagaggtatttcatccatttcatattataaatcatttttttaaaaaaatataagtttgattaaatttatagaaaaatatagtaacatctcaacacaaaaacaaacttataaaaaatatatttaatgttacatataataaaactaatttggtgttgttaattttttataaacttgagcaaataaaaaaaatgtttcactaaataaatcaaagcgagtacaaaactcaaagcaacttataatatactccgtaaaacataaaacagagtactcccaagttatttttcgatgaggaagtaaccatcagttcatctaatttaacagttaattaaacatccaaaggcatctaaatactcgtcaaccaatcatcaattgattaagtggttaatcgttcttgccagctagtatttttcaccgtattagattattgaaacaagagccttgtatatggcattaaaccatcattgccaagccaccaaaaaaaaaagaagaggaaatgcacgaaaacgaaaatgatagcagagtacatcgcagttgcaagacgaacgatgagctgcagtcggtactgggtacgaatcggggaaaaaacatgttagtaattcatcaaggaagccagcgcagcgacatctccatttgtaattaattattaatctcaagtatggaacacaaaatggactacaaaaggggattctttaagccttaatctcgtaataatccatggacaagtcttgccattgtaatacgtctcgtacgctaacgaagcggcctttccttgtcacaatgtcacatgtaagatggatgtatacttggaaaattacatcaacgaatccgggagtaattcggcctgaaaaaccgtgtatccaatcctgactaatacaagcaagtatggcagttccctatacagttatcgtgaagaaatagagtttcagcaaaacagccaatcccaactgcaacaagaatatccctgcaacgatcaagaaccatcgctctccagaatttacaatgtgagcgcgcagattcatagcaacgaaggtagcagacataaaccccgcgacaccagcaatcacccacctgaatatttctattggcacaatagacaggagctgtcacatggaaagagtgttaaattcatgcagaagttactcaactttctcaacaaccaatagataatcactaaacaagagactatgggtttgcatgttaatagggcatggagacaacaacacataacagacaacttccttgatagagattcggtaaataacggatatttttacaacacaaactatggtccttggtaatgaattagttttttgaatctaaagtagtgcaacttcttagaaacggcaaactggaactgattgctttgtaacgctatatatccagcacacttacatcaaacccaaatggaagccttctaaacaagataattaaccataacaaaatcgacaacactataagaagaattaatttctattgtctaagttttaggattttccttaccgatgctggaatgaagatgaataaagagtatccatagaggcaccatagttgcactagtccagcaggtgctgagaagtacttaaggatgacatatagaccaaggggaacaaatgtcacgtagccatagaataagccagcagaccatgtaaccaggttaatatcatagttccactccttcttatgccatttgtgggataggtaggtgacaaatgtggcaatggatgcagcaacgaaaatcagggtggtgcatgtccagaatggcccatatctacaaaatttaattgaaatgaaaattagcaggcatataaccagtgcttcaattccttgaaagtgcaataacttgataaaacacttaaattgcagagctatttatttacaaggaatttatcattatctgaaaaaagaaataatacttccaaaagcagagtttccactgaattaataggttagctgatatcgaaacacaaagttctatttgcaaatgatcaaacagcacccattgcttcagatttcagacattgagaaattcaggaaaatgctgtttaggtaatataatttattgctatcatctcaatatattcagtcctgcatatttgccaagtttttcacaatggtatcccactgccacttacaaatgcctcttcacctaataatagtaacccatggtatagacttgtactgctaatctgctattttcatgacacatgaattggtacaaacattcaagtttacttagtgttgacaccatacggtgatgttgaacaaggcacaaggtacattcaaaaggcaatcttagaactgttaccataaacactctcaagataagttcaacagaaagataatggtgcacacagcaagacaaagtagatgaaacaaagctttgaaatgaaaaataacaatggaatgatccaagcatgggtaggacatgtcattgtaaaaataaaaataagtttaggcagtgaaggctaaaggaaaatcctagactcccttttagtatgttgttacaacaagtcctcggaattattcattctttgtcatagaactctcagcaagaagaacgggaaaacaacatacaaaaagagatatagaagtattctaccgacctaagacatgctaacaactaattacatgtcgctatgagctgaaattattgcgctactcactcttaaccaaatgcaagacatgtcatcgagaagactaggctattttgctggagcaatcaaattcctcctatcagttcattatcttaaaatccccatttcttacacctatgtgaccaactcctctgaaatacccagacaaaattatcacattgtgcacgcaaataagtatcatggactttccagcaaaacaacagaagacgttcatagtctgtcaatgctattaaccatatccgctacctgagcatatgatctctaggaacattcgaatgcaaactatagtactactactaaggtaaggaggagttaggcgatggagaggcatacaggtcggng

SEQ ID NO: 10200 - DNA, 2120 bp, Oryza sativa
  unsure (1)..(2120): unsure at all n locations
ngaggttgaagtcggcgaacttgatggtcggcggatctggccccgtcgccgcctgcgaaaccccaacaaggagcgcgnaggtgagaagggtgagaagaaaacccatcggcgtgggaggggacggggacggggaagcttaccgggacggatccggaggccttggggtcgtcgagggcggagtagccaccgccagacatcatcttcgccggcgacggcgacggcggcggcggcggcggcggcggacgaagcgtggaggaggagcaaagcggtggtgggttaggcaggaggggcgcgtgaatgcggctgcttcattcggatctctcgttgctttgcgtcagttataacctggcgcgaactgtgtcggtgttagtcactggctcactgctaatgtttgctcttgtaacactgtactccgatatttgttagtgtcaattttggtcatgccaaaatatatttgttacttcttctgtttcataatgtaatcattctaccatattccacatttataatgatgtatatatgtctagattcattaatattaatatgaatgtgaaaaatattagaatgacttatattgttaaacggagggagtagtactgaagttttaatactatcaaatttaataaagtaaagttggtactagtgtggataaacataggtatcaaaccaaacgtatgtttgttacttctaaagttgctaaaagaattggcagaataattgtttttctttgatatatagtacctccgttttttaacatgtgacattgttgacattttacaaacatttatctattcgtcttatttaaacttttatgcaaatataaaaatactttaattcatgcttaaagaatatttgaagataaattaagtcacaataaaataaataataattacataaattttcaataaaacaaatgattaaacgtatctttaaaaagtcaattgtgttatatattaaaaacatgaggtagtatatgtaatggttaattttaggcttttagaatgttagatatggagaatcaatgattgtttttctttgagtatatatgagtagccaatcaagcctcgtttgtaaagactgatttaacttgaaggctgcttcccgattgaatttataagtatttatgtgttaatatctcttgttattgtgttctaagggaacgttcacaagagaaaatcgaattagcaaggacttgttcgaggagccaatccagcctcttttgtaaggcccgatttaatctctcgactgctttttaattgaatttccaagtatttacaggcttccgccacgatggtgtaccgggcattttggtgagagagaacattttcatatttgtagaagtataattatcattttggtgagagaatacctttttatatttagccctgccccaaagccccaccataccataccatttgctccatgctcattctccgattcttcacacaacggataaaattacttacccccgcaaacatccacactcggaaatacctaaatactatgaaaattctctgttgacagcaatctatgcttcacagtagtatatattttgtatatccaagtcgtagataagaaagtagggtctgacaaggttccaacttctctatgtaacttcgagaccagcgagattgatcggtgaaggtttttgcgcaaataagatgatgttcgaaaccagcagccttgttgtgcaatcaggttcaagtaggtaaagattcaccaaacctccattattcaagtttcatgatttcctgtaggataggacatgacactcgacgaccaagaggcaagagcacagcaatagagtatttgccatctgatgtttgcttgggtgtccaaaagcccccatcgcaggcttacgcttagcttaaggtaagttagggtctccgattggagcatttaatcaaatagaattaaaaacatatttagttgtcgcctcatgtacaaattggaaagcatgccgataaaataaagatatgatgcgttcttctattggattagaagaaacaatgtactgctctatattgttaatgtagaaatggtcgttgatataggnnnnnnnnnnnnnnnnnnnnnnnnnnnnnnnnnnntgctataggattagctaatcaatgggcgcg

SEQ ID NO: 10201 - DNA, 2895 bp, Oryza sativa
  unsure (1)..(2895): unsure at all n locations
atggacataaactctnnnnnnnnnnnnnnnnnnnnnnnnnnnnnnnnnnnnnnttgtgctagggtagttgctgtttatgtaggcaggcacctatcgctggctccgaaggcaaaacccctctttgcctgtatgacgagcattattttgtgaatgctaattcacaaaccaaagcgatatgatcacttccccatttctgtcaagcaacaaaaacagcatggattagagttctgtcatgaagatataacaattattcgatgaaatttgtgaagggttcaatgataaaatatacgatgcacttggtgataccttggtagggaacccaattgtttgtttcagaatttcttttgggaaggtatctagcacttgaacagtctgcagatcttcggaagcccttcattacacaaagtacaagattgtatagaggtaattagatagttgaatgtcagtggcaatagcaaaggaattccaataatgcttatttaccatatgtagtccactgttcccataaattttctgttgtaacttgttactagaggctccttgttggcatcttttgtcccttcaaaatcctggttgaacaatagttaccacaatcacaattgtttcacatgattgcctggaatttattggttctagaaaattattctatataaaaagagtaaatttgcacttttgcactagctatttgtcctttatttcactctgcactggtgtttcaaacaatattttcactttgcgctgcccaaagtcaccaacagtattgcagtttgcaccagccaaatctcatgttggtcttatccaattgtctgtcgtcgttatgaatcaagcacctttggtgatttccaacaccaggctagactgctacagcccagtattgtgttgtgttagtggttatacagttaactggaaatgaactcggctactgaaaaactacaaccttcgttagcttagggtggtgcaaagtgaaaacattgcttaaatgaaactactgcaaggtggaacaaagaaaaaaatggtgtgaagtgcaatttattttgtttatagagttaagaactacacatattgcaacccgccaaaaattaggcatctcagaacgagctaacagttgatatctgatatatctaaataaagatgagtggtgaaacatgttgatttctcacatcaaagattgatggagaaattgtagctagccatgtgaagttagcggttacctccacatctgtgtagacacttcggactttcaaattatgttccacgaaggtgcaatcttcattcccagtagcagctttaatttcatctggtgtccacctgtatggatcataatcgtaatatcttttatcagaagtaatcacttgctgggcagatggtgaaccatctgaggttgtttgcagctggtcttcatcttcaagtaaaaattcattaacaccagaaaactctttaaagatggaaggatctgcattcacatctgagcacaaaacttcattggatgccccatcatcctcaaaagcacaagaacaatttccaagctcatttgaacatgaatgcgattttgaaagcctgtttatcacttcaggtgtacattgaacatcacaagtgtcagaaaaggcacaatctgtgtgttgcaaaggctctagtggtgatgttaactgagttggctcagtattgttttcttcttctagcctcagattactcatttgatgaagtgtatcagcaaacttcaggggatcactgaaacaatttgattttgattcactacgcatgcaattattttgagtagacaaaggttcactgtcttgttccttttcatcgggtctgacctttgatatatcaaacagtgtatctgactggacattgtttcgctcaaaatcacaagtagcttttccagaaatcacatgaccaggaaagtttgccagggtatttgaactgttattgctaccaccagctaattcttcccaagaatctttagattcagatgattcataagatggaagaagctgacttctatcaactatttcactcgaatctgactgaagggtctcatcatttactgtcgttgaagcagacgaaaagtttgtaacgttagtttcttctacagagctcttttttattactccatatccttcactggagttgttaaccactgaagtttcttcaccattagtggtgttggtatgtgcttcagcatcagatgtataggcttcctttgtaggacctttcacacagcccattaattcttgctcgtgaggatttgtagagctctctgggtttaagaaagagtctgaagcagtatcagtcaaagttggttctctgccagaaagacgagaattttccgttacatttcttgcttcaggttgaggcttatgatcatttgggtaacttatgctaccctccttactattcgtcgtgtgaaaaggcggatagaatctgttaaataccaaaaagcatcaaacaaaggtcagttaggttaaaatatgcagaaaaaattgtcaaaagagggtgtctctgataaagcagaaggttcaccgagctgtgttaggaccagtatatagtccctgtgcagtactagtttgctgccctgatatattactcttcacaagaccggacagattcaactgcatgattattatgttgtgtgagtttcagtttctcaaaaacagccattttcaagttaatacagaacactctttaccttttgctccagcataaaattgtacagagggctctgaatgaggaagaaatgggtcagacattttgaccttgttacatgtaagcatgtaataaaatgtccaagaaatacagtgaaccagatatgaatctttaatataaaatggtagggactggatatttggcttggtgtagaggtggaatcttccacaatattactggagcttattt

SEQ ID NO: 10202 - DNA, 3041 bp, Oryza sativa
  unsure (1)..(3041): unsure at all n locations
ccaatttatggccaagaaaaattgatagaaaatcttaggtaatgcagctatcctttgtttcagtgatgaaagtataaacaagataatagcaaaagcccccaccccacctagtcatctacacgagagggtggaaaacaatgcacgatctcaaatgatgccatgaaagcatcagaaagcaacacgatggaagataaggtgtacattgttgctcagtacttaaggtctaacaaggtgttatttctttaccatgttatactaaaaacaaaagtgcttaggccaagaggctaattctggtgaaaaaaaaatcatactataaaagtctgaactaatgtaggaaattaagactcacgagtgaccacaacataatacctgaccaagtttgatgtcccctctctttggattgtaaagaacatgagtattgcatacaataatttgcttagcttgttgaggatggttagggctgtgaaacgaaagaatggttataaaaacatggatagataataccaatgtggacatgtgggttatgaaattttctcttcaataataaaggaacgtggaataggaactacacaagccagaaacaactaataaaaaggagacagcataacaccattgtcacaactcacaactgtgatgcatagtttagaaatcttgaagtttcaattacctagactcagtttgcacatttcctggaatcaccgactgaaaaatataatgaggaaacgattagcagatataggccatgcaagattggcagcataaagaaagcttcaattcaaagtgatcagtagtttgcccaacgatttcaagcccacctctaaaacacaaatctgtgcaacattatcacggagatcaatcttattgaactcgatatcctcttgatagcgcaactgaaacctacaagatgaaaaattttggatgactatgagaagtcaaagtagaagttttttaatgtaggtataacatcaggagaaataattttgtatcatacaaaaggtttctttctttaaaaaaaagaagaagaagggaaagacaggattgacacacctagctgttcgccaaaagatcgcacatccatcagtggcatttccagtccgcatctgtaccaaaggtccagcataatgcgtaaatcatacggtcaagcagattcaagaaaattgtgtttcctcaatggcaatcactaatgaaagtttcagttctgcgcatgctatgtaatcaagtaactgtaaatgagtagttagaagcactggccatttttgcacaactatattttgtccacttcatcaacagagtaattcctgtgatatatacccactctgtcgatttttatagggaatattttcatttaaaaaaacaaattgtagattttgaccaagaattagtcaaatgaccagtaaatttagtgtgtataaattataacgatagatataaattcatacttcaaaatgctttcgaacatcggtttaaaactattggatattaccttccatatgccattatatcctcgagttgccatttcttgctcaaggtctgtaaatttgtcaacctcctacaggcataaccaaggaatataagtctaacgtgtgtcaatatagatcccatttaatcattaatatcaaagaaatgtgtttatagcatacaggttatattcatcaagaagtgtcaaaaaactaacaaactttatcctttgtatgatttctagttgacaatgttatatgcagctattgaactagcagggagtgaccatgtagactagtggccttgcaattccttgcaattttccaaatttcaacttttcgagataacataactagctccacgaaggtattaccacttttttaactattgacttagcagcacaacccttctgaattactgcagtacagcagttataaattacctgaagacataaaatatctggagaccacaaaccaaactcgaacactaacttttccttccgccagttccaatccatgatgaaagatggtatgcgctcataaagaaactggtgctcctgggccagataatcagctagtatattgtatgatagaaccttaaacctctctgcatgataaaaaaagatctactcaatataccaaaggaaaacacgtggtaattttaaaacaagaacatcaattccacacacataatgattactcgactttaatactcttggtctaaaacacaccatgtccatgggtattatctgactgaattattcatatacggaaagtgtctacttttacatcttcaatacttctgaaagtttagttttcacccctcaactgtaaaactgaatagattacaatcataagcttgaaataaggtgtttgctcatggataagatgcccatggacccttttctgtttccctctcccattctctttgcccattatcctgtcacagaacaagatagttagctgtgatattgatttagctgaggagagaggggaaaggtaataggagggaaagagaaactgtatcacttttccaatgccttgctgtggcatcagtgctagcatggcagtggatgtggcgctgaagtctgtttcaggcttgatcggttaggggtgtaatttatctggtatagaaggttcagtggtggttttcatccaccttgagaattgaggtgtgaacacgtaaacttttggaggagttgaggggcataaactaaatcattttccttcatatatcatatatcacataccacatggcacatctgttgtctaaaatcaagtgaaactataatccattactagtttagtacacaaaccaaattgaaaagctttcaccattttgacttcagagaagtgctaagccatcaaatattaagaaactccgatcattaataacctaaaagtttttccacacaaaaagtaaaaagcaattacactattttttacttcagagaagtgctccctggatggtttgctatgcgattctactactactgcagtgctaagcattgagacagaatatatcacannnnnnnnnnnnnnnnnnnnnnnnnnnnnnnnnnnnnnnnatatcatcatggccca

SEQ ID NO: 10203 - DNA, 3468 bp, Oryza sativa
tgtgccccttttgaatgactcatccttgtctgcctgcaggtcgactctagaggatcccctgaggagatggggagggtttagactctagaggcgaggaaggatgggggattctggggagcaatccacgaggggagatgggcgggcgggcgtacgttgtagtaagcggacatggcggcggcgcggcgtatagaggcgcgggaggcaaggcgcatcgctttggcggcgctcacgactgcgacggcgggcggcggcggcggtggcggcgcggccgcgttcgacggtcgagtcgctgtgggggtttgaggcccgcgtgctgatgacgtaaatagtccttcagtacgggagggtcactttacgccttcggaaagcgatagcgcacatttgctctccgtgttcagatatcgaaggtgaaccatcgtatcggaattaagggctggtttggtttgatgtctaaattaggcttatcaatatttagcaatttcaatagtgtttagtgtctatttggtttgaagctaaattttggcatgcctaagaaaataggccatttcaatagtgaacttaggttattttggcttcaatctaaatataactttgccttaccaaaattagtcatgccaaaacttaccaaaatttagcattgacaaaatttgataaggtctatttaggccacaaaccaaaccaaccctaaacttttttggggttaatttcttgtgtttcaagggagccttgcaaatctctgggcctccctttctggcacacattgaacatggtttgaattctgatggatcctttcaattttccaacatgggatttcatataatatatagaaattcatataaacttttcaggattgttttacacgaatcagctcaattttccgttatagtcgaagaaattaaggtagtaagaaggaattaaggaagaaactaggggaggttagccgaatagacgataggggaggagtttgtataaatcctccgttctacacgaggcctttcactaggaaaggagtttgtagtaggctatcgtagagccggtgattttaatttaatttgaatgcagagggattagggaacaactgcacaatccatgtttatagagaattagaatgccaccattctgtgggcaaaatcacttaatactttaacacatcaccacaagcaaaaatatcactcagcatacatgtacgatgcaactaataagtacagtccagctgtagattgctgcaaccgcacaagtacacgcataaacttttgccaagcatggcttgctcgcatctataaacatatcccatggtaacgtatggtttgcttgtatgcctattgatactgcagcgagggtcgcctccttcgaggattgatgtgcctaaacatatcttcgaccatgcagcaattgtatatactaatctggggttctcgagtctcgactatgattactggaaaatgtttgtatcaacagatcctatgtagcatggcaatcctcggcacgcatcaagaggtttgttgcatcctattcgcagaaagtggaagctacatgagctgcaaagtcctcagacgctgctcttgctctggatccatctttggtggtgtataacacccgcgaaggtcctccaccacatattcctgcacatcatcaaacagtggaagtacagagtattaaacgagctgattaacaaatactactatttcactggttcagaggaaatgacaagtgatgacttcaagcagtgtttacctttgtgagctcccttttggtaagtatgtgatagtgtctctgcaagatcctctggacggctacggttgcagcgaagaagccatatgcaactccaagtatagcaaaaacaatgacaaatatcacagccagagcaaggcaagcttctattgaagcgggaaaatccagtatgccccacccatagcaacaattgcggcatccagccaggcatggatcattggtgttgaaagacgaacactgtactatcagtccaatgaatcctaccattacaaagaacaccactactcctgaaaaaaaaatgatttgacacagatatcagtaactagctttctagaagagggtgctaacgccttttacttgaggaagcttgtcagataggagtaataacttcaaaaattgtttatcaaataaaaataagttccaacgacctaaaattttgtgataattgaaatgttgccagaggtagagagtgttactctgggtgacatgtttgacctactatatagaatttctattttcagtgcacaagaaaaacatgagattatggttacagcagggaagcaagattgattttcattaattgtatgcttgtatgacacaatagacaagttgagtcatgagtcatgactacattataaatggtagtaatgagcatttaactgcagcagatcatgtcaaattatcaatcattatacgaactgcaatcagaactgaaggaaaagaattgcataccgacacagtagtaaaagggcacaggatgatttgataggatgtgttcccaaccatcagaaaaactgtttctaaattgtccatctttatccaacagataagccataccaccgatagcagcaatgacctgaaaagcaaggcagataaaaagtatgtcagagcaccataccaaaaacagaacggtgcaaaattgtagtaactcaggttcacagaggtttcaacaaaagaaataatatatgcagtcttttctgtgtttaatagagccagcatacatgtgaatgagaaacaacaacgagcaattagaaagaaaggtgttcttacagtctgtacagccaggaatacaaggaaaacatccctagcaacaaacaatcgaaacatcatcttgcgacacaggttgtcctccagacattcgacacggagatggaattgtgccttacatgttgtgcagtgagaaaaggcagttccttcctgcagaaacaagcgcaataaagcagtattgtaaaacaaggtctacaaggccacataacttgtaagattaagccacataaggggaaaaactatgccatataagctttatatggtggggtgaaagcacaataccttgccataaagtaagttaagtgtaataaagctaaacaatacactagtacattttaagaagccaactctatcaccatcaaaaacatctcactaacaagcatttgaaacagacgaagctttgtacactggacatataataagaataattcatcaaagactatgccttccaccaaggttacatatcatcggttcatcgcgttacaacagcagaggcgacactaggacagactagcagagctttttccggaaattcgtaaatccaatgttgggaatgtaggtactagcaactggcactttaccttaacagacctccaatgatcaaggcagtagcgatgcacgaactgctgcgtccctttgcacatacaaggagaaatcagcttatcacctgaagcagcacacgagccaaac

SEQ ID NO: 10204 - DNA, 1971 bp, Oryza sativa
  unsure (1)..(1971): unsure at all n locations
gaaagctcaaagcacactatttggggttaaaagagcccgaaaagcaatattaaaactcaatataacaggggactgatataaggtacgaatttttataccacagactcaatcttgggaaaataaagttaggagaagttaaagaaaccaactatttttagaacgctgttattaaggtagagcaatccaggatatacagcgccttaaaatgtttaagagaagagaaaaaaacccatccaacttttgccaagaaaaaaaatgaagaggatttttcggctcaacccgaagatgttaatggaaagcattaatgagcatcgtaagtacaggagcaatgtttaagcgacggataggtctaaaacatgacctttaatacctcacgttataaaagaagtggtttaagcgaccagatttacacaaaaagtagagagtatagggttaacaagtggaaagggcgtagctatccatagggacacgccactatggttcgccgagtaggcaaagggggcaaaagaaaannaaatcacctctttctagtggcaaattattaagcacaaacctaagaagggcatttggataattgataaacctaaaagtggcaaatagttaaatttcccgagttcgggagacaggttctcaacttgcctcttgacacgaaaactaagcaaacaattagaacgagattagtttagtattagcctaaaaaacttgaaaataaattaatataattttttaaaataacttttctataaaaaaatacttttagaaaaatacacaccgtttaaccgtttgaaaaggcacacggaaaacgagagaggtgacttggagaaaaaaaaggggaaaaacacaacatttactctgtatccgattgtctcacttatatttatactccctctgtatatccatccactcaaaaaaaatatattatgttttgggacagagagagtatgtttttaagtcaaaatttaatttaaaaaatattttactgcgttttgttgtagtttattttatagtatttgttttcaccgttaaagatacaaatataaatttttcactcatattggaagcattagctttggctttggcttattagggcaaccaatgaggctcttaagccactaatttgctaatcaatatatctgaacggtctgatccaactattcttagctttggctttggttttttagggcaaccgatgagactgttaagccactaattgccaatcagtatgtctaaacggtctaatttgtgtctagaaatttgttccaataatggattgacagtcccaaccgtgaaatattaaaaacgtcaggtggcgtctagtcatcagggtttataaaactgtgggattatcgtggttatcacgtgcgataacctataaccttctcagtttttaaaaccacgatatacctcgagataactgtgcggttaccacgataatcgctaaaccgtagggtgacggtaaccccacccaaaacaatttgacgaacccttctagtcgtacgacttgataacagtgggactagataatatgttccgatccgagtcgtagctgtgttacaagcaaattgtcaatttgatggttgtaaccccgttcgtttctccaactaagagttggatgtcaaactgctaacagtgtgtttcatgtgaaaactcaattaatatgaaagttgttctaaaatataagattaatctatttttcaagtttgtaataattaaaactcaattaatcacatgttattaccacctcattttgcgtgaaacacttaaacttttatcttcatctgaagatcatcttcaggagatttagagagatgtgaggcggtcaacgcaaacgacgaactaagacacgcatgaattgaccagatgagataaaaaaacaaccatttccagcaagtcagcaactaatacaggcctaaaaataggggatcctctagagtcgacctgcaggcagcaagaggagtatatatccagcac

SEQ ID NO: 10205 - DNA, 1205 bp, Oryza sativa
  unsure (1)..(1205): unsure at all n locations
cggtgtgaattgctatccnnnnnnnnnnnnnnnnnnnnnnnnnnnnnnnnntttctcaaatcggcaaggggacaagcccctttctccccctccttttcccctttttcctcctcgccggcgtcatcccccctgtcgccgctttggccgcgaccgccgagcgccagctcgcgcccttgaccgcgcaagtcggtttccaaaccgacattgccgccccctataaacccaggcgcccttccttccccttttcccctcccatctcgctcgccgcccccgcgccattgccaccccctctgtttcgccgtcaccgttcgtcgcgtgtgtgccggaggagccggtgcgcactaggacgcggaagggagcttcggccgcgtcctctccttcctcttccccggcccgaggccggagagattactcccgcgccgtcggcctctcatcacagcgcccctcctcttctcggtgatgtctctctccgttcttcctcctcgctccatctcctccccctagctttcggtagtagctcgagtagcctccccgtagttagccggcgccgccccgaccgttgccgtcgctcgccgtgtgctcgctgccgtcgccgcccgagctccgtagcacccgcacgtcgccagcctcgctcggcgtagctccgcccaatccgacgctagcgtcgagttcccgtggcggcgaggatgctctcaccgccgggaatcgacctctcgtgacctcgtcgtcgtttccctcttctcccgccgccggttgccgccgccgcattccgccgccgtcgagcaacctccggcgaatccgagccgttggctcgccttcccttgtcacgtgcaaccgcccggtgtgctcgtcgttgcccgtatcgccgtggttcgctccgccgctcgccgctgtcgcccgccgtccattcgcggccgggtcgtcgtctacctcccgccagcccacgtggcagccacgtaggcgccacgtcggcgccagcccagccgaggtcgggacgggccgaccccggtcagtccctccccgtgcgcgcgttccaccgcgagccgtgaggctgcgcgtgggcccgccgcacccacgtccaccacgaaccacgcgcgtgcaccgcgtccttcccccgcccgggcgcatgagccgcgtactccctccgcacggtgagccgagccgctgacaagcgggtctcagggtaacagtcgaatccaaacacg

SEQ ID NO: 10206 - DNA, 1959 bp, Oryza sativa
  unsure (1)..(1959): unsure at all n locations
ccgccgtgtgattgacanacgagctcggtacccttgtgattttgtggtttgtttcttcgattggatgttgaatttcctggttctttgaaaaaaattcgaagtgataatggtggtgaatttgaaaatgcttcatttgaacaattttgcaatgaaagaggtcttgaacatgaattttcttctcctcgtgttccacaacaaaatggtgttattgaaagaaaaaatcgtgttttggttgagatggctagaacgatgttggatgagtatcacactcctagaaaattttgagctgaagcggttaacactacatgctatatttcaaaacttggaaaaacttcttatgagcttcgatttggacgtcaacccaaagtttcatatttgcgtgtttttggttgcaaatgctttgtcttgaaacctggaaatttggataagtttgaggcacgctccaccgatggaatgtttcttagttaccccgcacaccctcgtggctatcgtgtacttattttggaaactaacaaaattgttgagactagtcctggtactagaccagaaattgcaagtacattgtcacaggtgcaggagtaggatggtcatatatttgaagacgagagtgacgacgacgacgaggtcgactcggccggttagaccgggcgccaggccgatcagaccgccggcacacctccggtcagacagcctcaggatgagcggtcagactggccagggtcgttggcttcccgttctgttcatgctgatcgtgatggtcctccagaggctacaacttcgaccaatactggtacagaacgtgaaacaacttcagaagtcgctgctcctttgcatattcaacgacgacatccgccggaacaaatcactggtaatctaggtgagcggactataagatctaaggtaacgactcatgatgtttctgcaaattctgcatttgttgcttcttttgaacccagagatgttactcatgcattaactgatgaatcgtggattaacgccatgcatgaagaacttgaaaattttgagagaaacaaagtttggactttagttgaaccaccttctggacataatattattggaaccaagtgggttttcaaaaataaacaaaatgaggatggtttgattgtgacaaataaagctagacttggttctcaaggttttacccaagtggagggtttggattttggtgaaacttttgctcctgttgctagaattgaggcaattagacttttgttagcttttgctatttcaaaaggttttaaattgtatcaaatggatgtgaaaagtgcttttctaaatggttttatataggaggaagtttatgtcaaacaaccaccatgttttgaaaatcctgattttcccaaccatgtttttaaattgtctaaagctttgtatggcttgaaacaagcaactagagcatggtatgataggcttaaaaattttttgcttgcgaaatgttttacaattggaaaggttgacaaaacacttttagttcttaagcatggtgataatcaactgttcgttcagatttatgtggatgatatcatctttggttgttcaacttacgctttggttgtggagtttgctgagactatgcgcagggagtttaagataagcatgatgagtgagttatcatactttttgggattgcaaattaagcaaacacctcaaggtacatttgtgcatcaaacgaagtacaatgttaacatcaattggttctacagctgtgttggatcctgatgaagatggtgaagctgtaactaacaacatgattgaatctttatcgcatctgattgcttctaggccagacatacagatttgctgtgtgtttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10207 - DNA, 1085 bp, Oryza sativa
  unsure (1)..(1085): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatggctagtgcttatagtttcagttcatagtatggctgagaatcaacaatttgttttcagaaaggaaaaaaaaaaacaagtatagatgtcactctacaatatttttgacacgctaaaatggtgaaaggaacacattggtttggacatacctatgtactaaaactttggaaaatcaaataatgcacccaatcatcttaatgaaagttgaccaaatatactttttcccatatatcttatataaataacatatattcaaaaccatgctttgcatatagctccacagcaatattttggagtacacatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtttaactcacttaaaagccggtataccggtat

SEQ ID NO: 10208 - DNA, 10891 bp, Oryza sativa
  unsure (1)..(10891): unsure at all n locations
gcgcgatgaaaatgatatggcacccttcagaaaatccctgttgatttagaagcattgcgcagcattcctctaaaagagagaacgaccatagaggatgtgtctgccaaacttaacatgagcaaatcaaagattcaaaggtatttgagaaaaggtttccttaggcgccactctagtagcatcaaaccatatctcactggagctaataaaaagtctaggttgaagtggtgtgttgacatgattaagagggatttgcatggtggtccaaggtttaaggatttttttgactttgtgctcattgatgaaaaatggttctacctctctcaaaaatctgaaaaatattatttgctacctgaacaagatgatccccatcggacttgtaagaacaagaattacatccctaggctcatgttcttgtgtgtttgtgctcggccaaggtttagggatgggaattgcatttttgatggtaggattagttgttttccacttgttacttatcaaccggctatgagaggcaatgtgagaaccggccgtgtccgtggagacttggttttgaagcccataacttcgatcacaagagaagtgattagagatttcatgatcaacaaagtcttgcccgctattcgagccaaatggccaaaagaagatgtgggcaaaccaatcttcattcaacaggataatgcaccttcccatctaaacttggatgattcggatttctgtgagcatgctaagcaagaaggatttgatattcgcctaatttgccaaacaccaaattctccggatttcaacattcttgacttggatttttttcgagctattcaagcaattcaatacaataagaatgcaaaaacaatagaagctctagttccaacagtggaagaggtaatttgatcaaattgttcacacatgttacattgattcttcaacaacaaatttgctcattgactcatttcttgcacacttattttgtaggcattcatggagtattcggcacacaaagcaaaccgaatgtttgtaacactacaaagtgttttgatggaagctatgaaggtgaaaggaagcaacaattttaagattccacacatgcaaaaagaaacattagaaagagaagatcggctgccaacttctcttccttgcgaaccatctttgctagatgaagccaaggctactctccgattccggtgcgagctcctgcaactccggtgcaaaggagtccggcacgagctctgactccggcgcttccacggaatctggcgcgagctcctgcaaatctggcgtgaaggagtccagcacgagctccgactccggcgcgtccatggagtccggcgcgagctcctgcaactccagcgtgaaggagtctggcacgagctccgactctggcgcgtccatggagtccggcgcgagctcctcctctgcgacggtgtttctggggcagcggtgtttctgggcggtggcgtttgtggtgaataagaagatgagcgaggaaaaagcgcgtggtggaaccgaagagtgcgaagttaatacagcgccggcgtggggttgagatcgaagaggcaggggcaatttcgtcggcttttgtacgtgtggctaggaacatcatctaaacgtgaaagtacgacggccacgcaaaacatcttctaattgtgatacggagggagtacaagaatcagtgagcacgtgaataaaaaaaagagaaaaaaatacatccccacatcccagaaaccagaacgcatccagcgccgcctgccgaccttctcgcttccatcgccgccgcgaaaccacttccccatcaccatcgctgcctcctccccatgatcggggtcacggtgcatgtggtgctagggctcggtttaagtgcacgaggtctggcggggctctgatggtggtgacaatgtgtgtaatggcccggcggcagccgaataggccagacgatgataatggcttcatccggcttcccaactatgaaaaggatgggcacgtgaagctactgaggttctagggatgacacctgcacggaatcaaatggtgactcaccggagaaggaggatttggcggtggtgctcggcggctagagttggggaaaatggaattgatctcggtggtgctcggcggctagagttggggaaaatggaattgatctcctagcttgctctaccaaccttggcgcttattggggcattttgaagaggatgccgaggtgatgaatgaggtgaggcgaccaagctggaggtggtagagggcaagtgtcacgtcccgccttcccccaggccaggcccgcttacatctgatagctttcataggttatagactgccctcacagaccaacacatgtcttttctgcacactttgtcctcactcgtgtgcacccggaaagaatttcccggtcggtcacccatcccaaattgctccaggccaagcacacttaaccccggagttctttggagattagcttccggaaaagaagttgcaacttgttgatatgagtattctattaattctattaagccctaggccgggatgttacagcaaggtgaagcgctcggtcgaagacacctcatgcccacgcgtcgtcggcgctctgccgctctgcggtgtcccttcttccctctctctctctcactctctcggtgttctgggctgaggaggagggaaaagaaaagtggacaagggtggagcgagacagaggggctttctagtgggcctagaccgatggaatcaatggtagggagaccgatggaatcaaggttagggtgagcagtatgggtagagattgagtgaagatcagtttctagaatattacaggattatttctctctctctttgttaatctgtagtttaatttgtgggcatgctaaaatagggtggatggaggcagatgaatttttagttggtttaaactgaggaaataaattctacaaaaattatatttattcattataattaacctggtattcgaataaattagttccattatacacttgtattcagtgtaatgcacattttggtgatggtaggttttagctgattaaggtttataactaatccactgtttgactactttgaccgatttatttgatgtaacaaatgtacatataaaattaggtaaaaattacagtgatttgattatattgattagtactttcatgaatttttccaagattttatcttgcatgaattatttttgataattcgcaaggccttgctttatatgtctgtttccagtatagatatatgtttaagtcattgtgaaattatattttaattttagaatgagcattgttgaggaaccaaaacaaagaggcctgatcttgaatataacgtctgaacttttcgttcaaaatatatgttcatctagatttaactatttttttatcatgtcgatcctatgattttacaaaaaagttcaaatttaaagtagacacagtaattatcatacttatagtgtgtatatattttgggctttttataaaggcttctaaagtcgtgcaacgcacgaccaaatagctattttttttaaacgaataagccatttgcccctatttcattaattcttgctaacggtgttaaatgtgaggtgaaaaggacaagtatacccttagatattttccggtacttttgtacaccactttcaaatttaacccaaattttagctaacttttacaaaattttgacaaactaaattattgctatggcatcaatagatctgattatgtcaaaagtacgggaaagtattgaagggtatacttatctttttacaccccgcatttaacaccattagcaagaattaacagaacagaggaaaacggttgattcatttaaaaaaaagtaggggtaagaacgaaaatcaatattagacatcatcaaagtagggggcaacaacgaaattgtcccaaattaatttgtctactatatgtacagtgtacactatagttgtagttatgaaaatggcatttctattattctctcacacaactcatcttaggatgcggagttgtctgaaattctaccttgtttaaaatttccccatatacctcatgctgcaaaatatagataggccgtgttttgttctttggcaaaatttgtttgacgtatacggatacatatttgaagtattaaatatagactaataataaaacaaattatagattccacccgtaaactgtgagatgaatctattaagcctaattaatctatcattagcaaatgtttaatgtagcaccacattatcaaatcatgacgtaattaggctcaaaagattcgtctcgtaatttacatgtaaactatgcagttggtttttttttttcatccacattacgctctatatatatattcaaatatttgatgtgatgaaatttttggaagtttaaagggaactaaacactgtcatagcattaaattaacatccgttgttccctatatatgcatagagagactgtatatatacatatgcatgcctgcaccaaaattcagccaacaccttgctgacaaaaagacaacaaaagtttagagaccagtacctactgaaatcctttgtcgtagaatctgcttgacatatcaatctcagctctgagaaagtttagattagaacataatttaataatgattaggaggcatcaggaaataatgtcctacacgtttctctcatcatccttcctcagcaagggtcaagctaaggccatttacaatgcaaagacgtggcgtgtgacaatgtagagccacgtaggcaaatcgcttgcgtggagtagagaggggagtggggaccgttcccaacccagcttcgcgtgatcaagtttggccacacgaacctcaacaacttttgtccaaaaaaaggggcacctccacgagaaacgagaaagcaaaagaaaggaggcacgctggagtaaaaaaaaaaggcacgctggagtaggggcactcggggcgtggggctcaccaaagtaggggccgccgctgcgtggtgctcgtcgaatgctcgccgaagtagaggcgctcggggatctcaccgtcgctgccttgggctcggggaagccacccgagatccgccgctcggcgccgccgccatcttctaggtggagctcgccgtcgctgcgtggggctcgggaagcctcccgagatccgccgctcggtgctgccgccgtcttctgggcggagctccagaagctcgccccccacctcgcgcgccaatggcgttggcagggtccgcggccgcgcagcttcggtgctgtgcctccaccgtcgacgacggtgtcgttgacgcagccgtcttccaccacgccgcttggcgccgccggcgtcttcggccgcaccgctggatgctgccggatctgttgctcatcgccgcatgggtccctccacccgtccgccggtgccaccgagctccgccgcgctggccggagcacgccgccatggccgccctggacatggggacgtgagaggattaggtgggggtgggggggtgtgggaggggtaagattttttatattatctgtaggtcccgttataaattttttaaaccacacttgccacacttgcactgtgggtatagtgtcttttagagttcccaagcctacatggcagctatggcatagcaatttactaggacgcattgctactgtcctgatgagcctccattgaggaaggttggatgtagcaacatatatatataagaaattgacccattgccaaacagtggctctacgtattacatccaggcagcaggctcacatcaggctatcaagatacgcagccacctcgcagtctaactgcaaagaagggacaacaatacagagaaatgtgtcaggtttggccgtgttagtctctgcaggtaataatagaggagcgatagcaatgcccctggattgatcattggctgaacatttttagtcctgatgacttagcacctaccttgttgtttacagaaagagatcatagttactaccaaagctaatttgatctcaacagccattatttccccaaaattcatatatcttcaagacttcattatttttagcagcaagggagagacaaaggggtaatgaggggacacagtataagaaaactggcatgacaaagatcataagtttaggaaaggagagtgagttccttttggattgacgataatacacttcgagtaatacacatttattaaattttatgctgcacataatgtctcgatatttagattcaattgatgaaattctgctttccaagaaaggttaagcagttcatttgttattccagatatcattggttaaaaggcgtggtttctacgaaaccacaccttttaaccactcttttcttgcgaaatgtgtcctgtaatttttttgtgtacagctttattgaatgtgtcattaatttgaggcaggtggcaacctttccagggcatatgaataattttctatgttgtactgttatataaacagcaagcagtgtaaagaaacacttcaaaagttcaagggccttttacaatgtacatgtgctatgctctaactaagggcacctactagtggcattgagttgataaatatccagtagaatgcaaattatattttgctgcaaactcaaaacatagggctggattataacacgaagcaatgtcagacagcgatagccttttcatgggttctttgtgagagtgttctaatcctgactcttaaatttaatctaaatggttgtgacaaaattctaaacaacttgacaatctagagtatagtaacatgtaccagacaccactgcaccaaaaattatattcaacttcaatatacaaaatgagaaacaaaaaaagattaagatgtgaatactgaaagtagaaaagacgattaatatggctggtctatctcaagaatgaattgtgtactctgaaatactctgttcttgcaatgaaatgctcatgtcatgcaatacacatgcaccttctttgtatatccatctttatgaaacttttttttaaaatttacgggaagctgcagccttcgtagttcatataaagatcttctctataatatattggagaataaataccatgcagtatatatataaatatacaaagagtgaatataaacaaatggctagcttcttaacaagttggagggccttttgcaatgtacacattcctctataattttctaataaaccaatacactggcatcctctgatgtatccatctttatttgtttggacataactagctagtataggattggaagtaatatggaattctggcataattctctggatgactaaaatcatactctataaactggaaaaatggccgagcataacatatggatctagaaaacactgccatggacaaaggtgacacataggtgcccctcggtgattttatgcatcttgctattgttgtaaacattatacagaaattttacaaacattgttggttagatacttagagtcttacgaactaaatcataatgcattgtcctatttatttggacacgaatcaccggtgaaatgcaaaatgtatcatgttgtaaatttcaaacatggaggaagtaacatatatcctacacacttaaaaccgtgacagctagctatctcatcttgtccatggatgtagttttttatgaactttttaagcctctgcaacaagattcattttctaaggaaacatcgtatggatagccactttgattttctaggagcgctgatcatcacagaaaacgtcaagaatggccagtcacagatgctcttgggaacgctcatcacactacatggtgtaaaaatcaaagtgtgtcgatcagaccagcgggtcaactccgatcagagctatctacatcagatttaagggtaatttttaattccggtaaaagttttagtttttgggtacttcaaccattcactcctctggttggtttagttcttgctattcgagactacacatgggacaaatgccaagacataattaataaggctagctatcatttgtagaccatagttctagtcatgaaaatggtctttttatggtcctctcacacaacttattttatgatacggacctatctggaaatactaccttatttaaactttctccatctacctggtgctgcaatacataaatagacttaatgaaacttctatcttccttagccagcaaacattttatatatatggagccgatgaacacctgcaccaaaattcagggaacactttcattgacaaaaacaaaaaaaaaacaaaaaaaaggtctagagaaactcgtactactaaaacctatggagatagaatataatgttcttgcgatattaatcccagccctaaattaaaaagttaaagttacattactctaatatgattaggcggcatcaggaattgtcctacacatttgtttcatgatatgtacatgagtacatacatgattatgaccgtctacgccaaatagtggctctacgtaccacatccagacagcacgcaggctgcaggcaatcaagaaataaagaggtctcgcagccttaaccgagagggatagttacccaactttgctgttaagagtgctcaatcgaacaagatcacccagtgttatagagactcttgaatctattgacaacttgccctagttagtgagttctctcctgatttttacccgtacaagatgtctttcaattcattattttgctcaccttgcttgatatacgtactaagtacaaaagtggttttatacagcttattccatcttttggtctacagcaaaactgctaggctatctgaacggcatgcaatgaattatttctgtatatacgaccagcaaagtcatatatggcatttctaacaaaaaataaccttgataaaaaaaatcaggcattgctgcttgctgcatggtgagtttggctatctgttcgttgctttcgactttctccctcccaaaatgtgaaaaatatgtttgctaattggtagatatatagatgctcagtctctctcacacacagagagacacatacatatatacacaaaagaccagcaattcgaatgatcaagtgcatgtcgctacgcacaaactagctaattctcgacctggaaaatatcatgcaacttgtaggttttaatgtacatcttttctggacaacttgcatagaattaggaggcatcgggagtaatctagcctctttgaaacattctaattgtttaattgttactcgagtattttctgcaagttggtcgttggcgacgaactgtccacaggcttggaaataactggcgagctggctggtttaagaaaaaggccaaaggtgaagaaccatttcaaaccatgcgttgtagcagtttccttctagttccataccacgtctttgcgagattgcagaggcacagagatacagtatgtatgtttgataatactttttgtaattaagttgtcgtttaatttataatatattggtataatttaaacattatttttaagaatagtataaattagtacgacgtataaaaaaatatcatgtgaagcaaatccagaaatggtggagggcatctttttcttctttttcttctttgcatgaggatccaacggggtagggggcttgaggcttacaaatatattaaatttatgttaaacatcgcatccggaaatttacattcatttgatgaaatttctacaagctttccgcaaatggttaaacatttcgttcgtcgttacacgtcttgtaccagcgctaggaaaccacacaatttcccactctattcttgctatgaaatttgtcatgtaatgcatgcaacttcttgtatctagctagttttttttgaaatgtgcaattaattttaggcaagtaacaaccttgttaggggaacatgaataattttcattgttatgtacgttggagcatataagtagtgcaaacaaagagttcaaaagttcgagggccattcacaatgtacatgtgtgcaatgtgctcatggtattgagttgacaaatcaccagtataacgcaaactatataatgttgcaaactcaaaacatcaatgcggcagcatgcagtaacagatagcctccatgggatggcttcatggcagcagttttctgcttgcgcgtactgctagattgaaacacgaggctatcgtcaaaatcttagtcatttggactgacttctctattttttatcaatgcataataaactatttgcattgtgtgtcatataattccaaacaggctccaacctgctttgcgtgctgccgtggcatgccatggtgacaccaatgcctacataaattaagatcaattttttttacttctcttttttaattatttatttaaaattaaaaacttccttgtctcatctctctcctctctttctaaattttatattttgtatgcgactaacatgtaggtgtcattgtggcatgccatgtcagattatggagcgggttggagcccgtttggatttatatgacacctatgaaaagtttaggcacctacgaatgtattttcgagaggggaaaagtacgaattatccccttaaaccacaaaactggatatccttcacccctaactatgtaaatcggacaaataaccccctagctcaatccgcggcggttttggtcctccatggcagtccattcaacaattcttttaataaaaaaatctatgggccccacatatcagttccccactcctctctatctctatactctatccccaatctctccttctcaaccatctccctcccctcaccagctcaccagcacggcagcatcgagaatggctgcgggtaggcgagggtgggggcaagcagagcttgctcgggcactggtggcgctggctatggcagcagaggcggaggtcccccgggtagctgtagcgcccgttccgtcgtggcgcctaacgggaaaaattatctcttaaaaaccctanatgcgaaatttggttctttgcttggtggctagcgccn

SEQ ID NO: 10209 - DNA, 9303 bp, Oryza sativa
catgtcatgatagaatcttgatcttcgctgctctgcagcgtcgactctagaggatccccgccgtggttcgctccgccgctcgccgctgtcgcccgccgtccattcgcggccgggtcgtcgtctacctcccgccagcccacgtggcagccacgtaggcgccacgtcggcgccagcccagccgaggtcgggacgggccgaccccggtcagtccctccccgtgcgcgcgttccaccgcgagccgtgaggctgcgcgtgggcccgccgcacccacgttcaccacgaaccacgcgcgtgcaccgcgtccctcccccgcccgcgcgcatgagccgcgtactccctccgcacggtgagccgagccgctgacaagcgggtcccacccgggaccgcgcatggtgagcccggtccaccggactctctctctcctccctccgggcgcgcgcgtcttgggccgctctgggccgcctccttgggccggccgacccgttaagttcggccgagccgccctttctctcgggccgcgccctagccgcccgagggaagtctattttccccccccccctctttccttttcttttcttttctaaaaggatttaattaaatccttttcctttaggtcaaaaattcaataatcttagaaattcaatatcttcccaaaccgtaaatccgtttgactccgttcaacttctaaaattccccaaatctcgagatctatctaatggcacgcttagaggtcattaatagggctttattttcgccgtttgttgagttgtcccgtttcgcgtgtagtttcggaacccgaagacccgcagtgcgaggatttcgaggatcaagctccagatctcgagcaaggcaagccacctttgaacatcttgagcctatatttgaaatttaattatattgcttgcaaaatattatgcattgataggatcacacttaatccgtttgtcccgtctgcaaggcagattggcggacctacctaattcgtcgcatttgatccttcctttgttaattgttatatcttgtccccttgtaaccatctagttgcgcctcgatattcgtgcaccctgtgcgagtatcgacggacgccttcaaacttaaaatctatttaacaacttgggtaaaacttgggttttacaaaaggtttggaaaacccgacacctgggtcggtgcttgcgaactaaatgaatttccaaaaccgcggaccgggaaatgtaccgggtgtatggtttcccgctctcgcacttaaggaccgattccttggaatttcatccaaacataagacaagtacgaccacatgggtggaatgagacactcctggctgagtaactagcttatcaggggagccttgatgccgagagacatgtggattcgccggggtggtgtcggggaggacccctgggcttcctggcacagtatggtctgggacctaacctgttgttggtctgggacccctcttgtcggcatatggtaaacctgtgttggctttggaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgagaataatgggttcgatgtttgaaaaatcagcagctgacgggatcagctaggcccgggtggccgtttgaagaagttgttggcccgggtggccgtttgaaaagttgttggcccgggtggccgtttgaaaatctgttgactgggtgccaaccttgtttcaattttaaagactgatacattgcacatactccgaccggacgagacgcactgtctcatccgtgtcgtttgagaagcactcacctagtgttttagaaaagagttcaaataaaatcaattgcaaaaacaaacagcccttctttgaagcctgcattaaacacttatttcccctggcttgctgagtactcccgtactcacccttgctctatataaataattccccccccagttgctgaagaagatgaagcggatcctgctgatgaggagttctttcaggagcaagccggctacgacgagttttagggtttcgacctagttcccaagtcgcgcctatgatgattggtccaagtcctggcttccgctttcctactgtaatgcagttgtgagctcgggatctgtccgcagcccaacatgactgtacttctactccataataaagagacctctgttgctgtgatattctgtctccctgtgataccagcactgtttcctgggactggtatcgattaacaggttaatttggggcgtcacgggctagttccggtcgggactggttcggggcgtgacagtagccgacagaggaggaggtagctcgagcggccgatgggggaggcgtggctcgttcgggcggcagacagtggcgtgcggggtcgggcggtgggtgggggtacgagacaatgagggggatccagtcagtgggctccgcacaaggaaggggaagagggcggttgcagcaacgccagcgtgtcggagctccgcgccaccgcagccgccacgctccacatcccatcgcccttgccaccgccgccgctgccaccggagccggctaagtgctgcccatgatgaaaccggagttgtgggcggccacaacaagcatctgcccccttgacgcatcgatggtgagacctagcgcaaccctcccagcctgaaccccagcgagaacgtccccatgaacgccgccactgcccgccactcgaagccaggcgacgacacgcagagggagaagccgaggatgaggagagacattgccatgtcgcgccacacgctcgtcgacccgccgccgccgccccaccacccgccccagtgtgctgccgggcgcgccgaccgcccgccgccactcgacgtacccgacggctagagaagagagagtggaagaggggaagaggaggttatagtgtatatggtaggtgggccccaccaataaaaaaggaaaatacatactggattgacatgtgtacgccacgtagaataaaaccgttctggattgggtcgagagggataaaaaaggggtgcaaatattgttttatgggccatcgccgatggttaccaaataatcactagacgggttcgtgcagcgtaacgctgcacggttagaaatatgaattggtgattatactattttatttttttatcatattgatttatcacatatgtaatacatgttattactttatagtctgagacgtgtgaccgtaccgtaatttttatcttcaattcttcaattatggatgtgtatctctttaaattttcagtcgtaatttaaaactaatcgacgcaactatcaacatatacaggaagaaattagtcggtaattcaaccaccatttcaacatgaggttgtacgcgtgtaagaatacatagctctgagacttgggctataccgctatagcatgcattttatagacacgtaatcactagtggaacaatagccccggttcaaataggaaccgggattaaagattctttttagtcccagttaaaaaacccaagggaactttttgatctttataaccaggactaaagatcatttttagtcccagtttaaaaagtcatccggccccactatctttagtccggtttaaagatatatatttagtcccggttgtttataccaactaggaccacatttgaaaaaaaatatagccgcacaccttcactctcgagacactatcttctcgtccaccgcgcacgtcttatcccttcgccagactcatctcccctctcctctcgatttcttctcctcttcacggccttctctcttggtggcaggtggtggcggccggtggtgcatggcagcacgccatgaaggccgtggagggtggcggcaggtggagtggaggatagcggcaggtggcgggtgggcggacgggcgaaggggtgggcgactacggctcggaggggtcggcggcggatctgtgttgtgttgattttttgttgtgtaaatgcatggtgttgtttatgattattttttgtgaatttgtggacgattaattttattgttgagtatgtgaatttgtgatatcaaagatctgtgaatgtttatttgatttgtgaatttagcgttgatctgtgaatgtgaatgtttatttgatttgtgattttgacgcgaaattaatatgcaaacaaaaaacaaatgaaaaaaaaagaaaacaaattggtgatgactctactgtatttatagtaccggttaaagttacaccccggttatttcacccggactaaagatagctataaatagtttcggattcgtagtcccggttaaataaccgggacactacaggccgtgaaccggggttaaaaaccctttctccagcagtgaacagaaaaactggaaaaggaaaacagaacaaatatgcatgcgtacgtaccgattctcttaggaatcctaaggaaatgatttaacttatataatacctggtatattgaatctatatatacaacagtacgatggcaaggggttaaccataggattcagatttcagaattaacattccaataactgagacactcataactagtcatctctgctgcaaccactatctttttctatagttgagccgtcttattttatgatgggagaaaagtttactcctccggttacgacacgattttaaaatatatctttttgactatattatttttctactataatatatgcaagaatatatatatatatatatatatatatatatatatatatatatatactccctcagtcctaaaatataacaacttttagcctcgagatttatccaaaatataaccacttctccaccaacattttcttcccaaccaatcagaacttttcatcattcaattttcccacctaccaccattagtgcttaaccaatcataaccctcaaccattcacttctacctactttcttaataaccgtgtccacctctaaaaatacttatattctggagtagtactttataagataaatagctagtgcatttaaattaaatatttttaggttattgatagttaaaattataaaaatttaacctcattcaaaagtcaaaacttttgaacaggagtgagtacatgttttttaataatggtttacagggtttcactacaagagacggttacaggatgaaaagttacatcttccaaacgaaaagctattctgtaaagtcgttttggagcgctaatctacttttattgtagtcttctacgattaaataggtgacatgatattctctagctactcctaccaagttgcagcttttgcatgctgttgaagagataaaaaaagattttgtgtaagcaacaatgtgctaacaaataattgactttttggcataaagggatagaagaggaaagcacaaataatattctaccttgtctgtactgttgtaaattttgggaaaatcacggtgaaaagaatgcaaaaagagaaaaagaaaataaactatgatgagcttttggggaaactggtgtgttttcaaatttaatcaaagggaatcaaaccaatataaccgcatttggcaaagatactttaaaaatgttatccaagattttaccacctaaaagcaagaatgcatagcatgctaaaccaatatggttgttatctctacaaagatagaaagatcatagaaagtttcattcgcgctcgcgccaccacatattaagctcgggttctacgccgatgcgctagggccacagtttcacccacaacaggacccaccagccacagccggtctggcatcatggaggccaacgcttcggtggacattgacgatcaacatgtctgcctgaagatctccaaccaggagtccaccacgagcatgtttcgctcgcacaagcagaggcacctcgtccggctcaccgacgcccagctagccctgcgccaagatgcatccacgtacatctcgcactcgcgttgttctagctgaactaagtagtgacgatgccaggctcagagaactatggcgacgggagaagtagcggcgacgcaggaaagagcacggccagctaaataactacaaactaaagaaagacaggaagtttgatttgaagcatggatgagaaaagaacgagatgctggcttaaatagggaaagaaagaggtattaaagcgagaaaaaagtactaattaagaagcaggaaacagaaaatgtaccacggtatggcacaagcgcagcggcattcagtgagccaagtagggggaaaagctagcctacgagaaaacatgtggccatgcatggtagcacgcataatacgcatgcaggcacgaggcaagcacaaacagctagctgtgcgtttgcttactacagcagctaatttttccaggaagcggcatgcattggtggaaccggttgagcaaaaaaaaaaaaaaacgagagatcaccggcacgtatacgcggggagcatcgaccatcgcgcagacaccggatacgccacctgaataaatatccaaccggttacccgacaagaaggaaattagaaagaaaatccatataacacgcggcaagcaacggagtgaatagaaaaaaattcaaaaaatcagaaaaatgggaacctgatcggagactactaggtaagtatgagttccgtaatcaaacgcaaccatttgatggtacagtggaacataggaccgcccctcaagcgcccagcagtagttcaaaccttactaagttggaaggcagaaatttcacaatgagaaaaatcaaatgatcagccaatcaaaggtactgacaaaaagaagaaaactaaaagaaagaggggaaatgatggtgagagttcacaaacaagtagttctggaggaaatagtcccacggatcctatggactggtggaagaagaaaagcattttcttcaaattgcaatattgggagcacttgtctttgcgccataatcttgatgtaatgcatatagaaaaaaatgtgtgtgataaccttgtttgtactctgttaaatgatgccaagtcaaaggataatctcgaagcacgtcttgacttggtagacctaggcatacatcaagaacttcatccaaaactggaagaagatagtcgttatatagtaccactggcttgcttcacaatgtctagagagaataaggaaactttatgttcagttattcagagcatcaagttgccttatggctatgcatcaaacatagcaaggtctgttgatatgaaaagctgcaaattcattggtctgaaaagtcatgattgccatattttaatagagcaccttctaccgattgcactgtgaaattgctatcctaacaaagatatcatgtcaattgttgaggagctatccaatttcttcaaatcattgtgctctaaggtgctagacatatctgaacttgccagccttaaagaacaagttctgatgacactgtaaaatggagaagttatttattccttcctttttcactatcatggttcatttaattgtgcacctggttgatgaagctaaattaggaggtcctgtacactatagatggatgtacccttttgagaggtaattaaatatgctcattctatttgttccattaaaatttacatattctatagtaattgatttgatcatgatatcaaacttcagatattttgttcggttgaagagctatgtgcgtaatcgtgcacatcccgaagggtctatagcagagcggaagaatgtttaacattctgtgcaagatttctcaaaggggttgataaatctagtctttccatgcccacaaattctgaacaaaaaagtatttgtttgatagttttggggaaacaataggctctgctcaagatgtgaagtttgatgcaaaaacacttactcaggcccatcgttatgtcttacgacatcttgatgaaatagaggattttcgtaggtatagtacctaactgaacattacctttaaaaaataaaatttataaaataatataaatatgctatttgtagagaatttctagaggaggagaagagaaaacaaaagaagtcagttttcacttcttttgaatctgacaagttgattaatgagcgattccatgattggctataccacaaggttagtataagttaggcaaaacaagtcagatcatgcatgtacttatgttttgtaaaattaatatgcctaatgtttaaaacccatgtttttattggttatgcttaatgcttgtggtcctgatccacgcatcacggaaaatatcataaaaatagctgaaaaaccgagtaactatggaaggagatttggtagattcttaattaatgggtttaaattccatactatttctcgtgagaataatctgcaaacttaaaacagtggtgttgttaatatatctgaaggtgatgccatcagctattatggccgtattacagacattatagagctgaactataatggagcatttaaggtcttcttatttaagtgtgattggtatgatgtgcaccatcgcgtgggtacgagggaagatgagtttggttttactcttttgaatttttcgtggggtatacacattggaaataagctgatggacgatccatttgttttctcttcacaagttgaacaagtattctatgtccaagatttgtttgacatgggaaaggttggagatgaagatgatgagatatgagttgtacatgatatattttgttgcatttatttgctgaaggcattagagttttagttatttacattcaaatatatttttaatgtatttgtttgttcaattgcttggtaatttctataagacacttccatttagtaactggagatatggagatgtgtgatctagagctatgtgtggtctcattttgtcattttaactggtatgcaatggttgtcttgttacttatatctttaaaattctaatccatttttaaatatagtgtgaatggctgcgaggtcccagacactacagggcttggatcttttgcagaatggagtgcaaaatcaagaaatagatataccaaggaatgatcagtatgttgaagaacagaacatatcaaatgagaattggtgcacaaactgccatgagtatcgtaagatatattgtttatttttctgcaaaattgtttcttatatactaacttttaaaactttgtagatcctgatggacgtattaaaagacgtcggggaccaacaaaattggcaaatgtttaaaatctttcaactggagttaagattattggcaaactggacccgtttaatgcaccttggtgacaattttt

SEQ ID NO: 10210 - DNA, 53330 bp, Oryza sativa
  unsure (1)..(53330): unsure at all n locations
agaccgtttcaatgcaccttgctgacatcttctgcagttcttggatcctatttaggaacattagtcaggaagccacatctagctccactgaatattctaaaatggaatgacaaattttttataagaatatatcatcaaaaaatgattactgaagttaaggtatttatgtttagtttaccatgtttttaaaatcatactgttatggtgatcccagtataattccattggctcttttttttatgcactagagaaagtttgcaattgatgggagagctaagagttggcttctccatcagttagatggtaaatggaggcaatacaagggaaaactgaaaggaaaatattacaagcctaacttacctatggaacgagtattgcaaacggtgcccaacactgttgatgaatctcgatggcctacactagtttcctactggtactcaaaggactctaaggtaaatatatgttgggactttttagtgagtggctgtcattttgaattatctcagctcatttaaatgatgatatatattgtattgttagaaaatcagtgacagaaaccaagagaatgcactcaagcatccacacactttaggaagaaagagttttacaagaaagagaaaagaactggtaagtcatttagcacttttatttgttaattcattcttctatttcctcatgcgtttgagatttataactataggaagttaatggggtggaggtggaccgagaaaccttctttgatgaatgccataagacaaaagatggtagatatgttactgatgctactcaagaaaaaatggtactaacatatctttttttaactgtttgtacaacaaaatacactatgctaagagtatgatttttccaatgtagaatgaggtatacatgaaattggctgagaaaagagtagatagtcaacaactcactgaagctgattttgaacaagctatgttagatatgtttggaaaggatcatagtggtagagttagaggcatgggtccaaccattactcctacaaactattatggtggaaggtttctgaatatatcagcaatcaatgaacaaggaaccagctccagtaatgtcaatgctttcataagttagttttatggtctcatatatggcagagaaatatcccgaggacaatttgttggctaggctgccaccatcccttactaggctcatcccaacaagtgaggtatgggcccaagattactagttttaaatgtagcaacttatatgggcatatgcataagcttggaaaataatgcattcatggattcattttcaggttaatcaaaaccaagaagttcaggcaccaaatactgcgccatctcccagtcagagagcatcttctcagccttcaactgaagaagagtgaagttatagatttacagtggcaactatatcattccatactacttgctgcattaggattttttttagttatcttgtttaacaagctactgtttcactgttatcggaaataatgtttaagcattttcattgggaacaatgtatggatattacttgtttgtttcaatacgaagtactggtgctaaaaatcttgttgtgatctaatggtaatttaatctggtgatattgttttatgaattttatgaataaagttgtattaattattctcgtgtaaccaacactgctaaggacggtattaaagtagagatggttttccatgtgtctagaaatttgatttgaatttcgagttatctatgtagcgacggttccgaccgtctctaactatacgtatggcttttcaaaccgtctctaatcatttgacacaggagcaatggcaatgcctctaacacggttgctaaaaccatctctaccacaattagagatgggtatagccgtctctacagtgtataaaaacccgtctctagagactgtttgtgctgtaatggtttaggaaccttgatgacagtacaaatttagggaccgcctgtacaattcaatctttaaagtttatgggggctatatgaactctttcagtttgcattattgctattgcctatatatatttcttttttagatgattggcaattgatctaaccgctatgtacatcctcttgcgccacaaatagtatgcgatatgtatagcgtataacacaatgaatccctccaaaatctcaaggtcgtcgttcacaatggctcatacataccatgatgttttggactaggaggcatcaagaataggttatgccctttgcaattaatcggctgctacaggtatcccaatagtacatattccacggcgcaagcagtttaactgatttgacaattgttgtggcagtctgccaacaaattgctatctattgatatgccatgtcacgtcattatgcaaacatctaaaaattctcaccattggaatggcgttatgagcaatgatcgtcgtactccttcgctgtcctgtcactttatttcagatacttgtaaccgtataatctaacgcagagaaggacgacggtcgcccaggtgaagaccagcgtcccaagggcgttgcctaacctctcggtcatcacaaccaagtgaacaaagcgattcagctgcttctctggcacgaccatcttgttgccgccgccttcgaattcgccctgtacgtcgtcgtctaccactcgaatccgggcgctctgctgctcgccatgtctacggctatagtcacatgtcttccatgcttctgctaattggcagtagaaatcgtcgacaatctattatgtatatgatgcgtaactaattcaaattttccctttaatatgtgaccccgttgactttttatccaacgtttgatcattcgtcttattcaaaaaatttatataattatcatttattttattgtgatttgattcatcatcaaatgttctttaagtatgatataaatattttttatatttgcacaaaatttttgaataaaatgaatggttaaacgttggtcgaaaagtcaacagcgtcatatattaaaatacggagggggtactattcatgttctttctcgagatacaaaagtattggacaataatactgtagtgacagcagttagacctgcgtggttaacatgtcttggagactagctttgtaaaacacaaattacatgtatgtgcaaggaaaacctgtgccattttttcctgactcatgtagtaggacatgaagcctcatgctcttacgtgcaattgagctaaaccataaatggggatttaaatagtgctgagtcatagagaaacatatactcaatttgaaagtgctgatgaatatggctggaaccacacaaaagcttaagtgcctatagcagtttgcttgctactagcgccgttctctacgatccttaaaatatcatacactttgtgcacaatcctatatttccaaaacttgtgtagaattaggacccatcaggattggggtggctccagatatccattccactcgaacggtcacacagggatcgctggaaaaaatggcacgatgttgagaacacctaattatgttggtatggtaggaaaatgatgttcgaagaagatgatgaaacagaagatgactgaccatagcgaaacacatcaatcgatcggcactcatcatctggaagacgcggcgcggtgacaaccagaatcgtagcattgatcatgctcagaccattaaacgattatacaccgtggggtcaccatacagctatgcaagagatgatcaattggatttaaaccatgaaatttcatatggcagtagaacaatgattttgaaggagcaaactatataagattactccacgatcgagtacaaaaccgtggtgagagcgttgaagagcaaagcaagctacttttgtgaagagattaattaatgttgagaagagttaattgcattttcatatactactattttagtcgctcaatcgctgaagacgttgtgccattgagacattatcacatcgttccacatgttgtcgtttggtaatttgatcagtacaactttaccaattgtgtataaaagaatggcattccaatttttgaacccactattttttttatgtaatcatggcacacgaatgtaaaatggcctacatttatacttcctccgtttaacaatataagtcattctaacatttcccacattcatattggtgctaatgaatctagatagatatgtatgtctagattcattagcaccaatataaatgtggaaaatgctagaatgactttcattgtgaaacggagggaataactagtatatatgtaataattaagatacgtgaccatatataaactacgtaaacaaacagccaacttcacaaatagctcgagggccttctacacataagcacttcactcttgtcacacaaaacatgcaacgctaggagcatcctcatatacatccatctttatttccttaagacaatttgcaacttactagcttaggattgggaagtctctagaattttcatatatatacctgcacagaatatgccacagagctgcaatttcatcatgagaagcaaatcatcaatgtcactatccaagagtggttgaccatcaattactcccacagatggaggaaagtgagtagtatcttgtggttttggagcaaacaatacaaactggccattggtcagtttttcatcaaaatgaatgttcatcatcaaaatggatagcctgaaacgagtgcagtccttaagagctggtttggtttgagacctaaattaggcttaccaatatttggcaattttaatagtgtttagtgtctatttggtttgaagccaaatttcggcatgcctaagaaaataggccatttcaatagtgaacttaggctattttgacttcaatccaaacacaactttgccttatcaaaattagttaatgccaaaacttaccaaaatttagcactgacaaaatttggtaaagtctatttaggctacaaattaaaccaaaccaatcctaagttacagtcaccactgtggctagctgcatgtttggagagaaaaaaattaaattttttttcctctccaaacaaaatggcacgcccagtgggacatggttctcctcctatctttgctgcgcacaaatggtcgtcgagttcttcttcgctttcttctccgacaaacatgatggttgatgaagacctttggttagagctatttgtttttcttcttatggaacggctcccatcaagaaaggggaatccagtgaagacaacctggttgcacttgtttgtgattttgaatgcagctcatggaagtgctcaagttatcaacaagctcaattgggggcaatcgaggaatttcttacaaatatttcttcttttgggaagtgagagtttctagcccaatggagctaacaaccacggtgtggacactagcattttctagctgcaaagctggtcatggtgattgctggtgatgttaatttggagtcatcaatttgggctcatgtcagtagcgaatatactgccatagtgctacagtttcatttcaccggttctcctcccatctttgatgcacagaaatgaccgttgagttgtccttcgtgttctttctccgacacacatgatggttgatgaaatgctctggttaagagctactttcttctgtaatgataacaacccggtggcacttgcgatttcgaaagcagcctcataggttgtgaagtgctcaagaaatcgagaattcaagatgctcaaccggggcaagcgaattcgtacttaaatttgtgccggggagcatgtcaaaattctctgaacttactaccatgacatgaacaccggagtatttagttggacaactggccatgcatatatcgataaagccatgcatgcagctggctgtgaaccatctcatctccactgtaaaagggaggccatctcactatacagagagggcagaggtagaacacagtggcaagagaactgatccatctactcatccatagctggtgcgcttgcacatcaccggcgcccggccctgcagggaggtagaggccaaaggaggagaaagccatctgcggcgcacgcgcacacgccggtggctagtagaccatcaactttggcattcatatacaaccaacacatccatccatccatctattcctatccagccgcaccaacaatacacaccgaccgacggcggagcaacaacatgtacacagccggagcacatcggccatggcgagcgacctcggccgaagcaccgcgtccggcaggaggatgagcgccctgaccatcagcaagcacgaaagtgagatcaatggctgcacagggtaaagctaattaagattgtttcctcctccttttatccatggcacacgtacatgcataggccgatctatatacacacaccgttgttgccggaggagtcgccgtggacgattcatctacacgccacagaatgtcgtcatgccgcccatccgagtcgacgagatgctactcgtccttggagtcgacatcgcccgttcaagtccttggcgacgtcatcgagaggccagacgtcctcgctatggtgaggcgaacttgccacgttggagttgtcgtcgtgctgctcgtcaggggaacctgcccttcgtcacatcggagtttttttttttctccccatcatgtcaagagcgaagctatctgtccatgatgcacgctctctccattgtcgctaccctgctgtactacgtcgagggtcgttggagccgatgtggacgtcaccgagctgcttgcatccacaatacatgagaccttattgccattgtcgagcggatgaggcactgtcgaccgatcatcatccgtaggaggaggatgtcgttacgccgccctaccggagcagctgcagatgtcgccaagccatctccctcctcgtagctatgttgtccacagcaccgtggtcaccgagtccgccgctaacaagcgggcctcgatcttcttgtcgtggctagcccacggacatcacaatgtcgcttgcaacaagcctctaggatgcatatatagcatcggcagtgttcaactcgacatgtctgagtccactgctacatcatcaaggccaacttgcttctttcatctccactgaacagagaccctcaatggtcatgccaccgctgacatccatgttcgccatagaatcaatggtgacttcgtcacactcgccaaccccacggtgtgcaatcctcacactcctgttgttgcaggtttattagctactgctagcatcaacctcatactcgagatagtgcctcactttgatcacttagcatgccactgcccacacatgtgctgctgccaacagctcacggaagccgttggtgatgctcacaaattaatcaccaccaaaatcgtcctgacagccagcatcatttatatatgcaccaaggcatcgacatcttggctgctgcctgtgatatactcaagcgtctcaccgctgtcagcgccgtcaccacacttgagccattgctggtattcacatgaccgcctcaactgaagagttcaaacctgtcatagtatccggccttgacctccatgatatcctcgtggtcgccaactctgccgacgccatcaccggcgtctccacgactgcctccgatttcgacctcaagattgtcatcgctgccggtacagtcgctgtgctgctggcaatgtttccatgctcgtgaactcaactagagcgcacgtgttgcagctggtgtctgcaagatttccaccggtggttcctatcgctattctacgaggcgtatttactttgctatgtgttggcaaggcaaaggcaatccataaggcagaagagtatatttattttgtagcagtgaggtcaaattccttgtgctaaacatcagcaaagcaaagtcatgctgctcttctaacccgagatgacgtcgttcatgtgagttggatggtttgcaaactatgtattgccaaccaatgcaagttaccaaagtcatatggaagctaaatgctcatgcctgtgtattttccatcaaaggtataataaaagtgacacatcaatactccaccaatgtcaggaaggctttctcccatacaactctcagtttgtctgagctacatgtgaatggctccatcccattctctatatatgtacaaatataagagcaatgcaggactccatcaaacaatccagggttctgaaccaagacgattgactcacattttcttttaaaaaatgattaatcaaatgatctgtcattgtttccatgctttctgctcaattcatcatatgagttgctgaaagcatatactagaacggttttgatcgtgaggtgcaaaaatttgactgctttgggcctcaaaaaaaactgtcgacagcccaatagctagttccatactagaaaggttgccatttggttgtactatctaagagaaactgttgatgccgtgctatgcgtatacacttgcaactatcactctagcagtgccatcattgagacacatctattgattttgtgtctcttctaacgaagcctgattcccatacgttcataccactgttcaaaccatatacacggagaccatgacactatgtaatggcaatgaaacacataacaacctcattctcaagcatttcaagattattcaagctatcatatactcgctgctgggtggccacagtttttttcagtacctagcttgtgctaaagccaagctctctctcattcaccacccaaggcattgaacatatctactcaagaatatcgcccaatccccatgaaaatgcagaattgtagaccaatgctcattttttttgtccaatatattctcctcagacaatggcggaagcgctatgcaattatagccttcattttctaaaaaaggttcttttacaacattccattcagttcccatatgaaacaggggcaactggctttctctatatcatgccatgctcacgactgaagatttggttgccctaggacttgtccaaaactaatcaagaaaaagaatcaatctactttcatcacacaacacacatgtcaagcagtggctaccgggggcaatggaaataattgctcggataactaccgattagcgagtttaacatgtccctcgttttctcaatgcgtctcagaccggtggagacacaaaaccccaggggaagactatagagataaagagcatgaaagggctacctgtcccaacataagttgtagtgcagtgtgcagccacttgccaaccctgcgaggtgataataagggaccaaaaaaaaaagcctgtgaggggttctttagtcacaaaattgaatggctactctctgatttcccaaggggatggttctccgacatgtcatatgaagaagtacaattattgaaagaaattttacaatcaagctatgaccatcaaacaatattttagatgggatcattcaatcttcaagcaagaagtatcaaggatatcaaaaaaaaaagagggaagaagaagataagaagctcttgatgtttaagtctccagaatatcaaagtagcgaatcaagcatatcacacatttgatccgaagaaggagagtagccatgtaacacccttcagcaaaagtaatggcattattccatagccgatgtcctaaaaaaaccattcctaatcttagcccaccctagtctctaggttcgatgagacaagcattgggaggtctattgtcaactggtagccttgccaaaacatgttttcctacacatacaatcacaaaacattttgtgttgctatattcgtcatggtttttcgacgatattcaatgactaagtcctttggcagcctatctgatgtcactctatagctggcagccaatggaaaagctaacactagcttcaaaaaacatttcgtctagtaaaagttttttttttgttttgttaagctaatatgtttctcgactacaatctccaatataaggagtgatacgacacctatctttgatgatggcctttacctttaattgaagcaatggttaattctgctttgattgtatggtgtccggattgaccctgttacttcgaaacaaaatttcatcgttccattattggagtcaactaaataccatgttaaatccccattgattccaagtgatgtttaattccgcttgattctcatcgatgattcattccgcttgattcccagtgatggtttattccacttggattacctagcatctgttttgtggagctattccttttattacctacatggtcaattcaaattgatgcctagcaatggttcattctgatagtactatatgcatctaccttatgccacactatcattttgtataagtgatggtctattccgctttaaatcatccatgatggtaatttatttatacctatagtgatggtggttctgctatcgataaatgagagcagtgtagcacgccagcgcggctagtgtgaatctgtgaaacccttcgatcaagttggctggcaccgtggagtttaaatggtcccgacttgattgataagacccttcaagaaatggcatgttctttcgccatggattgggaaaggcatggatttacgcctcacacatgttttctttagtagtggcatgaattttcgccacacaattctttagaccatcattaatctgatgtcaggttcaaagaatgaatcccattttcggcatggatttgcgccacaatattcttgagacagttcatcatcattggtcttgagaaatatatatatgtttacagggggcatgtagtgttgcctcaccattctttacactggtattaatctacagccaggccggtttaaagaataaatcatcattttggcatggactttcgcctcaaatattcttaaaaccattcgcgaagggttttaagaatataattgtttatcgaaggcacgtattttcgcctcacaattcttcagactaacatgtgccatccgtctagttggaagaatgaatttgcggcatggaccttggcctgtcattgtcttaacaaatagtataattttttttctggggcatacacttttgccgcgcaattctgcatgctggtatcgatcccttgaagaataaatttttggcatggatttccttcttaaatattcttgagaccatttgtacctggtcttagaaattatattttatcgatggcactaatttaagcctcaaatattcttaattccttatacccctggcattaatatgtgtctcgggcctgaaaatcgatttcttattccttgggcatgaactttagtctcacttgttcttaaaagaactttagactccggtatcaatatgtctcctagatgactattgatttctggtaaatagtgatggatatgccgctatgaatattttgggagcagtgaaacacgccagtacggctagtgtgaatctgtgaaacccttcaactcattcagctgacatcgtggaattttgacgatcgtgtgggttgataaaattctctcaggacacggcacttttttttcccgctgtggccaggacatattatggcatggatttttgcctcatgtatttactctggaccccatctagaatatacaggtctgaggagtattttgttaataatggcatggttgttcgcctaattcatttactttggaccttatcactaatacacaggtccgagggatgtttgttaacaatggcatggccgttcgcctaactaacttactttagaccttatcatcaatatacaggtctgaagaattttttttttcgacaatggcatggattttcgccttatagtatgttaattcatgagtcgctggcatggatttattttgcctcagtacatcctggtggactatataccatagtgaaaaaaaatcacatagccctttattgcaaaatttggtggcataatctacagctaccgtgagatatgctagaagggattaaatgtattttaagcagtatggcggcagctacatgcgcttcttcaacatagaaaaaaccaccaagttcgtcttggttgtttattcggtgcttgaactctgcttgcagttatgaaattaaaaaaaaaatgctgtggtacttaatttattgttcctcaggaaatggaaaattttcaccaagttaattccgagccgctccatgctcgaatttaacttggtgagggggcattttgttcgatgatattttgtacaccttttttttattttataagaaatagggtgcgtcaaaatattaatttcggaaataacagtataataataaaattagtgattaattatcactaatggtacaatctgacatacacgagcatatatgcatgaatgttctgtgacacgtgccaatatctgctctagtgcctagagtacagacgtgtatatgctcatggtattgcttcaggtgataatatgaattttctttttattaatctgaatggaagcatgccactgtagcatcgtcattagaggatgctaatcacgtgatttgccggcagtggattgcttgcatggaaaaccatgtacgtgcttgcatagaaactcaagaaatataaaggcaatgtagctctgtctagagaatcccttgccatatgcagtgtgcacgcatatacgaatacaaggaagccggtataatttggatggaatcatattgagtatgatcctggctaattggaagaaatcataacatatggaaggaattgcaaaatcgtagaatcaactgattggcttgccatccatatgtgagccatgcatgcactgggcagagaactgcatccccttcacgctataaaagaaccagccatttcacggagcagagggagagacgggggcgacggaggcagcggagagaggtcgaggaccgaggcaggagccgagagcctgcgcgttcacgctgcggcagccgccgccgtcaggcgctgcaccatgtctagccttggcagtagtcagtagagcccaacatatacaggggaggaagagaacacacagaaacggaggaacacacacagacagaacacacaccattttggctggagaatctcggcgtccagcgagaacacgggcgctcggcggtcggtgacgttggccgcagtgcctcggcgtccggcgaggaggcgcgcggaggagaagacggtcgccggagcacgtacccagccattgccattgtacagcttattagttttcttttgttttcctgctctttctgttcagatcgtcatgcatgcacaacacggcgaggaggcgagtttctgatgctgctcggcccgccggatatagcgtcctctccgcctgtcggacgcaccgccggccggagatcgcgtcactccctctcatcggagacgtcggtcgccggtgacacatctacctgctgccacgacgtccttgcctcgccggccgcaacctctatcccacgacgccttgtgatgtcgccgagacgctggacgttgtcaccttcccggtcgcagcctcctcttcgcgacatcactgacgttcgctcgctctcgtcgacgttaccatcttcttcgaactcatcggctggttgctcgaggagaacgccggccggagtgccactactcggtgcccgcaaggcgtcaccagctccagctacgtcgtaagccatctcgtcggagttgccggggacatcgccgagccgcctgagtccgtagatgacgcaacgctgccaagcgatgctcgtcatcatccgctgctcgccggagaaggttttttttttgtcattttgcctcactggagcacgccaaagggagtcgaggcagccgccagggcgctacgctgcggagccgtcccatgtcgcggatgctgactgacttgtgcatgttattgtatacggtgacgagccaacaaaacaagacatgcatgcatgctactgtacatagtgacaagcaaaaatgagtttgcagattcatactcatttggggctgctgcgtattaaacttcccagccatgaccaattcggctatcattcacgttgatcattttacttttataatctaattctgatgtaattcctacgtcgtcgggtcatccgggctacactattccatgcatgtcttcaataacaatataaaccaacatgccgtccaagaccgatgaggctaaaacggcaaggtgaaccgagtcgacatcaagacgacgtcaccaacaccgcgtgtggaccgatgaggccgcgaacaccgccagcgcccactcacacacatctgcaccaccatcaccatcatgcatgggagaacgtgaagcgaagacagacgacgacaactagcgtagcttaatcggaggtatctcacgggtttaacccgcgagagtaattaaccgagtgtctttcgagaccccgggaaccaggagatcacaatcgccaagtcagatccaccttgcttatgggccatggagcgtatttgaccaaggattctgtatttttgtaattcttcgagaattataataaaatgcatttttccttcgtccactttatttttttttacttagtacactggcacgcctacatatttttattttatttccctgtgcggagggataaaaatttaatttttttttctctccaaacaaaatggcatgcccagtgggttctgggcgtgccattttgtaatttttttctctccaaacactgcacttgatctgaatttgaaactccgctcctcggtaatatatttcatacaataggggcatattcatacatactagtatatccatccttgaaatctggaatcctaacatagctccacacaaaatgttaatagccagctatgaacatatgcagtaaaacttggggtagcagctaggaatgccattgagatagaggtgaaaagttcaaagagatgtgacaactggatgagccttccctcgtgcagtaggctctctatataagttctaataaaagtacagagaaaaaggttacataaattgcgagtaaaccaataaaataaagtatgatgatatggataaagtagaagtacactggccacctatcttacacctctattacagttctctaagccatcacataattattgtttaactcttgttcgggcattgtgccatctgcagagtggatatgcccaagtttctgggtttctaaattgtcaagcaagatattttcatacaactgtagataaattaagctgtgagtaccagttgtacatttgttaacattcaatatcagctatatttctccttcgagtgtcatatattatcattcgaaacggagaattatgaaaatcgaaaataatggcaaagttaatcactaaaagtttgtacaggcaagtaatttgaaaatgatggcaatagaaaatggtggccccagaactcgtcgtccggcaaaaaaaaattaacttgtggagctatcatgctctcggttggtctcagtaggacaaggtgactttactttctatggcaatttacttttttttttacagtgatccatgacacttttgttgagatgttacttggctctttggcatcttttaagctattggactaggagtgtgtaccggccgataattcacacaaaggttacaagatgcttccacaatgaaaaataataataactgcgtgtctatattgctagctgaaaattgctgcaaagacaatgcgagaaaacattagcatttttatgtgttacgcacattacttcagtagtcacaacaattatactttggaggcactcggagtacttaaaaaggaactgaaggatggataaatagtcagtcatatttgctgttgggcgtgttagagtatatagctgctgctgccaaatggcaatcgtgagcaaggccatccccagttgtagcctgggaatgacactgatcttaccagtctctgagaatctgacaacccagtctaagagtggaaggtgttccgaatttcaccatgtttttacccttacgatctgtgttttgttcttttgctggccttgctatccatgtaccatgtagaagactgatttgtcttggatgtttgatgtcacgcccagaaattcacgaaccagaatttctaagctgaatgtgcattaaatccctgtccaggaccagccagggtatacaaacaacaattgttgacatacagatccacgacttataaaaatataaaagattacaaatgcagcggaaaagataaaagcgagctaaaccgggatagcttgacttcagcagcggggcgactccactccacaggcaatccttgacggcagcgacgaaaccaacttcgacaaaacagctcccactaggaagatcttcagctctggtgtggagaaaaagagagcaagactgggtactacccattgtactcagcaagtcataccggaagaggaggtatgatgcaggatataaccaaaggaggctaaaggttcttttgcataaagctagcatttaaaagcagaagttgaaagcagtaaaacagttgtagtaattaatcaatattaaccaatcactgtccaacgctacaccacgttgcaacaggctcaaccaaccacctgaactacaccagttcattaaggttaactagggtgagactaatcacggtgaatctggttgatcgcccataactgcgggcacagctattcgaatagttttactctggccagaggtgtacaactgtacccacaagacacaattccacaaatgtcgccatgccccgaagtatcaccatgatactgcaaagggggaaatcgtgacaagaccctccgcataaccctcccctaacatccacaccacgctaaggtttcacccccacccctcaaaaggcaatgggcggtcccctcttgcgccgtggtgaatccggcagctggacaaccggacaccccggccgacccaactccatcacgcccaccctcaccaccggtgcctaggaaagggtccagctatacttcagatcaagcagttacccactcccgcttatggtaagcacggtaagtctcccagggtttcccgtgaaccggtccttaattgccatgggtgtgaccagcaaaaccatgcacccacagcccaccattcagtgtattttaattaactaacaccattgcggtggcaccaatccaaagctatgctaatagccaaaatctatgtaataatgggatccccatttgtgtacttattgaactaagcatggctaagcatttcctaaaccagcatctaatcattttgataccccagttatcaatggcatatggtaaacaatatatggctgagtaataggacccatcccacatgacattgaaaaagaatgcaacatttaatagaaatgtgggatatttgtaaatagggtacaatatgatcaaatataatgcatgacttgccttgctctcgcactgataagacctcagcaaggtcttcgagaaaccgcggatcgacgaaacggccgaaatctacgcgacaaacaaggcacacaagcaaaatatgctataagactactgaaacagggaacaaaaccatttttaatggattctttgcatttttatgaatttactgagacttgaatggacttaaacggagctcggatgaatttcttatgaattttagaagataaactgtgtttttactaacaaagaaaaagtccttaattatttattgcgcaataaatccatagggctgatgtcacccaggggggcggcaccgacggccctgcttgtcagtggcacaaggggagagggagggggcattggggtggtccaccagctggtggggcccaccgagcagcggcacaaggcaggagggggagtggatggtggtttggcacggctcaagccggctgaccatggcaggccgacgacgacggcacgcggcctccgacgatgaccggcggacgacgagacggcggcgcccggagcgaagccgacggcgcacggccggaatgacggtgtggctcggcgctcgcgggaaggggaaggaaaggagggggagggaaggggtcctcaccggcgatgcgagtgaatcgggttccggcggcggcggatggcaaccgaatggtgatcgaggtgcaggcgacactggcgagcgcgacggcgacggtttcagggcgcggcggcggctttagcggtggtggcgcgcggccagagccggtagtagccgccggcgcgtgggaagaacggtacggcggtggcgaacggaaagcgagcggcggccgaggtagctctcgcggcggcgaagctagcggcggtgattgcccggtgaggtgacggctcttgcgacgacggcgtgcggccggaggcgacggcaaacggcggcgctaacggcgagcggcgcgggctcggtaggaggcacgggagggggcagtgagagcggaaaggggaagaggaggctcgggggagcaatttataggtggagggggaagcggacgtggccgggaaagcctctgatttcgccggcgacgtggggtgtagagagagagaatgggggggattcaaattcgaatcccgccccttgcgagcgcgcgcgcgggccgggagacgcgggagagagggcggcgacgtggggaggacgcgggagcggcgcggcgtaggcgcaggaggagcggaggaggtgggcgcggcggtttcggcggtggctgccgacgtggggcggtcggctggaggaaggggacgaccccgacaggtggggcccacttgtcggcgtcccggagagagagggagtgagggaggacttcggggagggtaagggaggagcgggccggcccatcaaggggcgcgcgggaggagaaaggtgggccgatgacccaagaagaggaaaaaggaggaaaaagaaaaggaaaaagaagaaaggatttttcttgagatttaaaattgcacttgctcatttttaattggttaaaattaattttaaggctctgaaaattctattaaaaatcttgttaatgtattggagcatggggaacctaagaaaaattccacaataccatttccaattattaattgcattcattagataggaaattagctctaggttaattcaaaccatttcttcgcacaatttatttaaccatttttttaaagcaaggaaaagggggaaatttccgggcgtgacatttgaccaacatcttagctggcagattgcagtctattgcaaggtcctgcgtgttagtgtgtgactgtgtgaaaatttgtaaataagaatgcaccatatagcgaaaatgttaggagcccgggtatcaaaatttacctctttgattatattccttctttattcttgcctcgtgtatctttttgtacgtaagatatgcgaggttttacagtgtttacgagctatttagagttatcgagaggtggggcaatgtggaccattgatcaagagagaaaaaaggtatgaaagaaaaaatattgtaaccaatggcagtagagtaattaactactgaaatattggcattacgttgaatcgaaatttgctcctcgctagttgcacctgatctgaattcgaaactttgctcctcgctaataaatttcatacacatattcttacatagtagtatatccatccatggaatctgaaatcctagcatagctccatgcaagatgtcaacagcctgctatgaacatatgcagtaaaaagttggggtggctgcttggaactccattgagatagaggtgaaaagttggaggagatgtgataactggatgaactttccctcgtgcagtaggctctctgtaatttctaataaaagtacagagaaaaaggtaagataaattgtgagtaaaccaataaaataaagtatgatgatacggataaagtagaagtatactggccacctctattacagttgctttaagccgtcgcataattattgttgtttaattcttgttcacgcattgtgccatctgtcaagcaagttattttcatacaactgtggatagattaaagttgttgtgagtaccagttcactacaagaatgaagaatcagtaaattttcttagcggccaaatgatttctttgacggtcaaaaaaacagccgccaaatttaaatatattcttggtggttctaactagctgccaaacatagacatttgtcaccattcaattacagctatatttctcctttgagtgccgcatattatcattcgaaacggagagttgtggaaattgaaaatattggcaaagttaatcgctaaaagtttttacaggtcaataatttgaaagtaatggcaatagaaaatggtggccctatgactcgttttctagctaaaaaaccgccacgtggagctatcatgcttgagcaatgatctctcagttggactcagtaggacaaggtggttttactttctatgacaatttacattcttttactgtgatccatcagaccatgacacatttgtttgtaaaattaaaggtgtttttgattattattctgtgatgaacaattggcattggagattattggttttgatatttggaatttatttacgaagtggttttggagaagattggatttcacaggtgatctacaggtgctgctgttttgggaccggtcagaccggacatgggttgccgatcagaccggcgcagcccgcggtctgaccggctgacgctgtgtcggtttcggtttcgcgttgtttgtttggatatccgtgattgtttcatgattatggcttctagatggatactatacgtatgtaatactgttgtttgctactaatgagtcaagttggagatagcttggtctcggaatatggttttctttgtttatttcatgtgtaggtgacttgatgcctcgggagagtatttgcggtgatggaccgggagtcggcttgggataagacgacgtccgtggtggttagagatcatgtgggatacctaggctagagttgatgcacgtggttggtgaagattccatatggcatacgatggaggtattgtgtgcgtatgggatgcggagtcgaatttggaatgagtccaaatttggtatgagtggttatgtaaagtttgtttcttgtactagagggtttcctaaggtgtttaggacttctagtatgagtttggttcgtggctttaggctgcctacctcgggtataaatagagggggagcgtgagggttcccggtatcgctttttgagagcaattgagttgagagttgagttagggtttcgagtttagtcgaaatttttgtaaggagtgctgttggtgcactttgtaaacacagagagaatcaataaagttgtcatccactttaagagttcttcgatttgtgtttcaccgggtttcgacggtctaaccggcgacacgtcggcggtcagaccggcggcatcgcggcggtcagaccggcatcggcaacaggagctgatctcggcggttagaccggaaattcaatctcggtcagaccgacggcaaccaggcggtcagactggcgcaattacttcggtcagaccgcgatccgtcgaatttgagggtaacttttatttctgctaaaaattttcggtttttgggtataccaaccattcacccccctctggttggcttagttagttgttgtgattcgatagtacattgttgagatgttacttggctctttggcatcttcttagctattggactggtgtgtgtaccgacaattcacacaatggttacaagatgttttcacaatgagaaataataataactgatatcctgtgcaaaacccaggacagtatctgcacatccatattgctacctgaaaattgccgcaaagacaatgcgagaagtacttgaaaaggaactaaaggatgcataaatagtcggtcatatttgctgctgggattgctgagtacatagcagcagctgccaaatggtaatcgtgagcaaggccattcacagttgtaggcttgtagcctggggaatgacactgatcttaccagtctctgagaatctgacaacccggtctaagagtgggaggtgttcggaatttcaccatgtttttacccttacgatttgtgttttgttcttttgctgaccttgctatccatgtatcatgtagaagacagactgatctaaattgttttaccaccatcttaggtggcagattgcagtctattgcaaggtgctgaatgtttctgtgatggtgatgggacaaatggcatgagtgtgtgactgcgtcacagagctgaaaaattgtaaataagaatacaccatttagcgaaaatgtcaggagcctgggtatcaaaattaagcttattgatttcattgcagaaatctatatttcttctttattcgtgcctcttgtatctttgtgtcccattgttgatcgcgtacagatcattttgtaccaaatataagagaggttgcaatggaccattaatcaagagaggggtaagctatggaataaaagatattgtaacaaatggcagtagagtaattaactagctagtgaaatattcggattatcgttgactcaaatacttaaaatgtaaatcttctgaggtattgatttaggcatcgattagatctacacgggaaaaaagatcaggttgtgtcttctttctcttcttccacatcgcttcattctcgttctagggtatgaattgcggttcaccaggaaaaaaaagagggagaagcgttggaatggttgagaattgaacaggagatgagatcagctcgacaatggcaaggggaagcgcatcggccaaacatgaggtaaatcaggaagattattaattttggatcaatattaaaatctaggtgcatgtattatagaataagttatttaattcctaaaacatgtaatttttttgttaattaatgaattctacaaagcatgtaaatcacttaatggaggttcactgagcgaacatgtacttaagaagaaaaatgtaaatgataaaaaataacacgtagaaaataaggtactgatgtggtacctacgtacttatcggcgggccaattccctacatgcccatgtgatttcacccaattccttctacgcctctaaaatttgtttgatctcttatatatcgctgagtttttatttggatcccttacatacccatttcgttagttgaccattagtttgaccattagttattgtagaaattattttattgtccttggtatattgttaaaagctagaaatgttttatgtgtaaattatttgagttgtgaaaaccaataaggaataaattaataaatatttgttatgaatatttaaaaataaaacattatttcattaaaataaaaaagatttattgtaaaaaaagttctgcataaaatttgaaaattacttttcaacaaatatttagtgaaaaaagattcgttgtgaaaaaacaaaggggatgtaattagtttatcacaaattagaaaataaatttaaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgagcattaaatgattatattgcttgtattttgtataagttaatttttttgatatgaaaatttattgggtaggtaccacatatcgcaggagggccggccgtctgcctgtaagcaaacgactatgaagattgccgatcttcgtaggcaggacggccgtccgcttgcgaagacaattttcgcaggcggacgttagctagtcaggtccgtctgtgaaaataggaagtggccgcctgcaaaaaaaaaacttccgcctgcaaagataggtagaaaattttaaattttgatacaataataatttgcccaaaaattactttttaattatttaatagaaattgatgcaggaagattattagtaattatcaaacatatggtacttagaaatctacatatattgcataagtgaaaagtgttgtcaaaatatatatattacaatatttttttacattgtcacttaaaatacgccatctagttacattatggcatagcagtgttccactcctgaagttcttgaattcgtcacttgtagctcgggcaccctctgggttgaagaattctcctcgcacatgacagcactcacggtggatgaagtggcacagatcgcgctggacatttgtgatgcctgtatcgtcaaagcttgttcgaagttctattcttggcaactgcatgcattgaagaaaaataatatattagtattataaatatgtgaagctgtctagtccatagtctagagatttacatcctctgcgttaaccctgtacctcccattaaccctgaggaattcgcacgcataatacctgcagaggacaatgcctctaggttgcttgtgatacttcacgacatatcatagaagaaaatagttaaattttgcaattagtgaaataattggaatacattaagtgagtgaagtcttaccggctaatatgtatgtactagcagcttctcccttgtttgggtctgttctccaccctagaacttgtagtagttgtatgcactgtatggatgtcgtaccatttcgcattaaggaggatatttaattataatacattcatataaaaaatgcaagagtccgaatcacttattactgtaagattattagaaattctttgtataagtggtgactgtaatcgagactggtcctggactccgagttacactcgaagtcaacttggtttcttttctttcgcccaagctagtatctctgcaaacgaatacacacaaaactcattgtgtagcaacgtttattcgaatatataacaagtaaatctaatgtagaacatatgcacctttggtggaataatatataaggtagtcatggttatatccgagcgagttgtgtcctcatcagctagccaactgatgaaccgcaaaaacaatatcaagtcttgtgcaattggctaaatacattagtgctccaatggcatttaagtagggaattttgggtcccattatttcctcattatcttccttgggttttaatgtgtccttataagcttctatggatcgaactaccatgggggttttcaaaggatggcatttgttcatattgaagttaccaaggactgtctttgtgtagggagatcggtgcataaatactcctccatggaggtgctcgagttgctggcccaagcaaaacttggttttccccaagtccttcaatcaagctcgatattaagacaagccattgcttatttaggagagaatctattctatactgctgagtttgttcgagttcagcgatttgccatcgacattgtcttttatttaatgtcctctatggtggcaatgatatttagatcatagacatagaccgagatgatatacaaaatccattcagggatttctttgaaaacacatgtggacaatcataattgtttgaataacctctcttctagagatatctacttaactctttgaaccacaaccttccggattgtttcaatccataccatgatcgctgcatgtgcacactatacatgttgcagtttccttttgaatttgtgatcttgtgtcctttagggactctcatataaaattccaaatctaacgacccataaaagtatgccgtcaatacatccatcaactgcatgcatgggtccacatccttcatgaacagaacatatggaggtgattaattctcattgttctaagctaaaaaaaagtagagaagagatgggatcacatagctaatttttgggaggcctgcatgccgtaggctagcgaaacaaccaggaccacccaattagcatctatttatagcaactgtataagagcccctcgacgaaaaagtctaccaacgatctccatgctgcaccgtgcatctatgcctagttttcttaccctccctccaccataaatacgcacccatctgcaacatagatcaccaaacatatcgaccaatccctcttccagtcaagaaaaaaggaagattacaccaacaaacaaactagctagccaatggcctccttgtcatcttttccggctcgccgtggcggtggcggcactattggttgttggctcatgtgccactgagctcaccttcaaggtcgctaagggctctagcgccaaaagtctagagcttgtcactaatgttgccatctctaaggtggaggtcaaggagaagggcggcaaggactgggtggcgctcaaggaatcgtcgtctaacacctggacgctcaaaagtgagtcgccgctcaagggccccttctctgtccgcttccttgtcaagaatagcggctaccgtgtcgtcgacgatatcatccctgaaagctttacagctggctctgagtacaagagtggaatccaactctaagtaacagacatgtgtactcttgttgggtcacatgcgaaatatgaacatctaaataatcctctcttaaaagagatcgtgtcatgtttgagtgagcaaataattattatttttggttattttgttgtaataggccgatggcaacataaggcatacatgtgtccttccaaaatattgctgcggagctgtatgtgagcattgtttggaatatatgtcatttatataagatatatggaaaaaagtatatttggtcaactttcattaagatgattgcatctgtttgattttccaaagttttagtacatacttatgtccaaaccaatgtaatccatttcacttattttagcttgtcaaaaaatttgtaaagtcacatctacacttttttttcattttctaaaaacaaatagttgaattgactatactatgacctaaaactataagcattaagcatactggtacatcgtttaccttacgagagaatacattatataccactgtgtttgtcacaggtctatagtttgctattgactttgtcacgttctacaatatgccatcgacttttccttaacttctacgacttaccatcaccatctggttatccttcgtgagaaatgtataattttatccaatgaccaaaatacccctataacagatacttccaaaatttggaaaaaaaatttgaaatatcatattgtaaacatccaaaatttggccaaaaacttaaaatctgatattttagaatttttgtctacattttggaagtttttgtcctggaggtattttggtcattagaacaaaattgtacagtactaatggaggctaaccggacagcaatggtaaatcatagaagataagcaaaagtcgatggtatattatataatgtgacaaagtcagtggcaaatcttagacatgcaataaactcaatggcattgccggtctgattggcagagtccgagtcagactccattttcatcgggtctctggtttccttacttgggaaggcatgtttcggatttccattggtttctatcccgagttggacatggagaagggcttatagagggcaagaccaacccctatataaggaacaaggccggttcaattgttacctgacaaacacacaatcaatagaatcgttcttttactttaattttagccatgttttctactttaccctaattttagttcatctttatcgatttgcaccgtttgcccataaagaggtgccgtactcaaaaaatcaggtttgtcctaaaaaccttccgtttgcccacaagatggatagttatcctcatattgatttaaatcggcctagaggctgattttgatctctaaatcggcttcgctagccggtctagctttctttttacaaaacccatcttgatttggttgtttggctagatcggggtagttgctgactccatatccccgtaaggcatttaggtgctgcgatcgtgcttgttgacttctcacaaaaagttgccaacagtaacaacaaagataaataatgtgatggaagaggggaatgtgcagcacaccgtttcaaaattgatgattgatagttggtgacgatttcatggctacaacatctccaatgttgtactctctccatcctataatataagaaattttagagagatatgacacattttaagacaacgaatctagatgtgtcatatcccttataatataggatggagggagtataagtgaatgttatccaataaattcaaccaactttcgtaatcatacgtgtacctttttaacttttttatgcacacacgcacaaaaaaaaaagtggttacgtgtaaacaactatagacaccacgatcgatttgaactagagcagatggagtgaaggactccatatgtccaccacctacctctgaaatcgagtcaaaaagatatgcgctaattcagatatgacaacctattgtaactattaagcagagtaaataatgtattatcacctcaggatttaagcatattaaacagggcagcaaatcatcacatcatagctatgttctcaaacatctcaagattctatgaaaaatactctgttcttcctatgatatgtgtcatgcaatgcaatccatgggcttgtaaagacctttctctattatttattgcagcatatatgataataagtggtgtaaacaaacaaccaacttctccaaaagttcgagggcctttcactatatatatacatgagtttctctgcatttcaaataagctgtacaccaaggacatcgtctctctcatttaccaatatgtttagttctctagatactataactagattaagattaccggattaacttaaaaatctggtatgctgatgtcacgagagcttgcaattaagaaatacagatattaaactagtgttcgaccatagaagtacaagccattcatggactatataaataggccaaggctagtgctcagccaaaagctgaagatactttaactcgtattctaatatttatcatattgaaaacccttccaacatgcatgtgctgccttgtgtataaacatcttcagatacgtacacatgattaacttaactagtttaggcttaagaggcattgggaatccgggtgtagctactcccacatagtgcattacgtaagttgcattcttcacttgttcgcagtgagtttggtgttgtttcaggattcacgctggaccattcctattaaaaacaacaaacattcattcatattgatgtgtatatcagagttgccagagtaagtggtttggcatgcatctacaaagtattgtttacacagaaattttgcaactcctaggcaaagttctcatatccatcagactctttggtgatttccaaaaaactagaattccaagcgtgctgggggatttcgtatataccagaatttccattcttaaatcaaaccttgtagtcaatttattttattaaagcagatagcttgagatttggtcgatggataaataccacaacaggctaatctgtcagaaaaatggcactgcgagccgacatctagtatgcaaatataatgcttttttcatttaatttggcttggctagcatcatgctaattaggccagggaaacactaggagcatttcactagatcgatacgtggccggggggaagatcaaccatgaagatgaagcgaggccgaagggattgatactgaaccaaaacgaattaataccacttatttctggaaaaaaacgacttgcactttataattatctgcagtatatgtatatattctggctcttgtgctattattcaggtttgttcaacgttttggaccattgtccattagatgattggtgatggactgtttggaatctagccgattcatcaagcgcgagttcccccgcttcgcccccaaaatcaatcacagcaacgacatcatcatcgcataaacagaacaatacaaacaacacaaacaagaaatctaccggatccgtccgcgggtcgccgccgcggccgttagatccgacggagaagtcatcgccatcgccagatctgcgggagaaggttggggcgaagggggagatcactagatctgctcgccggaaacgccgtcgccgcctcctccgcaggatatgcccatgggagcaccgatgcaaccgccgctgctacggtagaagcttgggcgcggaggatgaggaggagggggtagagaaccgccagattcagtcgccgaaaacgccaccactatcgcctccgccggatctgcccgtcggaaacgccaccgccgccaactccgcaagatccgctagcgggagctaccgacgccactgccactgccttcactggatccacccatcggatatgccaccgccaccgatggatctgcgggagggggctgaggaacgccgaatctggcccgcaggagctgctgacaccattaccaccacgaggggaggaaaggggtgactgagtgagagggggagagagacgggtgagagtagggcagcgaatgataaggtcgccccccgtcacctcccacgcgtgcctttatccactcgcgtgcggctctctcttggctcggctcgtttgataggtgcgttttttttaaataccggcaccgataatatattatagctggcggtttttaatatattataattgtcggtttttttaaaaaaaatagcacgtatagtataggtattggtttttctattaaaccggcacctatattcacttaaaggtgatggattttttttttgtattttcagcctgtggaggtgggcaaaatactataggtgctagttttagctgttccggtgcctatagtgccaatatgtatgtgcttttttatactagtgatgctgagggtttcataccagaacttccattctaaaatcaatccttccagtcaatttattttattaaagcagacagcttgaggtttggggcaaggataaataccacaccaggctaannnnnnnnnnnnnnnnnnnnntgaacctacatctatatagtatgctaatataatgcttttctctttggcatagctagcatcatgttaattaggcctggaaagcaccaggacgttcacttgcaccatggaaagaagtcaacagccttcactgtatggttatgccgattcggttttttttacgtgtctacttggtgggtaaggatcgatagggtgctccggagaggaagcattccacgaagatgctagatgaatgctccggttaaattgctggatgaggatatccatctttgctaatctctatcattagtaattatttgcaataattaatatattttgttgttaattggtaattaacttgtcaaaaatagtattgataagatataattagtctattttgttgttaattagtataaactatgactatattaatgataattaatatattttattattaattaatatgttcaatccattcttatccacccaatcaaacaagaaattggatcatcatatctattagaaaaaaactgaccatatctgtgtaaatatggatgaccaaacgtggccggggaagatcaacgatgaagatgatgtgaggccgaagggattgatgctgaaccaaaacgaacccacttatctcaggaaaaaacggcttgcactagataattatctgtagactatgtatatattccgactgctgcttgtgttggtatgccggtttgttcaacgtttacagattaattattgtttcgtaccattgtccattagatgattggtgatggaatgtttggtacgtataaacttttataccttcaaatatatttttgacaaacagctaacttcaaatatttaaccaatgttttatgaatgaggcatcccaattattttttagataatggaaatggattatatctccggcttcggtcataacacacaaagtcataagtttaatacaaaaggtaaagataaaaataaatcaaaatgagaaataagatgatgggacaattccccaacccctttattattaactagcgttaaaccacacagatttctagctagcaattctaatggaactacgccacccatagtgaaataagagacccttggctactgattgcaaaaatatagcaccattacgcgtggtatcatgttcctcttgtggtagcatcgtagaccaaaaatggatccaattggaagacatgaagataatctacatagggttagacaattatttagcattaaaaactttatcattacgacaactcataattggccaacttacaacactagctccgattagaatcaattttttaatggacctaggtacccctttaagccaattaccaaaaaatatttttgacgttaccgggtgaagggatattaaaaacaaaaaatacacatatgtaacaaactgagcaacttgatacttgtcaacggtggatacccgtagactggataaattgagtattggagacaagaaacaaggattatactggttcaggcccctcgtgatgtaatagccctaatccagtttatacgagattaatatagaaaaccacatagtacaaagggtatagatgaatccaatgataccgacgagatccttgttgagattgatcaacgtgatctcccggcgacttcgccttgagttctttggcttcgtaaactatggtgggtgtgttggcgttatgatttgatgatcccgagcccttccgggagtgtgccttttataccataagttgccttagtctccaagtagaactcggagacaatgaaccctgcacgatatagaataatctctatcctctcctagtaggactctgataatctacatgctgtgaggatattttccataataccttgcatatttctttatcgcatagggaaacatatcgtaggatatgagatatgccaatccggcatatttggtaaattgtaggataggaggtatgtcttatccgtaaccctgaaaatactcaaagaaaagatgttggattatctcttgtggataacagaaagaacaatgtttcttcctccccccccacccttttcttatggccaggttttatttcgttagaattactttcttatgaaaaaaccacatacacacctttatctttagtggaacctttaagtctcatataattccttttatccaaacattagagttcataatcatatagatttgactgaaaattggccattcttatggagcgaccatacgaaacagtccttttcatttttgtttgacggagtcatacaaattagctagcctgaggatcccaattacttaatccacaattttcttagagattaacacaaatgtaaaatggcctatattacatatagtacgtagggcatgttcactttgatgacattttcaaccttaccaaattttggtaaagttgccaaaaaagtggctacatttagtttgttgccaaaatttggtaactatataagaaatcctaccaaaatttttggcaagttgtcaaaattttggtaatgccaaaatttagtaaggtttttttagcatcaaagtgaacagacccgtaatgactatgagatatcaatatatatacatatatatatatatatgtatatatatatatatatatgtatatgtatatatatataggagttggataatatgaacctaggtgcatctgcacctcaatcccacatgtgacacgtgtctatttttcgttgtagctgatcatcattttcaccaaagctcctacaacttgtacctacccagcccaaactcttatagggaaaattttaggcaggtacacaatgatgctgtagtcatgcatttctcacccacccatgtactagtactagtctgcaactgtattcatgtcttttcactaatgtgaccgtgagagagaatgagagagagagagagagagatgaacatgtagttttaatagatctcttggctacaatcacattactccatgtgattagccatcaaatatacgttgatttttttaattaatctgaccaccttgttttgtatgtccggaaattaatctatatctggttttattcggacatgatatatcaagatgaatgtccaatcaccaaacaaatacaatatatccgatgtccaagaatgacattgtgaaaataatatatcatttggcataaattaaaataaaaaatacatgatttttatttttacagatatatgctacataacaaagtataatttcattaattgacaaagaaaataatatacactgcaatttgttgacaccgaaaatgaaatacaacgaaaatatcattttgaaaagtcatgtctaaaaaaaagatgtcgcaaaatgataacatataacttgacatgtattgaaattaaaaaaaaaatcacatgcgtgttatttccaaaatggtcatgtgtactaaatttccatggataacaagagaaaagaaacaatattcaaatgatgagtaaatactacatgatgtgtggtcaactacctctcatctgttctttctctctctttgctcaggaagtacatgtcccatgtcagagcaacacatgcattacgtacctccctgacattttctcgtgtagacaatcttcattagtgaaaggtccatttagaaagcacgcatcttggaacgattgaatggttgtgattctgggtgcagatgaacctcggttcatatctgcttttatatatatatataaactgtgcaaacgaatagaaaacttctaacaaatctcgatggccttgctagctaggtgaatcatcatatacttccatctttttttttcctttgacaatttacagcttactagcttacaggattgggaaatctctggaattttcatatagctgcacaaattgtggcacagagctgcattcacagttctagaagcaaatcatcatagtcaatatgcaagagtggccgattagcagttactccgacagttggaagtagggtactagtacattctggtttttgagcaaacagttctaattggccattggtcagttctttttttgttcatgttgttactgtagctagaaatccaaaacgccaccaaaatggatatataccaaaaaaaatgtgcaattcttaagttgcagtcaccactgaatctgaagtcaactaaacttcatacactaggctcatattcttgctaatatacttcatacaaaataggggcacattcttacataggagtagccatttttaattcaactaggaagatagcccgtgtattcacgcgggcatgtgtcgtacattatgtttgaacatctacaatatatgatttctccataaattgttttcattagcattgctttcataattgtctaacctagttattagttatctttatagcatatcatatttaattaattcctacaagcaattatttataatattcttcatcatctactaagtaggtagacatattttgtgttagaaaacatgtatagaaaattaagtgtaaaatgaaaagtaagatgttttttaattgaatataggttgtcattgtttattgacggatgaattgggtgggatatgaggctctactaaatgcatgggtttatattattgtttaatttgagaaagaacccatatgtgaacattccatgtagagagtgtgtgagactccatgcaacctagcgcaaataatattggatgaagaaatatggttgtgcaatatattattttgatagatgatgtattatgaatacacgcttgtcttttaagatgagatagaactaatggttggaaataatgggcttatcggtttaaaaggcctaggaggatttatggggtaataggtggcgactttatataaaaaagaaaccattatctaaaattgattagatgatatataaaataaaattatcagtgtagcttaaaattatgctctttttaatatttgtttctctctatagttttgtagctgaaaatagggaggagactggagagaaacgaatagcgtagaactcaaatcagatatgagaaagggttcgcagtgcaatggtgttatgtgaatatgattggagagggaggtggatggtacattgtttttttttaataaaaaatcttcgtaaacaatctaagtgagaacctatgatttgttgttttctcattataaggatctttaagacatgacatgtggtggcttaagtttttttataaagagaaaggcaatctaatagttaaaaataatgggtcatcaaattaagtggaaaccgatggatagatatatactttattttctcttggaatttcaattttttcaaagttttaaaatatcatacatggtgacttgagagtgctacagagcacgcttaatcgatctttactatgtaaacgattcaagaatatataatatacgttttcatgtttttcaatgtttcgttgtaatttggtaaggagattttatttttattgaggtatatttaatgccttcatcagtttgaaatatttatgtctttaaatccaattgttaaattataactcgactgatttaaatgaaaattgatgaaattataagtctgccaatttaattgaaaattgatggttagatttgttttcttcggatcgccggccgagtctcccccaggcccacggctcggaccgggccccctggagccaccacccctgccggagccgccggtccgactgccgcccgtggtggcgccgttgctacccgtgccgtcgccaccgccaccaccggaggcgcctcggcgggaccgacccctacagcaccgacggccgacatcacagccaggatattctcccggtcgcggtcgctgcagagggggaggatcccgtccggaatcagcatttgctcgacggtgtccaggcccagcaccgccgaaccaccgtctttgcgtcctcctcgccccaatcccagcgctcacctacgtgggtgcacatgggatcgttatacctggtgtactcccacgcgccgcgggactgctcctggagaggcgtgatgcgacggcggaagtagtcgccgaacaccatcgccgccgttaagccctagcttcccaggcccttgaggcggtcccgcaccgcgtcgtactcctcgcccagctctgaaactgccaaccacgcggcagatcgttcgggagggccggtagggagccgaagtcgcggacgatccggcagcgcagtgtagaaccaatccttcttccaatcctcccacttcttgcggaggtcactatcgatgtactgccccgccacgcctggccggggctggaagtagcatcctccccctaccgcgccttgcagcagctgtgggacgaggaaggactggaacagccgcattgtcggccgcaccccgacgaacatcttgcacaagtgcgcgaagatggccagcgtcatcatagcattgggggcgagatgcaaggcatgaatttcgtagaaatccaagacctcgtggaagaacctggagaatggcaggatcaaccccaccatggtgaaggataggaggtgcacggatcgctctgggtaccgtggctgcggccgcgtctcccctaccctcacggcggcatcctctggaatgatcttgcggatgaggctaaggtgcctctccgccgtaatgcgcgatgccgggaggacggcgtcgccagcatcttgggccatgatggccagcgggaaacggcgaggagtttggcgtacggaataggatggagggagagaagcactagggcttgaggggcgagtatgcgggtgtgcagtcggcgagaggaagaagacgaactctccgcctcccttcccttttatccccacctcggccgcgctcgcctcctcgtttcacgcccctgcggttgccccatcgattcctgcgcctacggttgcctccttgattctcgcgtccactcatcacgtcgccccactgaacccgcgccccgcggttagtgcgcttgtcagtggcgcactcggcgcgggacatgcggtgttcacgagcacggctaggcgggcccgccgtcggtcccttcgcgtgcctagcaggcgggggagttgaggcggcgttgggtgacgattctgggtgtgatctggcagaccccccgacttttgcgccctaagtgccccagtgaacggcgcacttagtggcggtcaaatcgccattatggctgatgcgccagcctggccacccgacggcggctgcctagtttccccgccggacccacaaccacagcacgggaactcatgaggaaccacgccagaccgccctcagggggccaatgtccgacgcggtgccgggggctactgtcggtgatatgggcccgggggtatgcaaagtacgggggagttaccttcaaatgcagccacgtggccctacaacttggccctccccccacacctcggaagacgcaaaagcagccagggggcctcggggtgccacgtcacgcccctcgggccctcgcgctgccacgccccgaggccctcgcccagctgccatgtggcgaggggagcgcgcggggaggagactcaggctgaacccccatcaatgcgcggcgccccaaccgtttgtcaccgcatttaatgcggtaagggcggacgtgcggtgcggcctgattgacctacgtcaatcaggcatgaccagactgtgaccagcccgtcgccggtcacgtccggtcggacgggcagccgtgtccccacgttcgcccctgtacccggcggagtggaggcaggtatgccccgtcccatcaaggcatcatccggagctccctccacgtgagaaggaccgtcacaagtcttcgttcatttaagagggaatgacagagctgtcctccgtgtcaggcgggaggtggcgctgggtcccactcgaggacggacggccgcttagcttctgggcgaaggcacagatcgtggtccggtctgagtagagtgggtccccctcccgtgatagagtaggtagaacggtgcatgtagtatccccttgaactataaaaggaggaccttgcccaccgagaaaaagggacgactcctagtaggcctaaaccctaggagaagaagagcgagagtgctctccagagtttaggaacctttgtaacactcaaccataaatcccatccataggagtagggtataacgctccatagcggcccgaacctgtataatcttgacaccgtgcacgatctcgaagcactcagggcagataaaagatttggtcaagcgtgcattttcccccggccaaaatcacaaaagggggatctcactgtcacccgctagagaggatcattcctcgacagcactagacctctactcctccctgagcatagtcccggtcctcactattgaccaaggctgacctcaagtcacctgcacacaatcagacaaaacaaccgttcctgggcacagatatcacaacctgacccacattagtcacacgcactcacaccaacattcacataaattctcaaaccaattcattgattaaatcatctgcacagccaattgttcatcacaaatatattaatcatgacaatgatttcattaatcaatcatccccgaattgcctccaaatacacaaatcgatcatatcaaatacatcacaaaatcttaaaaaaattacatcacaacttctacaaaattcatcacaaatccacatcgcatacaaatcaaatacatcacacaacaatctcagatccaatcaaatacatcacacaacaatatcagattctcccaaaaaaaaaaccgccaaagtaggcgccgcctcgccgcgcgccgcgccgctgccgcgctggccggccctccacgccccgctgccctcgcgccggcctggcatcctcgccctgccgcttcactccggcctggcatcctcgccccaccactgcagtagagaggagaaggagaggagaaggagaggaatagataaggagaggaacagataaggttgaggagaggaggagagaggagttaaaggagaggaggagatacctcgatctgatcggcacgcctctccgatctccgcgttgatcttttttcccggttggtaacaccaaccgggactacaaatagatttttagtcccggttaccaaccgggagtaaagcgtatggcgatcttttttcccggttggtgttatcaaccgggactacaaatagatctttagtcccggttggtaacaccaaccggtacttaaagattggaaagtacccctggagtttttaaaccgggactaaagatatttatagtcccaatttttaatacaaccgagactattgtgaaatctggtcgaccgaccaaagatggtttctccaccagtgtcaagcacaccctccaaatctccatcagcgcttgcccaaggacatcctctcacctgtagctctcatgttgcatgactgtaacaacatgtgcacctgccaattaaaattaaattgaatttaaagtgcactcttgtttgaagcacgatctacaccgacttgtaggattatttctcccaaggccatgtgctcctttccacctatgcctcatcaattcgccatctcttattcctgtcaaatttatttcatcgactgccaccaccgttcgatatccagctaggggcgcactaccataataattagcatcagcaccatctagccatgtatgcaaacccatgtcccagatatagagccacaacggggcagcacctgggaccctccatcaccgccatggtgccatcaacattgaactgttgattgcccctctgccaagaatactatatatgcatgccacacggtgcccctcagtgccttgctcatcattcctaaccattttctcggccacccatctatcttccactggcatatccacccccctcccaatttgatcatgcatgggtccacatgctcaatgaacggatcatgaggaggtgactaattctcattatctataagttaaaatggctgctttttgggaggcctgcatgccctacgctagcgaaacaaccgggactaccaaccttgcatctatttaaagcaattgtataagagtccttcaacgaaaatggctgccaacgatctccatgctgcaccacacattttcttaccaccccctcccccctccaccataaatatgcacccagctgcaacatggatcaccgaacacatcgatccatccctctaccaagcaagaaacaagaaacattacaccaaaaaactagctagctagccaatggcctccatgtcctccttccgacttgccgtggcggtggctgcactattggtcattggctcacatgccacagagctcaccttcaaggttgctgagggctctagcgccactagtctagagctcgtcaccaacgtcgccatctctgaggtggaggtcaaggagaaaggcggcaaggactgggtggggctcaaggagtcgggctctaacacctggacactcaaaagtgatgcaccactcaagggccccttctccgttcgcttccttgtcaagaacggtggctaccgtgtcgtcgatgatgtcatccctgaaagctttactgccggctctgaatataagagtggcatccaactctaagtaacaggcgtgcatactcttgtgttgggtcatattggaattatgaacctctaaataattatgtcttaaaagagatcgctccatgttcgagcgaaccattaattaattttctattaattaattttctgtggttatttttttgtaatgggctagtggcaaaataaggcatacatgtgtactccaaaatattgctgtggagctatatgcaaagcatggttttgaatatatgttatttatataagatatatgggaaaaagtatatttggtcaactttcattaagatgattgggtgcattatttgattttccaaagttttagtacataggtatgtccaaaccaatgtgttcctttcaccattttagcgtgtcaaaaatattgtagagtgacatctatacttgtttttttttttcctttctgaaaacaaattgttgattctcagccatactatgaactgaaactataagcactagccatcaacccatactatctaattatatcatcataaatattaatactttagttgcaaatgaatatttgttttttgtaattacaatagctcttatgttaaattaaaataagattttatatgaattatatataccttgttaattagtgattcctaattaatagaatacttagtggataaaattcatgatttttaattcgttttgactatgacttccaatggcatgttttcttaatacaatgtcccaatatattattgtttgtattataaataaaacaattttagtcatttttatccctcaacattggtaaaagaaaagtaatttcactgaatttgttggaggaatcatgtattttctgaagcaacgactattaatagaaacataagttattgaactgggtgaagcatatgcaacagataatatattatagtaataggataacacacctatacttatcgtgaaaacctgacataaaggatcaaaatcaaataacatataaacattataacatatagtgagaggacaccatgcactagtaggtatgaatggattcttctaggagccaaatcaagaactcttctatactgtcctatcctaatgcatatgaaatcagttattatgattcttaacattacttgttttggcccataataaaaatatcgcttataaattttaaaataatagaaaaaactgtaggatacattagtttttcctttgatcaccattggggaattgcaataatcatctattaatttggaaaatctattattttaaacaaaaaatatataatcattctctcttccatgatctagggaaataggaacaaaaataagccatgtctcgccacataccatttggaaaataatctattagtttggaaaaatcattataaacaaaatatttataatgattctctcttgcatgcatatatgtatgtatattactcctacttcactaaagccacgcatgcatcattagtggaaaaacctgctagatgcatgcatatttattgatttttttccttgccccagaccatgcatgaccgcctttataatgcaaattttccagtgcataaactaaatactatatatacagatagtttcagaaggtctgaacattttttcgaacataaatttgaaaatttttacaaaataaaaataaggatagaaaattcataaaacatagaaaaaatacattgtaatatattatatactcccttcgtccaaaaatataatcagtcatagacttcaaattttatccacaaatactagtatgtagagagttgcgcgtttgcgcggccgtaacatccctgtatattaaatgtgttatttgttatttacagtaatcaatttaattttacaataataattaacactctagatgtaggtgtgtggaccaaaattgtcggacactgaagtgacaatattatcatgacaaccaataatttaacatgctttcatgcgaccatatcacctttgtatttatactaatattgtaaacaggtaattagagaaacatatggtacatagtttagtattattgttctaaaataaacaatgttattgttacaataaatgattacaaatgaactatctagaacatatttcataagttttagtagtgtggctggcgggatggaaggccggtcagctggcagcaaagccagagacagaaggtttggatgcagttttttttttttaattaaaagaaaaatcaacgtatctatctagactatccagttgtttctctgggccatgatttttttttatttctctaactttttttaagcatcaatttgattggatggctatgatcttttcttctactttgtccttttctgaatcaaatggttcatattatcctgatcatgtggaggatttcagtaaagttaagttttggttttaactttcacttagagagatgagcatttaagtgtacaacatccatcactcaaccacctctcacttaatatttttcgataaaccttattgctaataataaatgttcatgttcctacactgtcgatgaatgatactcgtataccggatgattagggtattagggtatgttagaatgatgatctacgtaatacgacatcaagcaaacagaagacaagaattatactggttcaggccccttatcaggtaatagtactagtccagtttatatgggattgatgattgaaaaccgcatatttcaatgggagtagaaaaattcgacgataccggcaagatcgtagttgatgtattcgacgagatctcccggtgacttggctccgtgtattccggcttcgtaaactatggtgggtgtgttagcaatgagattcgatgccttgcaccccttcccaggggtctcttttataccgtgaatcatcttgatctctatgtaagactcggaaacatcggatcccgtacgatacaatataaattttatcccctccaagtaggactttggaaatcacttaactcgtagagatattttccataatttgtaacggattcctactacatgtatagatacaccggtcagaccggcggtacagcagcggtcagaccagtggtacaactattttggagtatagactcgggaacatcagatctacaatataaactttatccccttcaagtaggactttggaaatcacttgactcgtatagataatttacatattttgtaatggattcctactatgtgtatagatacaacctgtgtacgtgaaggtataccatacacgtatattctataagtcgtaagataggaggtatatatgccttatccgtaaccataacactctcttatttaaatttgtcttatttttgcgttccttcctaatctctaaagaaacttgacatcccatatatttaaggatgtacaggtgaatataaatataagaagaataataaaagtagatcaaatatagataaaaaagttagactatgcaaattgatggaatactacttgaattgtacgaggctaccacactatggacctttctaaatgccagaaaaatttgtaaaagcaaatagatggaacacttttatgaattatgggtacgatgacaacggattggcttcttaggtgcaagcaaacttgtcgatcaattttaaatcaaacatctgaacatcaaaaaaatatatatggtaaggtgatgacgtaggttaacactcctatatattagacgtgttgtgacagatgagaaacatgcatgtaaagagaactgaactggaaattagaagttagaatcaaaccttaataattgatagaaaatagcaatagcgttcacctgtcgctgtgtgcatggccatgccgtgccctcccatgtttgccattgcgtctatctgatcagatcgatatgcagtactacattcgtctcattttaagtgtagtcatgatttttcatgcgcaacgtttgaccattcgtcatgtttgaaaatttcatgaaaaaattaaaagaataaatcatgcataaagtattatttatgtcttatcatctaataacaacaaagatactaacaataaaaattttaaataagacggataatcaaacatttgacacagaaactcacaactgcacttaaaattaaagtgcattggcggtccttaatcttgtagggttgtgtcatatagatccctaaactttcaaaatgcatatccagatcccagaacttgtcaaagtgtatcatctaggtcccaaatcgacgcatcccctctaagatcctacgtggtgctgaggacgtgacgtgtccttttctttttttttcttcttttatttttctttttcttttccgttttcttctcattcttctttttttcctttcttctgctcgggtcacaaagaaaggagaataaaggggaaaaagagaagaaaaaaagaaaaaaaaattaaatgggtcctatttatcagtaaaataatgccatgtcatgtccgtgtggcatgtcacatcaacgccacgtaggatcctaaaggggttgtggtaatttgggacgtagatgacacactatgacaagttctgagatttggatatacattttaagagtttaggaatctaaatgacacaccccaacaaatataaggactgtccgtacacattactctaaaattaaaatggaacggagagagtagtacgtgcaagctgtggaaaatcataaaaggactgttgtagagctattaattaacgtagatgtttctgtaatgtatgttcgttgtagtgcatgcttaatacgagatgttttggaaaaaaaaagagatatcagtagcatcccagtaaatatggatggccctgtataccaccaccgattttagactgcttgatcgatcggtttagaaaaaaaaaagattacgcactttcataaaaaggaaaaaaaatattgtacttaaacggatcgggtcaatgggcttggcaataggttagatggattttaaagagacccacaccacatagaatgtggattcaaatttcaacggttgacatattacaatctgtttaatcaacggttagatcacatgagaggttctaaaaaagtgtctaattaatatataggtatagataaaacatcagtacattgtatagtttattgagatgtcaaaacaaactgcagtacgactgagtggtaataggtaggatggaaatgaagccagctttgagaggagcaaaattaagcttcatatcatatagttggccaatgccccaagctacagtcaacaagaaagtttgtacccccgtcgttttttaatagatgatgccgttgactttttcacatgttggatcattcgtcttattcaaaaattttatgcaaatatataagatataaattccacttaaagtactatgagtgataaaacaactcataacaaaataaattataattacctaaattttttgaataagacgaatggtcaaacatgtgagaaaaagtcaacggcatcatctattaaaaaacaaaggtaatataatactattagaataccaatttattgcaaggatataaaataaataaaccattagttacaaactttaaatagaaatatttttgcactactagtataccgttagttccaaacatttgaacgcaaagaactagtaaatctttcacgtgaaaaaaatgtagtggtggtttacattctatagtccatcgtgtaagcacaacctcactcccacgccctctcgagcgactcctagctgcacacatgatgtctgcatgatgtcctttcccaggcgcttgcccatgaacttcctgtgacctgtagctctcatgtcgtatggatgtaacagcatgtgcatccgtgtcacgtgcaattccaaaattaatttgtgtattaaatcctcgtcaaaaatcagtcaaggtacacaaacttattatttgatcatacaatagaaaaactaaaacaataaattcttagtcctcaccatgacaaaaaggtaacaaaaaggaaaaactaacaaagctttaaatccactccgacaggtagctcaactgaggcatactcctttttcaactgagattgatgattattgcaaggtgggtatataacgtagtccataggccacacaacaaattaacgaatgatctaacagagccatcataaagtcatagctagtgaattcataaccccgggaaacaaggaataaggttaccagtgcaaattggtcataacaaaggaataggtgcacaccacaaataaatacatgtttgaaataaataaagaatttaaatataggatcaacctgctcaaagggaagtttgagatatgtccgacttgccatgcaaacaaatgacttcaattcgtattctgaaacacttccgacaaacttgtgatcctccgaaatgatagaactacactatagcatgcaaaacaaagaaaaagactaataagaaaaaaagctatagcgtacaagagttttcaaggtaatttttttgtgaaaatctttaaagtcgttgttcgtccttcttttgaattggagcctcccaatccatttatttattttattcattgagtttcacccccccccccataatctgatccattttcccttcgaaaccaaaattccaaatttcaagaattctccaaacgatctctgtgaaaatcattccatcaattcatgtctataaactcatatggaagttctattcaaaatcacataaaaattgaatgaccactatatctctccttgggccaaaatcaaccacaatccaacccgtcaccctctgtgtcacttcctccaccatctccctagctctgtcctgcacctttccagcccactgccactgcaccccaacaaaggcagctgccccaaccgagtttattacgtgtgccacacaatgcccctaggtgccttgccatcgctcctcccgaccattcgctcgaccacccctctatcttccactagcatatccccccggcccctaatttgtttgtgtatgggtccatatcctcaatgaacggaacatgaggaggtgactaattctcataattattaataagttaaaaaattacgtggagaagagatgggaccgcatagatgtcgtacgctagcgaaacaaccaggaccgtcaaacttgcatctacttaaagcaatagtatgagtccctcgatgaaaatgcctaccaaagatctccatgctgcaccgcacatccatgctaggttttcataccggtccataaacactcctttagggagatgcttgagcaataggcccaagcagaactaggctttccccaagtccttcatctcaagctcaatattaagataagccattgcttgtttaatgtcctgtgtggtgccaaggatatttagataattgacatagaccgagatgatacaaaatgcattcagggatttctttataaacacagggggacaatcataattgtttgggaaacctctctttaggagatatctatttaattgattgaatcacatccttccggattgttttgatccgtacattgatcgctgcaggcgaacaatatagatgttgcaatttcctttcggatttgggatcttgagtccttcagggactctcagataaagttccaaatctaatgccccatacaagtatgcggtcaatagatccatcaaccgcatgtgtcggttcacatgctccatgaacagatcatgaggaggtgattaattatcattattctaagttttaaaaaaaataagtagagaagaaatgggaccacatagctgatttttgggaggcctgcatgccctaggctagcgaaacaaccgggaccacccaactagcatctgtttatagcaattgtataagaacccctcaatgaaaaagtctaccaacgatctccacgctgcaccgtgcatctatgcctagtttgcttaccctccctccaccataaatacgcacccaactgtaacatgtatcaccaaacatatcgatccatccctctaccagtcaagaaacaaggaagattacaccaacaaataaactagctagccaatggcctcgttgtcctctttccggcttgccgtggcggtggcagcactgttggttgttggctcatgtgccactgagctcaccttcaaggtcgctgagggctctagcgccagtagtctagagcttgtcaccaacgtcgccatctctgaggtggagatcaaggagaagggtggcaaggactgggtggcgctcaaggagtcatcatctaacacctggacgatcaaaagtgaggcgccgctcaagggccccttctctgtccgcttccttgtcaagaatggcggctaccgcgtcgtcgatgatgtcatccccgaaagcttcactgctggctctgaatataagagtggcatccaactctaagtaagaggcatgcatactcttgtgttgggtcacatgagaattatgaacctctaaataattatctcttaaaagagatcacgccacgtttgagcgagcgaataattaattttctgtggttagttttttgtaataggctggtgttaaaataaggcatacatgtgtactccaaaatattgttgtggagctatatgcgagcatggttttgaatatatgttatttatataagatactaggtgattccccgcgctttgctgccgaaatttctaagtaacttttaatattttttttaataatcgatctaaaagtaaaatttatattagttattagcaacaaataaaaatggtttgtcaaactatgttcagagagaaatatgatatgtatgagattgtagatgaaatatgatatcccacactttgattatatgaatgaatataaatgttaaaaatattgtgaaaaataatgtgaaggaagatgattggatgttgatttgtataattcaataaattatagatgatgttgcatgcttgcataagttttgcatgtatttattgctagtggatgatgaggtggcatgtttgcatgttgagctttagggttagtgggtcataactttatagtaagataggatatgggaaaaagtatatttcatcaactttcatcaagatgattgggtgcatttgattttccaaagttttagtatatacgtatgtcctaaccaatgtagctcatttcacctttttagcatgtaaaaaatattgtaaagtcacacctacacgtgtattttttttcttttctgaaaacagattgttgtatcaaccatactatgacctgaaactataagcataaagcatcggtacatcgtttagtatattcagatatcagaacaaactgcaagtcacattaatctcacatatccaacacgaatgagtgataatcggagtagaatggaaatgaggtcagctttgagaggagcaaaattaagcttcatatcatatagttgggccaggcccagagctatactcaacaacaaagtttatatactactatgagaataccaatctattggaaagaatctaaaataaatatgccattagttccaaactttaaatcatttttttttacattaccagtgtgttacaaaggatctaaaaaacataccgtttaattccaaacattcaacataaagaacaaataaatctttcactcctaaaaaatgtagtggtggtttatgatctgtcctccatcatgtatgcctaacctcacgcccatgccctctcgagcaactcccgcacgcatgatgtccctttaccctatgccaatggaaacagacccccaacccccaccaccagatcaaattatacttcctacgtgcttgaccatggacctccactcacctgtaggctgtagctctcatgctgcatggatgtaacaacatgtgcatcccgaactaacttgtgcattaaatcgtcgtctaggaaagtaggaattagctgaggtatacaaactgacaatttaactatatagtaccaagaaaactaaagcaattaatacttacaaaagaggctattagtcctcaccacgaagacaattgcagcgaaaaaagaaaaaactactgaagctttgtttaggtgatgattggattcactattattttatgttttgattattattctgtgatgaacaattggcatatgtgattattggttttgatatttggagattatcgtcgaagtggttttggagataatcaatttttaggtgatgattggattcactattattttatgtgaccggtccgaccgggctgtgtatgccggtcagaccggcggtgatcgagcagtcagaccggacggcccgcggtctgaccggccgacagtgtatcggtttcggtttcgggttgttccataggatatccgtgattgtttcatagctatggcttttagatggatactataaatatgtaatactggtgtttgctaacaatgagtcgagttggggatagtttggtctcggaatatggtttttttgtttgtttcatgtgtaggtgactcgatgcctcgggagagtatttgcagtgatggactgggagtcggcttggtggtaagacgatgtccgtggtggtcagatatcatgcgggatactaaggctagagttgatgcacgtggttagtgaagattccatatggcatatgatggaggtattatgtgcatatgggatgcggagtcgaatttggaaggagtccaaatttgatacaattggttatgttaagtttgtgtcttgtactagagggtttcctgaggtgtttaggactcttagtatgagtttggttcgtggctttaggctgcctacctcatgtataaatagagggggagcgtgaggcttcccggtatcgtttttgtatcgcttttaagagcaattgagttgatagtttagttagggtttcgagtttagtagagatttttgtaaggagtgttgttgttgcactttgtaaacacagagagaagcaataaagttgtcatctactttaagagttcttcgatttgtgtttcaccgggtttcgacggtctaaccggcgactcactggcggtcagaccggcgaagcaccgacggttagaccggctagggcgaggcggtcagactggcggcgacatcaggcgcggcagggattccagggcggtccaaccggaagatcaataccggtcagaccggcggttacgcttcggtcagaccgacagatcaatctcggtcagaccgatctccatcgatttcgagggtaacttttatttctgctaaaagttttcggtttttgggtataccaatcattcacccccccccctctagttggcttagttcttgtgattcgatcctacaacatcgaacgtttaaactcctgcatgaagtattaaatataggctaaaaaaataactaattgcacagattgcgactactttgcgagacaaatcttttaagcctaattgctccatgatttgacaatgtagtgctgcagtaaatatgtgctaatataatgatggattaattaggctcaataaattcgtctcatgatttactgacggatagtgtaattagtttttttattactgtgcgaacaccccatgcgacaccctgtataatatccgatgtgacacgctaaaactttacacacctggatctaaacaccccctaagtagagaatcgcttagttatttttatgcatttactatttacaaaattatttggcatatccgtgaatagtgtggatgactgacaaacctgacacacagccggataagctgcccaattgaggagcttctgtaccatagaaaaatacatgtcaccaattgcgacgagccaaaaaaattcaaaaaaccgaggaaaacgtgaacaaatttattgcccaagttgggtgaaaagttttatatgagaaggtcaacaaatttgttgcccaaattctaatgcctgctgttaatataaaatttaattcactgctaatttttttgtcacgaatttcatagtcaaaatagataggaaaaacaaaaagaaaatagaataaaagagaccaggagcccgtttgtgtgttaggaatttccagtaattcattaactcatgcatatataacactaccacaatagctatcctgcttcagttttgctggtaggaagaaaatggaaatattccaaaacactagaggggcagtgtattcgcgtcagattttcaaggtttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10211 - DNA, 773 bp, Oryza sativa
  unsure (1)..(773): unsure at all n locations
cgcgtgttgagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatatagttgccactgtaaatctataacttcactcttcttcagttgaaggctgagaagatgctctctgactgggagatggcgcagtatttggtgcctgaacttcttggttttgattaacctgaaaatgaatccatgaatgcattattttccaagcttatgcatatgcccatataagttgctacatttaaaactagtaatcttgggcccatacctcacttgttgggatgagcctagtaagggatggtggcagcctaaccaacaaattgtcctcgggatatttctctgccatatatgagaccataaaactaacttatgaaagcattgacattactggagctggttccttgttcattgattgctgatatattcagaaaccttccaccataatagtttgtaggagtaatggttggacccatgcctctaactctaccactatgatcctttccaaacatatctaacatagcttgttcaaaatcagcttcagtgagttggtgactatctactcttttctcagccaatttcatgtatacctcattctacattggaaaaatcatactcttagcatagtgtattttggtgtacaaacagttaaaaaaagatatgttagtaccattttttcttgagtagcatcagtaacatatctaccatcttttgtctn

SEQ ID NO: 10212 - DNA, 2042 bp, Oryza sativa
tcttgctctctttacgtccacgttcatttcatgcatagaagcgtccttgtgtacaatgccgcaactagggtccttcatataggggatatgcatgccctcaacaggtcctccacgtggacctagttagtgtataaatcattggtagtgcgtcacattgtcttgatgcgcagtgcaggtctgtatgcccgattcaataatatagatggtggtacagcttttcagtccggacatcaagcgccggtcacaccatccctcacccatgatagttcgcgctttggacactacggtcaaaccggcccactcttagggctccgagtattctatggagttttgagctgtctctccttctctaatcgtagctacctattttgggtagtttgacatgccctcgggccgatctgataacatatgtgaatctgcaagcatacaacatgtttttggccgaagaacaataattcagccagggaccatagttcatcgtaagggtcgcgactacccttaaatatttattggtggcccgcatccccttaccgccagcgaagatacaataccttcactggtgtgagcttaagagagccgcaagagaagatatcctatcttcgctggcggccttcttaagtagaccgctagcgaagatgtgtttccgctagcggcccttgaccccccaccctcaagattttctgcgctggcggtttttctacgtggccgccatgaaaaatattttccaaacgccatgaaaaatcaattttctagtagtgagtacaacactgcccatggtatgggagtgagctgcaccaggaatatgcatgcttggtttggttggtcagttaggatcatgcacaaaagaatggtacccacttccattatctaggaacaacaaggaatattcccatagcttctgtatttttggaaacgccaactcagtagaagctagaatgttgacatgtgggttcaagagtatttttgacatttcatgcggtttctctctcctattcaaccgaaaattattattttaatgagcgtggtgttcaccagcaaatatcacatatttgagagggtattctatcaaaagtcacttggcgcgatatcctacagcaaaaaccatgaaattgcgatgttctgtagtaaaatttgccatcatataaatacatatacgcggcctccgagagatcaaatgagaatccttaccgaaaaagttaaacatatgtgaacaatttcactcctatttttctcttagactcatccagatacgttaccggatccacttgttttttttcgtagtggaaatgaattggccacctggacgtgcatgatcaacgctgtgaatggtggttcgctcaaaacgagtggtgttggccggcacaccaaggccacacatttcccgaactctccttcgccaccaacagggatgctagaccagcggatctctgagcagcaacacatcaccattcgacacggcacgggcttactgctgttttcatggagctaatcgaggtacggtggtgctttgacgaggtgtgttggaaggtcttagatccaatgcttcattcttctgctgcttgttgtcaactgtttcacttttcctcttttgcaataggtgaccgctcgctgctcataactactttgttctagtatatcacaattcacaagtgaagcattgaagctacaatataatagtatattcggattagttttattgtagaacttcatgtcttttcctattatgtattttttattttatctcttatatatacccttgtaagtcgtatgggaagtggtgacgtcctcattgttactcctctatgtttgtaatcacactactacaaaacatcaaatatgtgccgccactataggtgccggtagtgctcataaaaccggcacctataggcattttcccatctccgcgggttgaaatcgtaaaaaaccggcaccattaagtaattataggtgtcggttctaataaaaaccagcacctattatattttgtatcgtttttttaaacacacgccccttttaatatttaaagggtgccggtttcctaa

SEQ ID NO: 10213 - DNA, 989 bp, Oryza sativa
  unsure (1)..(989): unsure at all n locations
ccacgaatgaggtcgcgggatccggcatcggcggcgggcagggtggcaagatccggcgtcggcgtccgttcccgcggcgtcggcgtccgttcccgcggcatcggcttctcccgtggggacggtgagcttctcccgtggagttgtgaaaaaatttagtgaaaaaggaattgatggctgtgattgatgttggtgaatagtttttgtgatcggtgaattgatgaatagtttttgtgattgatgaatgtttctgtgattcgagatttgtgattgatgaatgtttggttcacggggtgatttgtgatttgtgaatgagatttgtgattcgggttgattcacgggatagatgcgctcaatgcatcggctcgattcgagcctttttttttttttgctcggagtggtctcaaaggtgctagttttaaaaacgggattggtgccagctctctcaaaggtgctagtttttaaaaccctcttgggtgtccgttttcccaaccggcacttttcaactgttctgtggtagtgtcaacttctcaatagtgatcattgccggtcggtcagcgtccgtggtttttacccgcaaaggtttttcacacaaaattcgtgtctccgttatgcatctattttcttaacatctctcctaccataacctagaaacattacacattaattgtcttgaagaagccatgcatgttgcctgttctatatgcttgcaagatataataaatgaaaatttatgtgctatcgaaactgcacagttgtactggttgtcttctcgttcttggtgaaatgaaaatatgctcggttgtgacagccatcctaaaaacataacanagacgttcggaaagtctggctcgtgccgcatggaacggactcgctgtctgcatgcgttgagctcaaatcacgcatagccgaaaaaagactaccatgggcttttgaccaaaaaaatggattggaaagcatgttgaagaacaaatgcatggacaagatatatg

SEQ ID NO: 10214 - DNA, 722 bp, Oryza sativa
  unsure (1)..(722): unsure at all n locations
gatgtnccngtttgaatcatgacatcgctccccacccctgactgtcgagttccttatgacagcccgtcatgaccatccaaccggggctaaatatggaggaataccctccccaggaaattaacttaggattatatataggcgcggaggaatacccgtactgagctgtcaccatcagcggcccacctctcatccgcaatatataaccccaaataatgatatcccgtaatttaaacaccatctatactgattgattgattggttagtggatggttgaattgcatatccaaaagtgataataacgagaatgacatcggcgaaattgatggtgtagtggtggttcagtcagagcaaagtagcagtatagtagttgcgttgggattattgcatggaaagttactgggctgtggatggggtacacaggtctcttactgtcctcttgtgtttttccatgaaatcaatcgaactggtgcaatgcaatttggagttgatgtgacatttgctcaatttggataatcggccgtattatatactcgtccgtttattcaggacatcagaatcatgggctcatggcagcgggtacctgtactatgcaagtaacgagatggattctaatatgaataaaaagagcaatggcatggtgattatgttttttttttctagcagtacaaaattggtgtgcatgttgtgctctttacgtaagctctgataatagccntggnatn

SEQ ID NO: 10215 - DNA, 954 bp, Oryza sativa
agaatatgcctgggatgcatttgggattgctaatattgagctggctctcgcaaatcttttgtttcattttgattggactctccctgagggcactctccatagtgatttggatatgacgaaaacgatggggatcactgctaggaggaaggaagacctttatgtgcacgctattccatttgtacaactcccctaatcctagttgtttcgtgtcattagcttgttggttctcctcgcactactgtacttcgactcttggagaagaagaataaaaacacacatgccattttaatcctacagttttctttgtgtgtttagtggatttttttataggtcgtgcaccctctatcttataatataagagattatgccttttttttccaatgattaagaaagtatcaaaatgacaaatgaaagtacaaaagctaataattgatgaaataacactactacagaaaatggttttagtgccggttttcccaactgtcacaagggaggcggcactgatttgaaaatcaaaaaggtgttggttccttagaaccggcaccttttaggttcgatgaataaaaaaaaagccggctcgagctgacgcatctagccgagttgtccctccttctacatccgcaagaactcctcccacatccacaataactcctcccacatccacaagaacagaacaaattttgatccacaacattcatcccacaacattagaagatggatccatcccacaacattcatatcacaacacaaatttatgcaataaaaaaaaatcacaccgccgccgaagaagtgagagggggagggtagggagaggaggggtttgcttggcttggtggcttgccttgttgaagaagatccggccaccatttgaatcgttgtacgccttttgtttgtcgcttcgagccgttgaccatttcccgttgtaacgtttcttcgaagcctgtcggcccttcc

SEQ ID NO: 10216 - DNA, 7124 bp, Oryza sativa
  unsure (1)..(7124): unsure at all n locations
acgtgcttgatcccctngannccctcggtacccccttcatctccttcgagtcaccatcatcaattgcatctctgatagacggtcctccacttggtgcctacatctccttctgtgtcatcccttgactctcctctctctctctctctctctctctatatatatatatatatatagactattctctacacccccctcccatggatcaaacccacctcccccaccctccctagggcccgaaacccacctcccatcttagtcaaaagggcggtcaaagcatcctccaccggtcaaacccgcccactcaattccccccacgtccacctctttgttgtccttgtctcacaggaattatgcagtaacaagacgaccatcgtgcagtaacagggttacttctcgcagtaacaatattataacgttgtcaaaatatagcgatgatggatctagttttataaagctcttttttaaagcattatggtggaaacggttcaaaaatataatatgtgatgcgagagatatgattgtttaaagattagaatttcaaataatccatttgtgtttagtttgctactatgtatcatttgtgttgctcccttccctctacgcccacctctttggtgcactcgtctcgtaggaattgtgcggtaacaagatgaccatattatagtaacatgattactttcttgtagtaacaacattcgatagtctgtagaagtaccgttactactacatacatgctctgtgttactataattttcacgggatattactgtcaaagctgcagtaacaacctatatatttttgcagtaacaatctatatatttatatttttgcagtaacgttacatgatactgcacttttacaataatgttactattggaacattataacagattataagttccacaacaatataagtgatttgctctcacaaagtttaaatagagatatataaaactgaaacaacaaactctaatcacaagatgtcataaggtgaattagttaataaagcatttctttgaaccatgagtcatgggttcaagccttggttttgtcacttttaattagttttaaaattttctatccaatgtagatgggagagagatcgagagagaaaaaaaagggaggaaggggcgccaggagaggggagatggaagagagatcgagagagaaaggggggcgggatcaggaggtgggcctcgtggggtgggataagaggagggtgtagaatagagctatcatatatatatatatatatacatatatatatatatatgtatatatacatatatatatatatggggcaagtactccgagctttgatttttgcatggaaccgaaataccggcaaatgagtacgaaaaactcattatgctatattgtcgaagtcatctagctacgtaataccactgaaagaagatggggattgtagctaaaaagacagccaacagttgacaaccggaagtaaactccttgataatctcactcccgggcaggaccttccccatacctgaacctggcctgcttctcatcgttgaaactcgaaggcctcagctgccgcagttaatgtcagcatggcggcttttctgacctgcaacggaaattccaacacgcaacttcgaccgttcgacgtcgcggatcagttggtcaaataaggacgaaacacaccatatttcgtgctatcaatcatgataatttgaacagcaaaatagaaccaagttcacgcaactaacaggaacttttttcaaagtgtttgcagattatgacaggttaagaaacatctcctgttcagggtttaatctttcggttgggttatttgtatcggtggtggctgaaataccgaaattttggatatttggatctgaacttatatgaatttttaataaaatttgatcaaaattgaacaaaataataccaaattcacgaaaaaacaaaaaaaataaaaattccgatagaactgaaatttcgaaaatttcgtttcgcaattttaaaccctgctcctgttacgcaacgattacggcactcaggtactgtatgtttgaattactggttttaaatttagatgagaagtacagtgaagtggctagatcattaattagggctacaatcacagagagtgcatatagaaaaaaatagctagcaggcgatcacgaccggaacggctttgagagggacggccaggacgttggcggtggtgaacttctcgctcacgtcgagctgctccgccgacatgccgtccggcagccgccactcgaacgcgtgcagcagcgacgccatgatgaggggcagcacccgctccgccatcggcacgccggggcacagcctccgccccgacccgaacgggaggaacccgaagtccttccccctgaagtccatctcctccgtagcgcggctgcggcccacgaaccgctccggcacgaactcgtcgggccgctcccatgccgccgggtcgcgcatgatcgcccacgtgttgaagatcacggcgcagcccctgggcacctcgaatccgccgatctcgacgccgtcctccgcggccttgcgcggcagcatcacgggggccaccgggtgcagccgcatcgcctccttcagcacggcctggacgtacggcatccgcgccacgtcggcctcctcgaccgcttccctgccgccgagtgcggcgtcgatctccgcccgtgccttcgccatgacgcccgggttgcggagcagctcggccatcgcccacaccaccgtcagcgacatggtgtcgctcccggcggtgaagacgtcgaacaggatgttcgtcaggtactcccgcgcgatcttgcccgtggacatgagctccagcagcacgtcgaggaagtctccgcgcttgtccatggcggcgtcgtcctcggccgaccggcggtcgattatgtcgtccaggaccttgtagattttggccaggtgcccggatgtccagcgacgccacccttgcaggtcgaaccgacggaggaacgggaagaggtcggacacgttgggcttggctatggactcgatcagctcctccacgagctcccggaacccctgcgccgactcgccgcccacgtccaccacgtcggcggagaagagcgcgctggacaccaggttcagcacgccgccgtacacggcgtccttgacgtccacctcccgcccggcgcgcccgcggaggtacgccacgaggtccctcaccttgcgctcgtggacggcgcgcgccgcggcgagcgcgcgcggcgaaaaggcgtgcgccgccacgacgccgcgcagggtccgccacatcgggtccgcgctggggagccagatcatggaccggtcgcagaagcccagcgcgtggttggcgtccggcacggcgcgggcggcgaggcgccggtcgtgcgcggtgaacgcctcccttgcggcgcccggcgaggagatgaccacggccggggagaggcccagctggaggcgcatgacgggggcgccatgggcgcgggcaaggcgcgcgagcgtgtggtgaaggttcccgccacgcaggtccaggaggttgccgaggagtgggagcggccgggggccaggcggccaccggcgccgtcgggagcccaggcggtggctggtcaggtagaggtagcagaggagcgagacggcaagcgttgcccatagcacccagagttcgtgccccatttctgcggcggttaattcactctgtttgcgttcggcgtgagtgtcggagcctgcgtttgcgaattctgttacctgttgctgcatctacttatactagtttggtacccgtggcttgcaatacgaggaaaataccaaaacgtctacaaatccaaaaatcgagcgtttgtttctcctctttatacgagaatttttcaatacacgtgcgcatttagattggttttgaaacaaatttaaacaattagtttgatagaaaaacaaaaaactaacaaaagaaaagaaaactatgtttaaaattatctctgtgcatgtgaaggggcctttagcctagaggttacaagttacaagaggctcagtagcactatagtttccatattctccatgtgagcgaattttccaggatttagatttaacggctttgggatggatttgctggcccaatattcaaagatgctcatagaggtagggtttgcgcgtgtgcgtgcgttgtgagtgtatgcattgaactgtgtaattctaaaaaaatatatattctaatacataaacattataaatataaatagatacattaaaagttttgaagttgaatttaaattcaaattgttattggatatataaactttgagtatgtaaaccaaagtataaactttagtgtctaaacttaaaaaatgtagaataaacatgtgtgtgagttgaagcccaagcgcccgatatcccacctattggatttggcctgatatgagaagacaaaaagcccaaaaaaaagggtaaattggattcatgccattgtaaatatgtttttttaagttaaattttatggggagtaaaatgacaggtgttatccggtcaatatttcactcttatgttttttttattgtctacgatgcatgcgcgtgcatcagcttcgcatgggattattctcttggttgttatttaaatgttcagggaagaagagttaaaaggagctatatatatgacaagtactccgagctttgattattggaaccaaaataccggcaaatgagtacggaaaactcattatgcaatagtattatcaaagtcatctagctacgtagtacactagtactactcacagaaaatggggattgtagctaaaaagacagccaacacagtcgacaaccggaagttcttgacaatctcactcccggtcccggcaggtcctcccccatgcctgagcctggcctacttctcatcgttgaaactcggaggcctcagctgccggccgcagttaatgtcagcaagtcggcctttccgcgatctgcaacagaaagtccaacacgcaacttcgaccgttcgacggcgcgccccgcggcgaggctgcgatggtgagaaggcgtgcgccaccgcgatgccgcgcatggtcttccaaataagggcatgtttagttcccgacaagaaattttttaatgtaatattagatatttgatcggatatcgaaagaagtttgagatacaaataaaaaaactaatttcataactcgtctggaaagcagaagacgaatcttctgagcctaataatccatgtgggttgctatagcacttatggctaatcatggactaattagactcaaaagatttgtctcgtgattccctccccctcacagtgcaattagtttttttaatctatatctaatgctctatgcatgtgtcaaagattcgatgtgatgtttttgggaaaaaaattagggaactaaaccaggtctaatgcaccggtcacagaagctcagcacgcggttggcgtccgccacggcgcaggcggcgaggtgctggtcttgcacaatgaatgcctccttggcgactccttctggccactgacttttggtcggtggctgacatattggctcctacgacgttagggcaagtactatgggcatctaagtacaaagccccaagatgctacataggactaaatagtgaggtggagaagagaaaaaggattagagagaaatagtcacctctcatgcaaggggcagcccctacacaaacttcaataaatatgtgaaagtgttagagatattggggattgtgtggtagaggtaacctattatacatatcacctcttaatttaattatgtatgtcatgtatgaaattggatgtggtagtcacctctactataaaacttgcccttaaggatggtttggccacatttcaagtcggtttttagtatcacgtgggccctccaatccttctgctagtatgtgattagccgaaggttcattttcgttgtacggcgagtgtattttctccttaaattacttggatacatatattttttaaagttaatggtggaaataattagtaataaacccataccacttagttttattttatttttttataccggagttgacggttaaaatctgtacttaacgactgtcaacattcgggtccccaagcctaatcgttttcagggtccacctaatgaatgggtgatcacgtggagtcaaaatcggccacaccccaccagacactgcaactttcttctccctaccacgtgcacatttagatttgttttgaaacaaagttaaacaattagtttgatagaagaaataaaatactaactaaagaaaaaataactacgtttaaaaatatctgtgtgcataaacattataaatataaataaatacattgaattttttaatctgaatttaaattcaaattcgcattgggtatataaacttcgagtacgtgaactaaagcataaactttgggtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcattatgctatattgtcgaagtcatctagctacgtgataccactgaaagaagatggggattgtagctaaaaagacagccaacagttgacaaccggaagtaaactccttgataatctcactcccgggcaggaccttccccatacctgaacctggcctgcttctcatcgttgaaactcgaaggcctcagctgccgcagttaatgtcagcatggcggcttttctgacctgcaacggaaattccaacacgcaacttcgaccgttcgacgtcgcggatcagttggtcaaataaggacgaaacacaccatatttcgtgctatcaatcatgataatttgaacagcaaaatagaaccaagttcacgcaactaacaggaacttttttcaaagtgtttgcagattatgacaggttaagaaacatctcctgttcagggtttaatctttcggttgggttatttgtatcggtggtggcttgaataccgaaattttggatatttggatctgaacttatatgaaattttaaataaatttgatcaaaattgaacaaaattatacaaattcacgaaaaaccaaaaaaaataaaatttcgatagaacttggatttccaaaaatttcggttcgcaattttaaaccctgcttctggtaccccacg

SEQ ID NO: 10217 - DNA, 3646 bp, Oryza sativa
  unsure (1)..(3646): unsure at all n locations
agagcgtttatattgacccattcgcgttggtccagcagccncgactcttttangttgtctccatcacagacggcagaatgcanctacctaagcctcaaggtcaaaactagtgattttatgtattttcttacatgtgctactatatttatgtgttggggttctacaatagatgctgacttatcagaatatgactatcatttttttccacaattgcaatgtggctttttttgacgcaattcacaatcgggctgttggcaacttttttgacaagttgacaagcacgatcacagcagcttaaaccttgcggtgatcctagagtcgtcaaccacctcgatctagcaaaaggctaaacctaaatgggttttgataactaaaccgtctagcggagccgatttctagataactacccgtctcgtgggcaaaacggaagattttcaggacaaacctacaaagagatgtcgcactctcgcaacggcgacggacggtttacagcgcaaaccagtaaagatggacaaactaagagaaaaactaaaagcaatatgaaaacacgattcgattgattgatagtagattatttttttacaatgaaccggccatgtcccttatataggggttggtcttgccctctacaggccctcctccatgtccaactcggggtagaaaccaaaggaaacccgaaacatgtcttcccgagcaaggaaaccccaagacccgacgaaacacaatcggactcggtcctgccggtcagaccggccgcataccgccggtctgaccagccctcaaccggcggtctgaccgcctaacacacggcggtcagaccggcccactcggaggaaaccggtagacttccaaattttggcaatctttcctactttaatcctaggtgccaaatttgggtgtaaacacatgcccccctgcctttttgatgaacaacgtgaatctaaaagcatagaacatgtttttggtcttaggacgataatccaattaccggccatagtacctcctaagcgtcttgccaaacgctcaggaattatttcttcaagtatttcccgttgattgctcgctgaaaacactccccttgaagagtctccaaaaaatatgcgtttcctcgaacaatgccgcatactcgataaggaccctcccaactaggagaccacttaccgaactccttggatcgagtacccaaaggcaaaattgtcttccaatccaaatctccaacttgaaacaactttgcttttacccttttgttgtacgccttggccaccttcttcttctctttctctatttcttccaatgccttcaagcgcttgtcgatgacttcatcaagattgtctcccatcaacgccttgtaatcctcacttgacaaatcatcttgcttgatataacgaagagaaccaagatttacctccaccggtaaaacgacttcttgaccataaaccaactcaaaaggagtgactttagtagcaccatgtttagatatcctatgcgcccacaatgcttcagaaagcacctcatgccacctctttgggtattcctcaatcttctttttcactaacttcaaaaacgttttattactcgactcggcttgtccattagcctgagcgtagtaaggagaagaactcaacaatttaacaccataagattcggcaaaactcttcacttccttagacataaaagaagcaccttgatccgtagttaatgtttgtggaataccgaatctatgaataatatgcttcaaaataaagtcaattacctccatatgagtcatattcttcaacggcacggcttcggcccacttggtgaagtaatccgtagcaactagcacgaacctatgcccctttgatgacgaaggataaatttgaccaatgaaatctaaagcccaccctcggaacggccatggtttgattatagggttcaacacggcggcgggcgccaattgaacattgccgaaccgttgacaagcctcgcatcctctataatatttgaagcaatcatcaatcatcttcggccaatagaaccccgctctcctaagcaaccaattcatcttgtgggccgattgatgagttctacaaatttcttcatgtacctctcccatagccactctagattaatcttcatctaagcactttaacaagacatcatctatatttcggcgatacaaatctccatcaagcaatgtatatttgaacgcttgccgccgaattttccgaacaaccttaagtgtaggatctttcaaatatcgaatcaaaggaattctccaatcctcttctgtttcctgggcacaaatgtctgaattcacaattaattcggcctccaaattgatcgaaacgtgccccccagcgctctgcccagaaccggttgttgccggtcagaccgctcggggtcgccggtcagaccggcggcatgcggccggtcggaccgcccctggtcactggtcagaccggccgtgcaatgccagtcagaccgcccctggtctccagttttgccaatttcacataaagatttaaaaccaagcaccggctcttctaatattagaaataatcccttcttcatattatagccagatgcttgttgtgccaagtcatttgctctagaattatcatgcctagtaatatgtctgatagcaaaattatcaaaattggcaataatatctaaacatgaatcgaagtacctatttagtgatccgtccaagcatttgtagactccgacgacttgttgcaccaccaattccgaatcaccaaaagcctccacgtatttagctccaaccatctccataacttgtaagccgaataataaagcattgtattcggcttgattatttgtacaataatactccaaacgaaccgatgcctcataacacatgccattaggtgaaaataaaactacccctatgccttgaccttctttccaagaagaaccatcaaaataaattctccaaggtataacttcaactaagcaaacctccccctcataagcaatatctatatgatggtctactataaaatcacatacaatttggcctttcatagatttcaatggttcataagtcaaataatattctatcagagcatatgcccacttgccaattctcccacttagaattggcctttgcaacatgtgtttaataacatcggcttgacaagtaactatgcatgtactagataacaaataatgcctcaatttggtacaagcatagtataagcatagacaaagtctctctataaagacatacctcgtttcggcatccaaaagacggcggctcaaatatgtaatgatatattccttgccatcttcctgttgcgtcaaaacggcaccaatgactttgtcttcggaggcaatatataaccgaaacggctttccggctttaggcgctcacacaacgagtggagtagacaaatantctcttcaactcttcanaatgccnccttccttttttgggttttttgggggttttttttttttttgggggcccccccccccccagtaaaatcggcttttttttcaaacaaagtataggaacaaaagcatcgattttacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10218 - DNA, 3072 bp, Oryza sativa
  unsure (1)..(3072): unsure at all n locations
gtcgccagtataattatgatgattataaatatgttcatgtatnttatgcgttatctaaatttntngntataatatatctcgttctgtttaatgtcgctttntttttcnnnnncctcccnnaaggcgtgttgtgattgcataacgnccaacnncagccnncagnnnacnatagaggagccccaaaatgactgctctgattatgcccatggggagctcgaagtgcaggctttcttctgcttggagccggaggaggacgtcgatgaggggctcctcgcgggctgcggcctgacacgacctctacttctcgaggtgctccctgatgactcggtccatgaactccatgagggactcgacgaacgcctccgccctgcgcagcgttgtgctgataatcgcccgcgccagcctagactacgggaacaggtcggccatggtgaggctgcccgccagccgcaccggctcgtcgacgtaccggagcagggcgtcgcgctcccggaaccgctcgcccatcacgatgtgcaccgtcgtgtccgtgacgtagttgccgaggagctcgctcagattcgtcacgagcggcggcgaggcgacgccgatggcccggacgagccgcgccgtctcctcctcgcggatggcgcggaacgccaggatgcgcctggggctcagcagctcgaggcggcagatcttgcgcacctgccgccagtgctcgccgtagggcgcgaacgtgatgcccgcgccgcgcctggtgcacaccttcaccacggcgctcagcggccgcgacgagaagttgtcgtcgtgcgtccgcaggatctctctggccgcgccggccgtggacgcgacgacgaccacaggggcgtcgccgaaggcgaggagcatgagggggccgtggcggcgggccaggtcgcgcagcgcgcggtgcgggagcgcgccgaagaacaggtggtggaggctgccgatgagcgggaggcgccatggcccaggaggtagccgcaggtcgctgtcgcgtgagccatggaggaagagcgtgatgaggtagtgtagaagaggaagaagagctagcaagcagcagaacacagctgcgtccatgattgagcaatccgagctgtgtgattagtttgtgattaggtgatcccctgctgctcattttctattgttagctgaagttgacttaagagcatcgcattattgttggtgggaatattaatctatcgatcgttggaatactaggggcgccacatcagcttgctttggaaaattaaaacgcacatactccctccgttttaaaatgtttgacaccgttaactttttagcatatgtttgaccgtttgtcttattaaaaaatttgtgaaatatgtaaaactatatgtgtacatgaaagtatatttaacaataaatcaaatgatatgaaaagaataaataattacttaaattttttgaataagatgaatgttcaaacacgtactaaaaagtcaacggtgtcaaacattttgaaacggagggagaatatttaacaaccaccgtggagcttgtgtttttattgactcactaatggttctccaaatgcgttgtatttcgtctactacttcctccaggttgataatacttgtcgttttagataagagcatggtctctaaaagacaactattttctattataatgtatatagaaatatcaacaaatatatgattttattaaagtacttttcaagactaatcacgcatatgatttccatatttttaagataactattttaaaaattatttatagtcaaatattttaaagtttgactttacccttattcaaaatgactaatatttattagtctggggtggaaaatttgggcccatggttttcgtcgtgcaactggtctttttttttgttacaaatagtaatagattcgtaactgaatttggagcttgtttgatccgttgtcttgaaatattttaactttatcaaattacggtgattttggaaactagtactctaaacactgtcaaggtacttaaatagtactcccttcgtccctaaatatttaaagttgttgactttttacagagtaaatttcactttgggctagttttaatagccaaagtttcactatggaccaggcctacgcccatatttttacataacaccaggtaatattatcttccgttgcactttggatcaagctgcactaatttgggccaccacgtcatcttcagcccaatccacgtgagcagcaggctggtggactcagttcacggaagaatcatatggagccgccgatacacgatgcgtataaaactagcgccagcctcctctgcttgagagaaaactagcgcaacacaaggttgggcgccccggcgctgccgcgagccccgctgccgtcgtcgccgtggctaccgcgtccgccatcgccactgttnnngccncgtccgccaccatcgccgtcgctgtcgtcgtcgccgcggccgccaccgtcttcatcgccgtcgccgaggggactacacaagctcgcataatgggagcactactcagcagccatcatgtgatctagtttaccacccttaatccatctctaatgtcaactttagtgatttccggtgaattgacaccttaaccaggttgcagtagcagtggaatcgagcaacaagaattggtcgaatcgatatgggagttcgcttcaatatatatatttttagaaaatcatgaactgtagttaagagaccgatcatcttaagctaacatacgagtttttttaaacagatttcttatatgattacttctgtattaccgaaagtgaacgatcttagaaaccgactcaaatacggatatgtatttctaaaagtaaacgaacttaaaaaccgactcatacacgaatgacataccaaaatactggtaaaaacatttttaatttttataatagtagagatttggtcaaacctaaaagttttgactaagtaaaaagtcaaacggcttatataatatgaaacggagaagtattaattaatgtgcatgtatataaaacagccataggccatgtaacgagggataggattgatttttgtagctgttgcgcacccaaaactaacagat

SEQ ID NO: 10219 - DNA, 10072 bp, Oryza sativa
  unsure (1)..(10072): unsure at all n locations
ctggctccnattgatttgagtattccttctcggtacccccatttatatgttgactttatgatgggctaatagtaggaagtagggttgaaactggttcggatagtttccgtccgttcggaccatttttgggattcggatagtttcggtcagaactatccggaaattttcggattcggaaacgaattcggatattttttttcagaaacaaaaacgaatacagtatgggtaccgtactatctgtcggaatcggaaaatggtcggaaactatccggaatttttttcggttatccgcagacattgagcaaattttagaaaaaacacgtatatatacataacttcttcatacagaatctgatgaagacaaactttatatcaacattgtagagctcgatgagatctacaactttattattgactattttattatttgaggatatttaagggtctaaatattcattacaatataccatattaatttttacaaaatctaagatctacaattcaaacgacatctgatggagattgtcagggttatggataccacatacctaatagtagttgactaaatctcagcaggacccaccacataccatgtctaatacggaaactgacctcgagggagttccggataaggaaagacaaccagggttctacatggaaacgacaaggactactcggattgtatccatatttgtttccctagttctacttgaacaaggggacacctatgggtataaatacaagaccccctaggaggagaggggacacgatcacctcaatcaacatacacggaacaacagaagccacaacatacaagccaacatacgccaagacaagacgccggatatcgacttcaaggataggcacggctagttccctacggtgtctccggatactgtcaggagagacgaaagtgctatctttgatctcgccaggcacggattcgaggaggaagactatcctgttgtcgactacgagtcagaccttcagaccgccatgtcgacaacagttagataggctaccccaaaatattgtactggtgtgattatgatgaataagagcaacgaccggcttcggccaacaggatgtagggttattacctgacaattcagggcccgaacctgtataaaaatccctgtctctgtctcttttaccttagtctcgcgtatactctagtaccaacgatccccatactatgcaaataccagaattgcgacatcaaatgttgacagagatgtgttccatatcaaagttgtagagctcaacgggatctaccactttgtagtttataatatttgtatttgaaagcatttaaagtataaaacaaacattacaaatttcgaagatgtgaaataaaataaataacatctccaattcatacaatggtaagtaagttatacatctagtaaaaggtcttgggaatagaaaatgataatcatatttgcatatgaatctcttagaggaacatccatgaaaatagattttcacatatggttgtaggaccgtctacattgacgatacaaatgttggagatgttgaactaaaataataagcgatatctcttccttgatcaagaaactcaatttgagggggtttttatataccggtaaatattcgctaccgtattcgttccgtctcgtattcgccctgtatctgtattcgataatattcgatttcatttccgtatccgagttttcgattctgattccaattccaaaaaaaatatgaaaacgaatatgataaagctagtttccgtctgtttccgatctgttttcatccctagtaggaagtgagctctactattatccttgctctaatggctacaacagatgaccaaatccttactagaggagagcagccgagcggccacactgagcaacacaggtgaaatcctgattaggccgaccatatccaaatcagggcagtgctgtagccagggggagggagggctgccatctactgagtgggtggtggcgctagaaccctcgtggcgtcagcttcgcgccctagcgcgtgacttcccgcgcggttcttctcaccgtaaacagagtccaccagccgctgctcacgtggtttgggctgaagacgacgtggtggcccaaatctgtgaaacccggttcaaagtgcaatggaaggtaatattacccggtgttatgtgaaaatatgggcctcggcctggtccatagtgaaactttggctattaaatctggctcaaagtgaaatttactcttgaagagtatgtttgaccgttcgtcttattcaaaaaaaatttaagtaattattaatatttttcctatcatttgattcattgttaaatatactactactacttaaatatcacaaaattttgaataagacgaacggttaaatatatttaaaaaagttaatggcatcaaatatttagaaatggagggagtagtattttgtgccacaagcagctctatgataaaaatagaacggagatgctcaacaaagataaccgaacacaacgcatgctgatacatggcacggccgcatgcccttgggccgtgcatggcatggagttggcccgtgcagattgacgttgacaattaacatagtcattaaagcagcaaaggggaccggtatcaagtgaaagacgaacagttggaggctcgacatgaaggggtacgtaatcacaaaattagaagatgaaactattgttctttttttgacacgccaccaacacgaaacggatccacctaaagctttgcagtgttaatagagttgccaaccacctcaaccttgagaaacctgctaatcaaggtgggtttaccagatcaaaatcggctagcggagctgatttagataaattgggataaacacccgtgtcatgggtggaatggaagatttataggacaaatctacaaagaggatttgcacttttacggtgaagataggtggctttcagcttaaatcgacgaagatgaacgagctagactataaacacaaaaaaaatgcaaaactgaaaaaagattcaattggctaattgcgttgattgtacattggtttcttaaattggacgagctatggcatttatgaaggaattggtcttgccttctaaaaaaaaggaattggtcctactaggtctagaaatcagttaggactcgacaaacatcaaactcaatgacggaacccgagaaattttaaattagactcaagtcgaactctgctgatcagaccgatcacctgttgtgggtcagactagacttgcgcaaaaagcttaggtattttctaaatctaaccacatttcccttttttgtttgtttagatgccaaatctgagtcctaaccgaaacaacgattaattgcctagagtattttattagtttaatgttttatttatgagctagtcagctagtgggtgattgctaggccaatattcatatagtggtttttggggtctgagtcgacttgtgttgtagctaggcagaccggcctactcatataaaatcgttgctatggcgcagtccaatgtgtggacaggaacatttcaatccaactattatgaagaaaacattaaaaaaaagcctgataatcctcaacgtcgggcgcccgatcggccggcccgcacgcgccgctgccacgtggccccatcacgtgtgtccgtatgccgccacgcgtacacggacaatttgttttagctagtatacttgtgatgttgcactaagtatagatcaaattttgcagtgaattgaaacattcttgtgcaacaaatcacccatatatttaggaaaccctctattaagggaatttgtttcaatttttgttccacaaaaaatgtttcacctagtgtactcataatgtttcactatgtatagatctaatgttgcagtgaattaaaacattcttccgctatttgctgaaacattgtctttatataaggtgaaacagcgcccgatttaaacgattgaaacattttcgatctacttagtgaaacaatccgatatacttggtggaacaacgtgcaacatttataaataattcaataataagataattttcttttatcagaatataaccatgtgtggtcttgttttaaagatttaattacaacgaatttaatggtgcaatcggatcatgatttggataaataatttaagagaaaaaaattgtttaaagtggttttgcacgcatgtgtcatgctgacgtcgtgctgatatcagcatgacatgggcgcctgattttcccaccccgggatcgggcgcccgtgtttatacccaaatttggcatttaggattaaagtaggaaagattgccaaactttggaagtctaccggtttcctccgagtgggccggtctgatcgccgtgtgttgggcagtcagaccgccggttgagggccggtcagaccggcggtatgcggccggtctgaccggtaggaccgagtccgattttgtttcgtcgggtctcggggtttccttgctcgggaaggcatgtttcgggttttctttggtttctaccccgagttggacgtggaggagggcctgtagagggcaagaccaacccctatatatgggacatggccggttcattgtaaaaaaacaatctactatcaatcaatcgaatcgttttttcatattgcttttagttttctcttagtttgtctatctttgccggtttgcgctgtaaaccgtccaccgccgctgcgagagtgcgacatctttttgtaggtttgtcctgaaaatcttctgttttcaggattaaggtgctgcgatcgtgcttgtcaacttgtcaaaaaagttgccaacacgatttttggcgactccgctggggaaaagatccgttcatcgtcaactcgacttcgatttcgccatgacgaagccgccatccaagacggaggtggagccatccaatgtgataacggtcacattggatgacctcgaatgagaagatcgtaaagctatggaggagtacatcaacgagctcacacgggaggtgttgatgagagcaagcactaggactcatcaaggcgtgaccatcaagcccaggccatgtcccaagctcgctcccgacttggtaagtaatgatgaggtatcacaatctatccaacaacaaattgcatctacaatagattcatctatggttgcttttaaagatcagttagatgcaatttttaagggtaaatttgatgagtttttaaggattaaattcggccctcttatggacgattacacattaaaggataaagcctctaccactgctaaccaacctcctatagatgaaacgggtagtaaaaccgacggaacggcgttcacggccggtccgaccgggcctgacggccggtcagaccgcgacacagccgtcggtccgaccggccagacggccggtcggaccgggtatcaccctggcggtcaaaccgggactcaggccggtccgaccgcacctctgaacgccggtcagaccggcgcaattattccgatacagggaatagatccgatgactaatgctagttatttgtatcactttagaacattcgatcctcctgtatctactgctacaagtagtccccaagttcccccacatgttcctaatgcttataatgatgtttctaggggtatcctcccgataccagacaaggccaatataatcatattgtgccacaaacacaacctattaggccaccaaatccaccgccaaatcaacaagggcctaataacatggaggatataattagtgatattattaagaatagattcgggattgaaactaggaatcgtgctagaacttacaaaaaaccgtatcctgattattatgataatgtgccgtttcctcgcaattatagagttcccgaatttgccaagtttagtggtgaggatggtaagaccacatgggagcatgtaggtcaatttttggcgcaatgtggtgaggctaatagtgatacttttaaattgcgcttgttttctttatctttgtccgataatgcttttacatggtttacttctttataggcaaattctattcatacttggactcaattagaagaaaaattccatgattatttctatactggagaaactgagcttaggtcatgtgatttaacatcggttaagcaaaagtataatgaatctgtcattgattatattaagagatttagagatgttagaaaccgatgttatactttgaatataactgatagagatttggctggtcttgcttttaatggtttaattgctcctcttagagaaagactagatggccaacaatttcttgatgttagtcaactcatgcaaagggctctggctcaagaaagccgggttaaggataatagaaaacttgctagaccatttgacaaaaagcctaatgttaatgtggttgattactctgaggctagtgatagtgaggaagagggtgatcatgatatttatattgccgaatggtcatggactaataaaaataagccttttgtttgctctaacctaatgccgactcctcgcaaagatcgacaaagtgaggttaaatatagttttgatgtggccaagtgtgataagattttttattatcttttgcaagagaaacaaattagattacctaaaggccatgtcataccatctcaagaagagttgaaacgtcgagcatattgtaaatggcatgattctcattctcattctactaatgattgcaatgtgtttcgacgataggttcaatcggccatagatgaaggacgattgaagttcaccgatagctccaagataaagcttgatcatgatccttttccggtgaatacaattaatttcaatgataagaaggtgttgattcggccggagcaagccgaatctactaagggaaaggaactggtcattggttaaccgaggcctaagatggtagtgccaaagaagccggaggttggcgtttggaaggagaataaaagtggagcttcaacttctaaggcccctaggaagaccaaagtaacttttgatatgcttttggagaagtatgagaagcaaggtagtgagagaggtcgcaacaaagggaaaagaccaagatcacctcctagggagcaatttggtcattcatcaagacggtcgtattcaccttcatatcatcatccacaagacatgtcatggggttcttatccaatgccgccgccgggttatccttatccttacttcatgccatggggggcaacgccgccaatgtttaatcatatgcctccaatgcaattcaaccaagggtggggaggaccaaggaggccgattcatgagcgtttgtcttcaccaaacaatagccggttttatggtaagaatcaggctaatgaagaaaagagggaaggaaagcgcgtcaaggtggagacgaggacttcggaggtaattactatcaaagtggggtttcatgatgtgccaatacctactggagatggagttggagtgtccccgaacaaaaaatccgaagccggtaccagctcctcgcagtcagccggtcaatccaggccttctagccggtctgaccgcagtcatgcgaccggtctgaccgagccatcaggccggtctgaccgtgctccggatgtcggtctgaccggcgcgtctggccggtctgaccagtggtctatggctggcctgaccgggctccagcgccggtttgacaggaggattgcaaagggcgatgtggaagcttcatcgtcttcaaacaaagttaatacagggcattatttacctcctggaacagagccgaatcctaggtggatgcctaaggatttgatggcaactcaaaagagaaggttgcaacgtcttcgggcccaagagctaagagagaaaaaggccgaagagcaaagggataaaaggtttaataagttgcgaccaccaccggtatggaggcctaaatccatagagaaggcaaaaccgattgatgtagaggagaaggaagaacaatcggtagataaaggtgaatcatctccaaaagaagacatggatatcaacatggtatgtatgttgcctatggagttttgtgctatggatgaagccgaggttgctcaattctcattaggtcctaaagatgcggtttttgagaagcccaatgaatcaaaccgtcacatgaagcctctctatctcaaaggccatgttgatgggaagccggtctctaggatgctagtggatggaggtgccgctgtgaacttgatgccgtactcattattcaagaaattggggtgtgaggatgatgagttgaagaagaccaacatgattctcaatggcttcaatggtgaaccaacggaggcgaaaggtatctttttggcggagctcaccgtgggaaacaagacgttaccaaccgctttcttcatcgtcgatgtgcaaggtaactacaatgttattttgggtcgttgttggatccatgccaattgttgtgtgccttctaccttgcatcaatgtttaattcaatgggacggagatgatgttgaaattgttcaagcggatacatcggccgaggttgcaatggccgatgctacttttgagtagcatcatgggaatatccaatgcttatcggggagggatctttctagctatgattttattagtatctccgatggcaaatttgtacctatctctgtaaagccggctagtgtggcacggctaagccatataaatttgtataatgagtaaagaggctaatttagagtggttacaaaagagggtgcaagaatatcggtctacaaagaacgatattggtgaannnnnnnnnnnnnnnnnnnnntggagaagcttggaaaaggatttacatcagctgatccattagaggaagtagacataggtgatggaaccaaaccaaagccgacttttgtaaacaaaaatatgagagccgattataaggttaagataatcgagctacttaaaaaatatgttgattgctttgcatgggaatatcatgagatgtggggtcttagccgtgagcttgttgagcatcggcttccaattaaaccgggttttaggccttataagcaaccacctcgtcgttttaatcctttgctatatgaccgagtcaaagaggagattgatcggttgttgaaggcggggtttattaggccatgtcgttatacagagtgggtttctagcatagtcccggtggagaagaaggggagtggtaagattagagtttgcatagattttagatatttaaataaagccactcccaaagatgagtatcctatgcctatagccgacatgatgattaatgatgcctcgggtcataaggtgattagctttctagatggtaatgccggctacaatcaaatctttatggcggaggaggatatgtacaagacggcttttaggtgcccgggatttgttggtttgtttgagtgggttgtcataacttttgggttgaagaatgccggtgcaacatatcaaagggcaatgaatttaatctttcatgatttggtaggtattatcttagagatctacattgatgatattgttgtcaaatcggatggtatggaaggacacatagccgatttgaggttagcttttgagaggatgcgccggtatggtttgaagatgaactcacttaaatgtgcttttggtgtgtcggcggggaagttcttaggattcatggtgcatgagagaggagttgagattgatcctaagaagatagaaaatattcgtgatttcaaagcgccgacatgcaagaaggaggttcaaaagttgctaggtaaagtgaattatttgaggaggtttatttctaacctagcgggtaaaatcgatgcttttgttcctatactttgtttgaaaaaagaagccgattttacctggggggcaaaacaacaagaggcatttgaagagttgaagagatatttgtctactccactcgttgtgtgagcgcctaaagccggaaagccgtttcggttatatattgcctccgaagacaaagtcattggtgccgttttgacccaacaggaagatgccaaggaatatatcctcacatatttgagccgccgtcttttgaatgccgaaacgaggtatgtctttatagagagactttgtctatgcttatactatgctggggggatcctctaaagtcgacgtgcnggcntgcaagcatgcggttatgatgagtnttcaatngnccat

SEQ ID NO: 10220 - DNA, 9145 bp, Oryza sativa
  unsure (1)..(9145): unsure at all n locations
gacgtgtaggttagacaatcatgcngcacgccngcaggtcgactctagaggatccccctgctgcccatctgcctctggtccggtgccatcatctccatggccatctctctcgccgccgccgacctctcacctgcatacatcatctgtgactgcatgccggcctgctctatattggaacaacctacctgtatgaacaaacaaactcctcaattgatatgcaaactatccctcccctacaatgctaacaaagcgagtgaagctactgatctttaagctagctggtacatgcagtgcagcaaggaactcaatctacaacatgtgtagtagtgagctatagttagtgatggagaatcatcaaatatgtatcagtctcagaaattcagaacggtctctggctgcctaactacctatatactatgtagctaaatgcagcattaagaatggtccattattccatgcatggattgcattgctcaaggggagtatgaaggaaggaaggaagtggagtcagaatatatgcttcgggagatatttcaattcagctgagaaaaaaagcgactttgcatgggatctatacttgttctacctatctggtctaggaagaggaatagatggaagcacaaaagcatgcagtcgactcgatcttgagtcgtcgtctatctgtctgatctatacaacggcagttaatcccctgttttgtgcttactagtcgtcaaccgatgcgttgcacggtctattagtattgacagtaaaaatttaaattctaattaaatgtgtggtttgccttttgaaattatagatactcaaattaaaaaaagtccacgtcaattacaacttcttaataataattaaaacactaaaattgagagtgcaagatgggcacgatattatatttataaattataaattttagaattactaaattgaaatccgtgctatttctaattgcatgactatcaacacagtctacaatcgtattaatgtgatccatgaaattaacatgtgttgagtgcgctattattattcatattataaacaacaattttttataaacagagctcggataaattagatatgaattttcatattacatacagagcttggatgaattagatatgaattttaaaagttttaataacaatttgctatcagcaaaattaaaataaacgatttattgcgcaacaaaggagagcgctgatgttagcgaggggatggaccgtcgccgacatgcgggtcctacctgtcggtgactcaaggcaagcgagtccacggtggaccgagtccacaggacagggggcgattgtaccacgtgactacacgtgtcacacacgtggcgccaacgaggcagccagccgtcccgaccgagaggcgatggccaagcgcgtagcccgatggtcatcgtcggcggaggggcggcacaaagcagcggtggcaacgaggagatgcggcgaggcggtggcgcacacacggcaaaacaaagtggaggaggagggggcctcaccgacggtggtgacgaccggtggcgaaggacgacgacgaggatggtggccctaggtagggaaaaagaggactagatagggaagataaaggagaaaaggaggccggcggcgagaacatgaatggcggctcaccgccgagggggtgacggcgagatccggcggcgatcggtggtcatgaaccggcggacgaggcggcccacaatgatgcgaacccaatggcggtgttggcttgccgaggcgcggtggctagcaatggcaagcggcggccagagcaatggagatggcggcggtggctagggcgacagcgcggcgacgacctaggcatgggagcgagcagggagcgagcgaaaagagagaggagggtacgagtaggggtggaaacgagtcgagccaagcctggctcgactcagcttgcaggggtcacaacaaactaggcttggcttggcttggctcggctcagttagggaaacaagctaaaacttgagcttggctcaagccagctcgagctggcttgcaagcctttatgttgaaacacctcttcatatatatatatatatattgtaattattaaaaatagtaagaacaaattatcaacatgtacaatttaaataagtttctatattcaattcttcacaatcttaatgataaatttcaagttgacaaataataacgccataaaaagtaaaatagtcgatataaatacatgatggcttaggctcgcgagacaaaacaagcggctcgcgagccagttcggctcggctcatttcagcaacgagctgaaaaggaagcttgggcttggctcatttggcttacgagccgagccaagccaagccaaccaagctcgagccaagcccgagctaagtttacgagcccgggctttttttccacccctaggtacggggatgctttttatagcggtggggagtgcagtttgcggtggatttagcggcggccggcggttaggatagggtttaatcccagtcgcataggagggggtttcagcgcgggagatgcaggggagggaagccgagttggttagggacttggagagggacatggcgcggcggggcggcgcatgactgaggaggcggcggctagggcagccggccggaggaaggggacgggcccgacaggtgggccccacctgtcggtgacccgaccactgtcgagcgtgggcgagctgcggccttgggctggcctagcaaaggcgtgcgcgctccagggagagaaatgggggagtgggccggaaactgccgacggccgaagagagagaggaatgaattttcttaattaaactaaatcctgtgaattggtgtgacttattaaaattatttctttgctatgtaaattccgctaaaaatacgcaaattccgctaaaaatacagttagcgtatttaaacatggggaactcaagaaaaattctaccatactaattcctcttattatatgcatttaataattagggttaactccaaattaacttaaataatttcgcggagcgatttcttaatgaattagaaactagagaaaaagggaaaacttccgggtgtgacagagaaggggtaagtagttgtatattttaatagctatggaattgtaatagtatttcaaatggttaaaaagtaatgatattttttaagactgtgaaaattgtaatggcatgatctaattaatccatatttaacacccaccaactatttaaaataccaagtgtttaaccgtgttttagagaaagcaaaggtgtataaaatggacttgtcaaaaaagttgtgatggccatacgtaaacttaaacctccaatcagaatgggctgggattttgatcggcctcaccaaatggggccttcttcttcttgcttttttttttgaactaaaagggttcttcttttgtgtctttttctttttgagaacacccttcttttgtgtccataccctgaacaagacaaaaacttttcactcatcacatcgaatgtttagacacatgtatggagtattaaatgtggacaagaaaaagcatggagtattaaatgtggacaagaaaagctaattacacagattgcgtgtaaattgcgagacgaatcgtttaagcctaattgctccatgatttgataatatggtactacagtaaacatttgctaatgatggattaattaggcttaataaattcgtttcacagtttcctgacggaatctgtaatttgttttgttattaaactacgtttaatatttcaaatgcgtgtccgtatatccgacgtgataactaaatctaaaatatttccccaactaaacaaggcccgagttggcatccaacgtataaaagaaatccaacgtggcccctaccccgggaggacagagccattgaagggaggagtgccattccgctccgccgccgcctctggcttctgcggcgcttgcgatcgaggtctacctagccggacggacgcgccgcgctgatcgcggatgggcggccgggcgcgcgcgccaccggaatggcgtacaatcagcgctccagaaatcagacaacaggtttcgtgaatcgtaaatccttctctccagcgtctttcctggattaattaactcgagaaaattgggtatcgcacgaccgggcaatgtacgtattcattaattccttgtacgttggtagataaggtttctacagccgtatgtagaaaagaagatgaagcgggtagagcttgccagttgccacatcgtcgggtcgtaagtcgtaacccctagtcagtgccagaaatcgaaccgacagtaaacattcagaactgataatatggtcatcacagctaggttaagaatcggcactgatggttcccacaagacaaaaaataaaaaagggcagctcgatcaatccgttgattcattgaacctattcttcgagtggtcaactgaacctcaggtctcccgagatcccccaatcaacatagacaagtagacaaatatgacatatccaattaagatcaacatcactaatactccctccttccctaaatatttgacaccgttgacttttttaaacatatttgatcgttcgttttattcaaaaacttttgtgatatgtgtaaaactatatgtatacataaaagtatatttaacaataaatcaaatgatagaaaaagaattaacaattacttaaattttttgaataagacgaatagtcaaacatttttaaaaaagtcaacggcgtcaaatattttgggatggaggtagtatatcgcatcaccaacacatcatcgacatgttcattaaaaaaaaattcatcaagtcgactaagacccattaataaatataaatagatcgcatgcatgtttatctaacagatggagaaaaaaaatcaggaatcaacaaatgattaaaagtaaagcacatgtcacggcaggaatatataatcgtactcggagtaggcactgtgggtgcagtggtcctcggggatgtgggcagcctccatccctgatgcattcaacgccatagcggccaggaggaggccatagacgtcgaggttggagtcgccggtggagggatgcagggcagagaggtcggaggcggccggattcggtggtccatggtgagagatggggaaaaggggaggcaaccgttggtgggctcctgggcctcaccaccgacggggagaccgtcgccgccgatgcccccgtggccacgaggccggctgctactgccggtaaccatgaccataataaataataacaagaagcgtaaaaaggaacattacaagatcaactaaaatttagaataacaaatttaattaaattagaaattaaattactatatcaattgatagaatctgtcgtactaattttccagtcacaaattacaactcaccattatcagctttactgttgtcaatgataaatggcctataaagttgtagggatttatgtgtacatgttatttgtcaatcgtcgttagactctcgtctagtctcattagccattagaagctttatcgatcaccgatattgtagcaaggtgatacaattaacccaacacaattcgtggcctctaaatagctaggattcggtcatcatataattattaataaacagaaaaatgaaggacgacatgacaacaagtttcatgccgcaacgagcttcttcttcattcaccactacagcaacactttggactgcgagaatagacctccaaaggcaatgcctccataagaaaatggaacacgcacgcgccatccttgccatgatccaactagcaaaggccatactattggtttttacctagaataattttatcatccttgagaagatatcgagaggtaccatattaaaagtgagaacactagcatctgtagagacctcagcaactaaaatattttgttgattgcaaatctcaaagatccttgggaagcaagttttctgagggcaagtgccataccacgcatcatgccaaaaccaaatgtggtctccccttcccaaagacctttctgaacctaatcttatccatttcctgatattcataatccccttctagaactaggatccagaatctggacattgaaaaaccccagaattcctcacatactttttcctcaaaagctcaacacacaaactcttatccagggactctatttttatcaaccatttagcaatcaaggcaatgtttaaagctcttgtttcagtgagactcaaaccaccaaaatcctttggaaaggctagatcagtccacttaatcatatgatatttcctagaatgtttgtcaccagcccagtagtatctacctcttatactgtcaaaactctgatgaatcccttcagggagctgatgcatcgccggtagtgagaggagggttggcatgcgagggttttggtatagtctgcatatcgcctcctggaccccttgtcagagggatcgattctcatatattgccatctttggttgctgttttttttgtttgaacatgatttattatcatcatattattgtgatgggagcagttttggagatgggctgcatttgagcaaacttaaattgagatagctcaatttgggcacatgttttcattgtggatgttgacggttgttatcgatcagtttcgaccatcaatattactaaaacaggagagaattggtgatgcttgcaatgcatatgtttgttaaaataataatattccactagtattaggtctactaacctttttacagagaatgacaacaaagtggaggagaatcgacatcaacacaaacgataaatcaatcggacgatgtcgacaaccaaacttatgtatgaatgggccaagaacttagaattgacacgatgaattgggccaaagttcacaagtctgcagagtggagcaatagaggaagtcgctagccgaagatgggctggtttgggccagcccatggttcggccgaaccagggggttcggccgaacccccatctccaccgttgaggccagggtttggcatggacgtccaagatttcaccccaatgacggttggagggtacttcggacaattccccttccataaccgtcatacctacctctatataaagagcttactctcttcacttcaacacacacctcaagcaagagctctatcattcctctcaagtttagtttagtagtatctagctggtggaatagaattagaatagaaatcaggagtccggaagccttcggaagagttcgggtatggctctagtagctttccttttctcttttgtaagctttgtacttttattagaatactcttctaaatacattccgggtattgaaatactttccgagtatatgagtacctactttacattatgttcaagttatactgaatatactgctagcttacctggaagatcctttggtacgggtatagtgtttgcttatgcaattactctatgtcataataatgacattagagtagtatctggtagtttacacatggtgtctaaattacgggatatcattatttggggttatatattgcggatgagaggtgggccgctgatggtgacagctcagtacgggtattcctccgcgcctatatataatcctaagttaatttcctggggagggtattcctccatatttagccccggttggatggtcatgacgggctgtcataaggaactcgacagtcaggggtggcttctcgaagtaccaggagggcattggatagagggtattggctagtatatcagttaactagaatgtatgtatactatgtatattagaagtataggaatagattctctttctcttttctttccacctagcttagattatttattattatgaggataagtagtaatgcttgtgtgtcactctacccttggattatattaacccctgcttagaatatgattatcacaagtaatatataaattattagttgagttctctctacatgatctttccacgggataaaacaaatacgatacccttggaatactctcgagtgaaatgctacaatggtatatccgtgcgcctgcggatgaactctgtaagcataatataccagaagtgtttctacgccattgctgggaattatatttctagtaatgtcgttaagaaataccaacagtggatatgataaattctttcttaatatttggtcataaatgttttaattacaatagaatgtagtcatctatatattgaaacataattttgagcatgtacgagctgttgcctccaactgttttaacttaaccaaactttggtaacttgtactcttaaagtgtacacaaaattgtgaaagatctcatacctaaaatttttcaaacactacctatagattcaaaaacttcaagaagttttatggtaactggttaagtagatgtgaagactgaagaatcttcggctgcgtggagcttgggtgatcaggaggagcagagggcatgccgagagatgctgagatcggtattcaggagccagttatagtgatggggccagatggaggccgaaggtgatgatgaagaggaaggcatgtcgattcagctccgggcatgtcaacgatcgatcgaggatgcactagtgagtgaagatcagagaagaagaacaggtaaggaagtttattattatctctcattaacagtaacactgctatcctgatgttatgttttcgagtgaagatgcaaattttgtgtggcaattccttgtactcaccaaaattctatgatattaattgatacactttcttgttgtctatttttttattacattagcttcactgccacagaaaaggcaatttataccagtttagaaaaggaattagtgccaacaccatatttgtacgcattatgaatgtggattgagaatctgtcctattgagatcggtgagcaaaatataaatgaatcaatgaagcttgaattatggaaacacgatgcggacccgtgcatagatctagccatcaccacctacctattggcggtcggattcgacaaagtcaaggatagtggtgtagagtctccccgcttctcacctgagtatccaacacttgctgctgtgaaaaagtttgtccgcccgccactgttgtgctagtcgccccatgtgcggatctgttcgttgtgagctcatggaggtcggatctaaccgcccccgagcttgtggtagctagatccggcgaattcctcctctccacactccctccatctacccctcctttttt

SEQ ID NO: 10221 - DNA, 2492 bp, Oryza sativa
  unsure (1)..(2492): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacccgtccgccgacgctgccgccgagccgtactccacggcggcgcacgggcacgggcacggcaggtacgcgtacgcgccgtcgccgctggcgcggtggaagatgctgggctcggcgggcacgccgcggcggcacgagtacttctccggcgagtaccggtggtgctacccgacgccggtgcgcgagggcatctacagcctcgccacggacgccaaccgcctcaccaccatcttcagcgaggagaatcccaacgcctgtgccatcgtctgaccaagaaattcacaattgtcagagaataatcaaaagttcttcttaggggacaaactatatatatataactagtgattagaggaatatgatgctttcagcgttttaatttgtagataaggttggtgacagtagtgtgagtggagtagcagtagtagctttagttggtgaaatggacctgttctaatgtttcggcttatattctcattgtcccatgcatactggcttttgttagcacgagtacttttgttaaccaagttggcagtgttaattaagtaggtctagaaatagaatttgatcagcaccaacagtttttaccagggagaacgaaaggattgatgcatatggatatatatgatgctcattattctatacccatcatctaatttggcccgaaatttatatatgtaaaaggagatgcttcgttatcccctactctactcgcagacttcatctgactttgcttgataatggcagagagaggagcacagtacgtgggactttgcatgattaacgagtaaatttcactttatgccacctttaataaccaaagttttacaataaactaaggctcaacctatattttcatatactaacatcacacatagttacacttcattgcaccttggaccggggtttacaacatagattagcacaataataagatatgtagctggttatatactacatcctatcaaataaatcaaatggtatttcattacaccgggcaaatagcaaatacttttgcagcacactaaaccctgcttggcacacctctgcattataatccaaagctgattttgaattttattttttttattttaagattggttttatgtgtttttttttgttacttttggtgcccgttgtttgtatgactgctgagaagacaagtaaaaaaatatatatctaatgtaattcttaaaactcaaacttcaaaattcgaattgaattgagttggattataatctaaaggagttccaaagcagagccactggtatgttgcgccagtatacctttcatgttctgttattttcaaccaatatacctttcaacattgttatgttgcaccaacaataatgctagagatctaaactctataacatctttgataacttcaccactaaatatatatatagttttgtgatacggtgccttaaatatgtagttccgtgaaacgttcgatgataaatatatagttttgtgatatacattcttaaatcagtttgcgacgagctcacctctggccctctgctaccttctgtttgctcctccggtgacgcgaccgcagctacttgctccgccggcaccccgccactgcttgctccgcggacagcactgccgcttgctgtgccgccgtcgccgctcattgtgtgacgttcaagccctgctcgctcctttgccgccgctgcttgcttcaccagcttcgctgcttgcgccgacgaagccctcggctagggtttggagctacatttggggctgattaacaaagataatagttattgtttcctcgtgtaaaaatatagataatatatattacggagcacacacacgtgagctacccgctactccctccgtccctaaatataagggattttcgttggatgtgatacatcctagcacagcgaatttggacaggctctatatctagattcattatattagaatgtgtcacatccaaccaaaatcccttatatttagggatggaaggagtagtattcatgtgcaaagaatagtgctggctgtagcaatattattatcaaaaaaataaatnagaatgagaaaaataagaagatggaacaatngaaagatataagggtaaaaattttaagttcacatcaattactataaagaacattttaattatatta

SEQ ID NO: 10222 - DNA, 5041 bp, Oryza sativa
  unsure (1)..(5041): unsure at all n locations
gatggtcnnnnnaagtagactctctgtnnnnnnnnnnnnnnnnnnnnnnnnnnnnnnnnnnaaatttctcacctcttttgacccaaaaatttaaaatattgccttcagtgtcctatagccaattacataatttttgtagtgtccatcagccgtgtcacgtttttgcggtgtctcccaaccaattacacgtttttttgagtatcctgtagcaaattttgcctttaggtagacaaaagatgttttgttttgaataaaaaagaaacaatttaactagattattttttagagagaatccatcgtgggccgctgactttgtccatgttctataatatgccactgagtttgttaagttctacagtatgtcattgtattttgcttaaattctataatataccgtcaccgtccatttagattccgttagtactgtacaatttgtcctaatgattgaaatatccctaggaaaagaattccaaaatttggccgaaaattcccaaatatcatattataaaccaggcagagaagttgcccatctcaaactttgtaagttttacaatctatatgataaaattgtacaatgctaacagaagttaactagacgacgatggtatgttatagaagttaagcaaaatgtgataccatgttagaacttgacaaacccaacgacatatcatagagcacggacaaaatcaatgacacacaatggattatctttattttttatggttgttcggttaactgcttatctactatgatacggcatttttagaaaaaagaaggttaaatcttatactataagtccatatcttacacattaaattgcatacacttataatataattttcaaattataaaatgccctattctcattttataggagaaatatgcttatctactatgatacggcatttttagaaaaaagaaggttaaatcttatactataagtccatatcttacacattaaattgcatacacttataatataattttcaaattataaaatgccctattctcattttataggagaaatatggaagaatgatttattatctatttaattaactttacattcccgacctcaacggcaatcataacaatagtgtgcatcacgatagaagaggagaaaaagacatgtcatataaaggcaaagcggaggaacaatggtggctcatggagaaagagcggtgatggcagtacgtagagtggcagcggttgctggtggtatgaggaatttatcgtcgacacaatcgtcatttaaatattgataatatgtgggtcaccagttatataaataaatagtactagctagttttaaaatagtaaaaatattgagatactagtccaatgcccgtgcgttgcaacaggtcttaaataacgtgaaaacgtaataaacttatgcattattgttctataaatgtatttgtgaatacaataatagttactctaaaaaacattcaaatgatatcaatcaactataacactatgaattggacaatctaaattgcaaaacatatacaatgaatttaaaaattgataatagactacatttagtgagcgaattatagaaaatatgcaattagaatatagtcagattgtatggcaaacagaattttgcagttttatggtttggagctaaaacttgggcttgtgcgggcctgcgttttgagataaattaagctagtaatgtgtgatatcatgcataaatcgctctgaactttaatagtctgaaacttgcacatgtattgattctgaaatctgaacatgggcgtgcaattttttgtcaacctatctgcacagatagctaccatccactttgaaggaagatctgacgatgatataccatagtgcatctatcactgcatattagttgtataacagaacacaggtgaacacacaactgcatggatcaacatcctcccgttcaccgagatgatctccaagctttatcaagtcccataactgaagatgtccaaatctggcactgcaggttatactatactatacctgtgtatcacgttcaaactatgatatatcagattataacatcagatacaattgtttgaggaaagcaaaacaaaatagcaaatccaggattcaagggaatcctgatacagtagagcgcaatgatgctatttcatctggctaacaccagcatccatgacttttaacccattaacagaggcagaccagctcaaatttacagcatatcccagagtctgattacatattttggatacataaactcctgcttatatcccattcctccaagctgattttagtgcatgtgtttaaaaccatgaaaataagtatcaagtcaaataataaccatgaatataattttcaaacaatcacgaaaggatcttgagtataatacatctatgtaagtgttgttcttgctagctggccctttcaccatgacagcaaagaatcgatggcaacatagattttttttttataaagcaacaactaagagtttttttaccacaagcagtggaggcagccattcattaagttttagaagaagcacaagtacacgcccttgtttacctaagtattggggggaacaatatcaaattcatcacaaagaagaaaacaaagtgcttgcagcacccccttcactaataacgatcgacatagcaatgtatggccatgtacctcagtaataaggtagaaattttattcaaccagcttctcgttgaagttcctcacctccatccttgatcaccgagaaatcagatgcctgcaaaaagcaataaatggtcagcatggtcaacatttcttatcaaggcaaaacactataatgaacatatagtgggcagactattgtactcatgttgacctacgcctccacaccatgccgcctcatatcaaaaaatgttttcatttgtacgacaattgcgcactacatttttaggaacatcaataagatattaatattaccttcattcaattcatatccacacaaaaaataaagaatctctgcatgtccattttaacaaaatgattagctgctagctcatcttgttcttgaaaatattttatcctattctgtctgagagaggcaatagagaactgaggatatacaaaatgatatgaacatattaatttagattgcagcactaaaacacactatatctagtgttgtggctgtcaataaccacctaatatgtgccttatggaattggaagcaatgaaccaatgagatcaaatcagtggtggaacaaaattagtttatcctaaacagttataggaacaaaactatatataaattattacttctagaagcaaccaagtatactttttgaaacagagtcttgccattttgccatagaaagtgtgctttagtagcccttcaaaaatatttttttcacttgtccagtatgcatactgtcagctgaaaagagttcattactaaccttgaataatattgaaagcactattcagaaaaggttaatcttttaagtgaggatggattatagttggactaaccatcttcctttgtcattttgatacagtatagtttaattgttgttgatctaccgtgtcaaatatagtgcatgcgacatcatgtaaagaatacagccttaccctctgagttgttattcaggtcatttctcatatatttattctattaggactttcaactttacgtgatgcatcaacatatattaattgttattatgaagataaaacatggcagcatatgcattcagcagaacttacctagaactatattatattggagagatagatggcatgagggatgagtctagtcgccaacctagtcacgtccagccgggatcgatttgcagccgccggggagagagtggagaggcgatacggtgtgcgatggtggtggaggtggtcgaaggggagagagcggagcggagatgcagaggaaggcgtctactttgaagctgctcaattaatttatccctagacaattcagaggaaccaaaataatcatttgtaaactgaaatgagattaaaatgcagatggaaacacacagacatatccaaggagtggatgctatagcagaaaaagacagattttataacgatggcatcaaatgtagacaaatatccacatatgaaatgcattctccatcagttcaaattacctcaatactgtatagaactattgatagagccgcaagaaagcatgcattttttttccgtaagagacagatgaactattcagatatatagggaggatttagcactattagacagtgaaaccaaacaatgtccatcagctttaagttaggttggacaccataccaggtggaggtgtaggggaggggggaagcgggtggctcccgtcgatccggcggtggcacaggtggagcggctgcgcagccgatggaggaggtcggttggaggctccctatgacggcgcaggtggagcggctggcggctcccgtcgatccggcggtggcataggttgagcggcagcgcagccgatggaggaggtcggagtgcgtaaaatttcaggtcaacgcattctccctcatctgccaagcaaaagcataaaaacttgatgtataatataagaagtaaaactgaaacaaagatagaaagcaatatgaaccatgagtatgtctagataacagagaaacctactcagatttgctatttaaatttggttgagataaatgcatattacaaataattaagggaggcagagctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtccgaaccgattcaaagggcgct

SEQ ID NO: 10223 - DNA, 7615 bp, Oryza sativa
  unsure (1)..(7615): unsure at all n locations
tctgggctncnatagtagacatctnnnnnnnnnnnnnnnnnnnnnnnnnnnnnnnnnnnnnnnnttgatctatatcacaaaatagtcgtatgaatgaaaaaattataggctcaatcacacacaagtgataaaattactcacaggtgaatcaaactagaaaagaaaaaaaatgattcagccaaaaatctatctgttggctttgctagatcttgttataaggatgaagagaacggtctgtgtcttgtgactagtagtggagagagcaaccgagtggcaagcagtagccgacgatggaatcatggaaggatgtagtggtgtggtatagagatgagctcgacgttgcgcagtaacagccatccatcatctagcaagcacgaaaaaaaagcaaaaacattctcgttcatgtcaatagagataacgagcaaaagaaaaatagtaaacaacctccatcaccggcgtactctaccctatcctctgcggccagcaacatggagcatgatgtgcaaatgtaggacctgtacaacccatcaattgagattaggtaatattggagattgcacgtcaatttgatttgcaaaaaaaaaaaaaattgggccttcatgcgtgaagtagaaggagagtatgcagatacaaatcagagtgtcatttccttacttgcttgttctattaatatcgccgacgtggagtagccgctagttcttgctattggcccaggtgaacaccttcttgctggttaaggtgctgcccaacgtccggcagtgaggctcgaagcagtgctttcgcctcaactgccgccggccaccgctcgccggccgccgccatcaactgccatggtgtcgtcgtcctcctccatagtgtgtcgacgatctgtgggctggaatggttgatcgatttagatccgcaaaaaaggaaaaaaggaagtgggggcgagagtggttggttgggtacggaaaaaaatgaatatatatcgcaaggagagaagttgtttttatcgaagtaaatcatttactccaataatggtgggagcacgatgcagaacgtggggtgggatcgaaagcaggggagttgtttttattatcgaagtaaatcgtttactcgaataaaggcgggtggttgaggcgtacgataggagtaaatcgtttacttcgataacggtgggagtgggatgacgggacgtggggtggggtgggcctgggctgatgcatgtttggctcttggaatagctgtgctcctaatagtagttctgactaatataatttttttttgttgtaacatattataatatattttcttttaacccaaatcatgccatgtgcattttgctattccctccattgaaaactacttgttgttctacttttatcctaaaccaaacatttacagtttaatcgttaaatttctatatattcatataggttaacattataggttttatgtttttatgaccatgagaaatattttcataatatatgttgttaaactacatgaatttttaaaattggtggttaaagatagatgtctaagtcatattacaaagcagtggtttagttgtggatttatgggtgtatggttctactcacgaggatttaaattctagtgcttagattcaaatctttacgcccacaaatacgttttcaacggaaatttagtaagatgaaggatgtgatgctctagttgaacgtgtgtgagtgggcatatttaaaggaccgttagtgtggtgcgacatgttagcggtgtttgtgcgtatacgtctacagtgtaattgaaaaacaaaaagaaagaggagtaatttaaacggaaggaagttgtaatttttaaagactagctagttatatgctcatgccttgcaattttttttttattcgtttagtgaatggtaggtttattggttttctatattattattattccattttttttgataaatctgtttttaggaggaagtgagaagaagagggataggaggacgactttttaaagtagcggagaaatggtgggagcagacgggcacgccggaattgcgcgttgccgcaagcgtgcagcttgcaaatactctttgcgacttgcgagcccattacttatatatatatatgtatatataatatgtacatatacatatatgtgaaatttatatggtactaccgggagtccctccctatgcgccctcaattcgatcgctactaatgccaatgccaatgactgttaccgggtctaatgaatcgaatactcccgtccgtttttatttttctcggtggtcaacagaaggtcgtttatcttctacagtagatccaaaaattgaacgaagcctcccgagtttgttgtagatatgaaatttgaaacttgtgtttgtttatccaaagcgagaaagcaggatatttcttccgtcgttaaggaagagcagaacattatcgatctaaaattgttctctgcgtttggagggttcataacccaactgaagtcagatttgtagccgccggcgaagccctagtatggaggattccagttccaaggtttgctatcatattcatctgttattttttcatcttttggattcttttcctgatctcgattcctttattgatagtttctgctcctaattcgctttctttatgttttgcatttgtagcaactttgcagtcctgcagcaggtgcaaatgtatcaggtggtggtggctctagttctgttttcaccagaaactatcatgctggtgtaaatgtaattaggcgataagaaattaagaagtaatgttctgctcccacttctgctgccgtcgtccatgttctgcaacatctctaccaaatctgcaacatgttctgctcctcagaaatcagatagcagatcatgctctgctccaaatgagtgcatgtccatctctaaacccaaaaaaagaagtgatgttctgctcccagttctgccgtgtgccatgatttgctacatctctaaacccaaatacaagcacaagcagaaactacgatccatgttctgctacaagcgcagaagaagcaggaatgttctgctctcgtttctggacgggccttgctctaatagtagattaaatcgtttgaaggaccagaagctattctattacatatccatagtttaaggaacgggagattagcttctgctgcatgcgcatgcatacttctctgatgcagattagtttctgccattttttttagttgatgctctgccaattttttctgttggctctaataaatatcttctgctggctagtagcagaaaatcaatttgaaaagagcagaacatcaacaatttcatgtgccgccaaacagctgatgttctgcttcctttcaaacagaatctctgctcgatcttgtgctctctttccagttctattctgctcctaattggatgagcagaatatcttctgtccgcttaaatttttttcatgtgagcagaatatcttctgtccgcgttttttttttcatgttctgctcctttcccgattcacattatgttctgccaacgatattttcaaaacagttatgttctgccatttttttagctgacgttctaccggtttttaaaattggtttgcatgcaaccgatgatttagaaattatttgaactaactacaagctaaaattttgtgcaaatattattggattatggattattccactaacctgatccaataagcggagggagtaactactcccggtagtagcaaataggtaggtatatatatatgtatatatatatatatatatattacacacttgcatatatgtgtacactatatgtatatctatatctatatataaagtattttttttaatttagttctgttgccttctcgtattgttgtatcatcaggaagtagtatgaacctcttataattctgctgcaccaggaaatggacgatattgtcctcggtttgtttcacgatgtgttcactttgcgcaaagaaatgaatccagtattgaatttgttgtgctgacggcacaactgaatctccattctccaacggggaaaaggaatgtgtgtgagcaacgttcaaaggaggaacaaaattgaactataaacagtacttacaaagtccacgcactgagaatagagacgtcgagggcctttaagtggtataagtcgaagacttctttgtggcggatccaaataacatcttctccttggtaataatctgagtttcgcaccctagctccgaacatctctctacccatcactgatttgtccatgtaccattgatggaaccggtacatctgtgtaggtagctctctgatcttatcaggcgtgactagcggttcaccgagtttaaacatgtacatgaccggagccgtttcgataggtgcgtcctctagcaactgctccatactctgtcccgtatctttcaagaagttgcatatctctagttgtgccggttctacgacgaatggttcaacctcttgtcgtggctgttgccccagctgagggacttcctttctgcacttcactgctgcaaggttggcttgaagagccttcctcaatgttcgatcatagtcagaaacttcgaccggtttgcccggttcggccatcttaataaagtgatcctaaacctccggggctatagggatcttcttttctggactacgtggcttcaactgctccctaacttccgctctaacggcttcatcgagctcctccggagtcaagtcgtacgcccttttcttgagagcggggagccgtggctcgtcagatttggctttcttcttcggccttgacggtgcgggttcatatgggcgggaccttgacggcgtagacttggtagcaggtgcacgcggaggagtagttgcccgcgggcccgacggtgcagacttggcagctggtgcacgcggaggaggtggtggtgcaggggaaggagccggaggagattgacgagccggtgatggcggaggagactgtgcttgcggcggggaaggaggagcgggcagctgttcttgcccgggaaacacgatgtacttcttacgccagagtatgatggcgtgggctgtgtctccaagtctcttctccccgtctcctcctgggatgtcaagctcgagatcctcgtaggttcgttccaccagctctatctcgaccttcgcatatccatgtggaatgggcctgcaatggtatgtacccgaaaggtccgtgggtatggccatgcccaacgcgaccttcacaagaaatatagttcattaattactaatcaacatatatatgtaacaaatttcgcatttcgcataccttgatagacaagttcctgaagggagtatgcatatcgcagggtgttcgctgcgtgatatcatcaacggggaagtgggttgcttcgtgagctgccactgccttaataccctctgatccaacttggcccgttgatgcgcagctgctgcggttgcgcgaggggctcaccatgacgggcgcttgtgtttccattccgcgctgctcggccaggcgttggtccacctgtcttgtcacctcctcttgcatccttgcctcataggtggacaccctgtactcaagatcgacgatcttagcctctgtatccctcttgctcctcatccgactcctatacatgtggatgtcctctttgaatccatatttccaaggaaggacacctttcccttgcgttcgtcctggatgctcagcattctgtagtgcgagggtgagctcgtccttctctctgtcgggctggaaagtcccctgtgtagaggcttcaattgcatccgcaagtcggcgtgctgcatcttgaatctcatcgccgaatatgagggagccatcacctagattgagcgatccatcgtgtgtatagaaccagttccttgatcgctcaggccaattagccgtggccggctcgataccccttgctatcaagtcggcttccaacttgtcccacttggggattgcctttccatatccgcctgacccaagccggcgatggtatttcttcctagctgcattggctttgttcttttctatctgtgcttgcccttgcgctccagtcttgtatgccacaaacgcatcccagtgatcccttagcttgttatgcacgttgaaatcaggtgtcaagcccttgaggatgtatctcttgtacagatctgatttgtagctctggaatagttctgccattttcttcaggggccattctttgcatctgggacgatctgcatcagggatcgtgaatgtctccaagatggtggtccacaacatgtccttctctgtgtcagggagaaagctatcttcatccccgcgtgacctagttcgacgccagtacactatgctgatggggacgttgtctctcacgacccaaccacaatgattcacaaactttcgtcctatacccgccggggctactggttcgccgtctggggcaatctcagtaacgatgtgccttccctccagcttcttcgcgggacctcttttcccgcgtggcctcttctatccggccgacggttgactatcagtcccctcttggttagcctcctggttaccctcatcgttgccctcctcgttcaggtattggttgggatcctcgtttccctcctcatccacctagtactgactgctgccctctgcgatcgtgtctaacaggatttgttcgtcatcgcagtctgccatctgtacgtgcaaagaaaaaaagacagtgaggtcatgcacatcgacatgtacaggtcatacgtctaaaccctacaattatacatgtataattcactaagtcgttgttctcgttaagtcgttaagtcgctaagacgttgttctcgctaagtcgctaagtcgtcgttcgtcaaagtcgctaagtcgtcgttcgtgaaagtcgctaagtcgctaagtcgctaagtcgctaagacgtcgttctcgctaagtcgctaagtcgtccatctcgttaagtcgctaagtcatcgttcactaaaacgttctcgttcaaacgttcgaccgtgagtgttttcgttcaagctgtgtcggcggcggcagtgggcggcgtcggtgttggcggcggtgacggcggcggcgttgttggcgtcgacggcgcgcagcggcggctgtgcaggccgacgcggttggcagcggtggagtcggcgcgcggcggtggcggcggcagcggtggattcggcgcgaggtggcggcggtggagtccgcgcgcagcggtggattattccgcgcgaggtggcggcggtggagtcagcgacggcgatggcaaagtacgatggtgccggcaacgatgatggcggcgaggtccggtcggccggcgcgtgtcaagtttgagagagacagagagagaatgcgagatcagaggcgcaagatttgcgccctcaccttgagggaggcgacgcgctgccggtggcgttggggagggtggctgagctcggcgagcacgacgacgacgacggcggagacggtggcggcgtctagggcggtgatggcgcgcgaggaagaagatcgatcgtggagaagtctaagtgtggcgcggggaagccgatgcagtggatatttaaacccggtcatctttcgtcctggttcgtggcttcaaccgggactaaagatatctttagtctcggttggtattaacaaccaggagtaaagaacaaatgtttactcgggtaccgagctctaatacagcgtctt

SEQ ID NO: 10224 - DNA, 11069 bp, Oryza sativa
  unsure (1)..(11069): unsure at all n locations
gagtgttgattactactcgcatctcgcagcctgcagtctggtctatagatccccccgggactaaagatatcgatatctttagtcccggttgaagccacgaaccgggacgaaagatattttcccgctatttcaaaatttgtattggtcccggctactgttaataaccgggactaaagatgtttacacaaaaccgagttatggcctttttaaattgtcttacaagtcgaaataaataccaataaatccaatataattagcacatggccgatttatatggtttcaaagtccaaataaatacgaaaaatcgtctgtaatttacgtatggccgaattaaatgttttcaaaattttaataaatagaaataaacatatataattaacataatacctaagtaaatggtctcaaagtataaataaataaaaataatcatttataattaacataaggccaatttaattctactcaaagtgtaaataaatagaaattatcatttatgattaagatatggcctacttaattgttttcaaagtgtaaataaataccaataatcatttataaataataacatattgccgaattaattgtattcaaagtgtaaataaatggaagtaaccatttataaatatcatatgacctatttaaatggttgaaaaatagtaatacattacaaattaagtagttgagaataatatattgatccaaattgttcgaccttcaatacaatacaaataatttacatcttccatcaaacaacctatgtcactgtcttcctcacgtactttctcctcactattgttcctttgctatgatcgttgcgtgagtacggcgtgtcctccttactacaaatgggaaattcatgagaaaacacaagggactgcacttattacatgagaccacatatcactcgatatacagataggaaagccacacaagtccaaatccatgagcatagacacaaccattatgctcaaccatagtgccaaaacacacacagaggcagaatatatacaaatgcacaccacacatatatagcagacagaaacacacaattaagtagtagcaaaccaaacctcatgagcacccaaatgcaaaccgataatgggagggacacgatggtgattcccttcagctcgacgtccggtgccgacgcttgtccttggggatgaataggcagcatggcgcaccgtgtacttctttcacctggttagggtgtataatgaattttatctttatgcgactctatcggctgcgagaagtcatcacatcgaggaggaagaacaactagttgctcctgctatcccagtaagttttcctttgtttcaacaattacatcggctataatttacccaactcttactccttctgaaatcttttctgcaggttctagccgatctcttctcttttgatatcagagattaccttgatgaagcagaagaagatatttcaagcaaagccttagctcccctatccaatgatgtgagaaaaacactggaagatatctctcatcggctagaagcatcactagataacttggtgaccaactgcggctcgatccgggcgaggttcacagacatccaagctctactctattgttgtataggaggagaagaaggagggggctgtagaatagacaagtgttatatagagccggttgagtttgattaagtaaaagaattaaagatatcttactggtggagccgacttggcaatcgttgctactggctttttcttcacagcagtcttctttttctgcaaccgcaaagtctatgggcaattagccgaagagggaagtacttttagtagaagtcaaaagaggtgcttactcttgtaaaatgaacgggggtagaaggagttggaggcgtttgcttgggtgaagccgatggagttctttctgtgtcacttatctcggctaaagcctggtcaacatcttcaccaatttcctcttcatctaaggcttgttcaatagatggatccaaggcgggcagatcatcagccggcttatcagtcggcttggttttcttgaatttggcttttttctttggagctaagaccaaggtactcacagctgatgatctggttttccttttcttgcctgcattggctggttccctggttaagccgtgaaggagagttgaagtcttggggccatggtagccgatgacagggggagataatccacctccattcaggattaaacctgaagcatattaaatattcttgccactgttactttgatgaggaggggaggactctgttgtctgcaaaacaggagcaaaagattattcaagtaatgaatcggctaactgattatgcagtctagtaatgacaaagtttacctgaggtatgatgtcagggaatagatttgtcatatacatcgtagccgattgatgaaatagatgcagcttctattcaccccaccatctgtcaaagtttttgcttctaaatcctgccaactcaatattttcaatgctacccagagaaggtcctggtaggttaagtagccgatccatcattaaagtggacgtgatttgtcctcggcactgaattttgtcggcaaagaataagccgattgggagttggcccaatccaagttgcctggccgagctcattgggtgatagaactcataggagacttggatatttctcccttgatgaatgccgacaggaaggatgcatgggctgattgcagctgtaagaacttctctggatttttggaatttctcatgattaatatcttcaaatctaaaatccgatggaagttcaagatctactgagtcttcataaggaaaccagattcgtgcatctttcttaaaaccttcgtagaagctgcagaaccagtccttgagcagcttggctgatagttttgctccagcatcagttggtgtggatgcatatgctccatatgacatacatctgcgatgggtgcgctcttctccgtcatcttctacaatcggctctggcaatgggaactcagcttctgttacatagggccgattgacaaccttcatgactatcagatttaaccaagtttgcagcagccaccatggtccacctgctccgactattgagccgacggctattttagccgatgcattgttcaacatttgatacagatagccgagaagaattttgcccaaagggaattctttctttgattctagggcttcggctacaaattgccagttggttgtagggccacaactggatccacagaagaggaatttttccagccacatgagcaagaaagctacatgctctcgaggggtaacatatccttggcccatatatgccgccacatagccagactagccacctatgtttttggtcttaaagtcaaattggttcttggtgttcatgctcatggggttagccgatgaagtcacatctaatccagtaatcatggtgatgtcgattaaagtcggagtcatcggtccttggttgaataagaaagcattgatggtatttgaccagaagtaggtggcggcagtcatcagatgttcatccttagcagaattggctgtggtgagagcaagcgcttggccgattctaatctcatcccagtgaactttcttactagccgatacacgttggtaccaagtgatccagctcttatcaggtgtaggtttttcaagagatggccaagatttgaaggtattcttctagtgacccaggttagggttggctagcctaaaggggatccggttggtttcaccaatgatgaaatgagtggggtcgagattgccgatcgggccaagaaaatagtggtttttgtgcgaaaggctgggaatcgcgacttggttggagagatgctacaaatccaagacaaccgagagaaagagagcggtataatataggagaaaatcgatctgctgctaagaaaggggatctagccgatggggacttacctcagcgtactcagctgatggcgcatcagatggattggtggaagacgacatcactgcaggcggaggtatcgccggagacaaagtcgcccgggagtcgcttttgcgtcggaggaatcgccggagagagaggataaagtttcgcttgagcggtgaaaacggaagtcacggtgtgagatttctcgagggtgacggttagtatttaaagcacggcaataatggtcggaaaacgacaaagtgcgaaagttgctcggagtcgatttatagcaaatccgaaacattatcaaatattccggacttggggggcatgtgttaccaacaaaatttggtaacatcggcattgggaaagaagatcagatcgaagcaaagtcggaggcagagatcgagttcgataccagagcagaaatcggctggagtccagatcggctacgataagatcggctgagtctgagtcgggctaggtaagccgatgtagccgatcccgacaatacaacttgatgtgtgatgtcgggttggatcgtggtgctccaaggtgattgccgcacatggatagagtcctgaggaggcaattgtatctattaattaggatgttttatgtaatttccttagagatacgtttgggcaaaagtctgccgcaaagacttatggtatcttagagtttgttagagatagtagtcgtgtccgttatggacgtatattttaattcttgggtataaatagacccgagtcctatgtaacttttaacacacatgttcaatacaatttcggcgcatcgccacccttttgctttagttttgtttcgacgagttcttgctttcgggttgagctgcatcggtttcgatcttcaacaagaggtaaaacttgttatgacgacttgtattctcgggattagtgcttccatctttatgacactctaatcttgtttatgtaattcgtcgagttataatatatcttacataatctctggcaatatcgctatctaacctacaatcggctaacacctatcgaagagggcagccgattaggttagattttgacgttgattcagattatgtaagatatctaccactctatgagacttccagcggcttgattgtctagatattgttcttcttttcatacttaatgctacatcagttgagtttgatatgttaagtcgtgcttagaatatcaatctctagcctgctttctagttgccgattagggtagcatcggagtttcagccgatcttatctgatttaactatatttgctgtgtatgcttcattgacatgttaaatctgcccttcatgtcaagatattgctgtatctaagtatattaggcctttgtttgatatattatacttgttttaatatcctgatacagagtagtatcggagtattagccgagacatgttagatctatctgatcggctatgctataaacatatatagtcctgttattgatatatattttgatctaagtgatttatactgtctcgacatggcgaccgatctatcccaatcacttgatttaagtatatatcgatataaggagtatatattgttaatatctacagccgatcgagtagatttaattccttcttacttattcatgactgccgatcgatacacatatgacatcggctcaaagataaatgatatgtcttcggcacctagccgatcggctatcatttatatatttaaccgcggtttctttgcttctatttatttcttgttgattacaggatcaaatcaactggcacgctcatacattcgaaggcgagctttggacctacattggagttaagcagatctcccaggccacgtgttttctgttaacagctgtgcaaaatgaaaaaggtagcgtgtgttgaggttctggataaaaatgtttgcgactttaacctcttcttttattgtgttggtaaggaccaaagataattcaaaaaaaatcttttctacaaactccttaatcagaaatatctgattattaattaggtgaatcgtgttatcttatccatagatttatttttcaaacatgtctttaaagttgggggcctaataaatcccaacaaaatagcagtttaatatgtatatatattgccaatcccgttgcgtgcaaacttatgtcacacgtacgtacattgtcttcagcaacttgttgctgtaggtacatgcatatttcttgagattatacggaccccttcaaataaacgtgatgtgttatttttaggtcttgcatcaatcgataaatatttgatcttgaactcagttgctcattaattgttttttaactcttacacacccatttgtattcatgatagatactttgtgatgaaggcgaagcaatgagtggcaaggagacatcgcgatgagatggcgctattggtgatgagtggctttatggcgtagaggagcaacaacagccgccatctttgccacgacccgccgctatgtgcctgcgtagggaattgcgatagggtgcagccgctattgggatcgggagtgggagatttgggaatctgggtttactatttacatggtttgtttactcaactcaatgggctagttaggcctatattattgtaatgtgctatttttagggaggtaacttctaccccaaggccccgcctggtctcccatagggtgaaattctccccaattcctaaccccatagtggggggtcaccggtcccaacggagaaattaccacccctaaacatgtggatgtagttgtcctctatatataagagtatgttttctggtagaggtggatactacttgtaatttcatgcataccatatattaataaatttagagcaaacgtacattagattgtctctaatatacaatctccaataactctaatattctcacatttttattggagttttttattggagtttgtgtatgggttactccttatatgagaggtggctctttctgtttctgtctcttcattcttgtctcctccaccttaccatttagtcttatatgtcatcttgagttttgtgtttagatgaccatagcacttgctctaatatctaatatttaagcaaaatattggatcaattgtgcatgtactaattattgagcattcccgggaattccatgttaattaaaaacgttgccgccggctagtaggatcaataagcacgaccatagatcgcattacgaatctttcttaaggatctctttgaatcgcaggaatggaaaaacagagaaataggaaaaatatatgattctgacatgaataaatgtgtaaaacagaggattgaaaaatacaaaaaaaaacataggaatgaccgtttgaatagaccatatgaaaaacgcaggaatcggatgacagagatagattcaaaggaatttttcaatgaggttagagctcttgctaacattctccaaaatctctataggattatccattccgtaggaattttaaagaataggatatgattcaatcctttgcttcaaaggcttccacaagaatttttttcgtattattaaaatcctccaaagttcctacgcttttcctggaaatcaatggcgccctaaatcaaataggctattgaaaataccgcagattctttagtttctactacaatttcgttttagatgtcattcaatttaataattattaaatccaaaattaataaatatgaaattgtataaatcttactcttaattttgttcctaaatttaaaaattaataattattgtgttataattgacacaacaatatttatttagaatttaaatattatgatactaatcggtagcgctattccgtgctctacagaatattagttcgagcgtcgcacaacaccctctcctttcgggttttccattttttaccaccccacctttccttcgcattccaccttttctcggttctttttttttgtcttttaccactccaccttccatgattcttttttctcttttccatctcatccgtgcttcatcaatgggcccggtaaaatattaaccatccagatttttttgtttttggttccttctctctagtttttcatttttcgcatttcagtaaaatatttaccctgtagtttttcttttccgagttttccatttttctagtacctcagcacgtttcaaaataatgaatttactccgtggaactcctagcctcccacatctgctcattcaaaagtaacaaatttacttgcatgaatgcctccacattgtataacgccatacctagatggtcgtaaagaattactactagattacaacgctagtaattcttttaacaatattataaataatgtttagatttcatggtctgtgagtaaaacaattactatcttcctctcgatatagccctcctctcgatatagcccatgatcttatagccaccgtgtagtaatatgtttactgatgtgttcaatacacagtatacaagtaaaaactgagatttcgtggtctgcgagtaaaacaattaccaccttcctctcgatatagccatgatctcgtagccaccgtggagtaatatgtttactgatgtgttcaatatacggtataagagcaaaaactgatactaagagtattgttgatctgtatcacaaaatagtcgtatgaatgaaaaatttacaggctcaatcacacacaagcgataaaattactcacaggtgaatcaaacttgaaaagaacaaaaatgattcagccaaaaatccatcagtggctttgttggatcttgctataaggattaaaaagcacggtctgtatcttgtgactagtagtggagggcaaccgggttttttaggtgcacatagaatgtttttgttgttaaccagcccaataatgtttacaagttttctcacttgaagttcatcgctacttgaataataagttatgtatataatatgttgtgagattacctatttaggttaaatgaaagagtatgaagggaaacttctaatcagtagtaactaatttgtgtttaatagaatctctggctggcttaaaccacctttgtttgggggtctggctaaacagtatggtcaaaccgactttaatcacatttgtagttcttctcactgtctttaacatcccgcaggccgcatggacttagcaaacgtccacaaagggtatatacttcacggcgcgatcagagctcttctgtccacatttcttgatagtctgtgacgatgtggaatggaagctacccgtttaagaaatcctggtgcctccctctcctagcacaatgaactgctttaatttttgcctcatgacctacctctcggattatttttgcccattccctcatacctctatctcagatatatttggcgagttttgtacgtatcatggtttctcagatttcaaccgtacgttggcaatttgactttttatttcgttatctctcgttttttctttgagctacccctagagttcctggaactagcaactatctaggcttaatttggttgtagcctccatggagactacagaagaagatgcttgatatttatcaccaggacaacacggtaaggatatgagcgcgttgaacaatgaatagcgatctgaccgagccatccaccaactgtccttcagaagtagcttgcgtaggtaaagttgttgttactatgtactcctatagtaatgttagtacaaaattagaacatatttggatctagcatacataattcccactataattagaatgtaaaagaatcaagggggtttgaggtctggagttaatctccctccaaccacttttattatgggattgagcgaacaaaccattactaggatataggagagagatattggacgaaagatatatggacgatcaatttttacatttaagacaaagattttgattgccatggtatagaatttataatcctatctgtgtaattttagctaagaaaatatcgatactctgctgtatgtgaactaatggtaggaagagcgatgaaaaggatcagtcagatcagacaatgacagcgattatgacacgacaaatacggatgaaatcaaacatcctttttgctgagaccggaacttccaatcccataccggaagttccgatttgaatcgaaagttctcttcattctaatattctatgaagttgtgataaattttaggaacgcctattcacctcccccctaggcaacatcaaggttctttcaacgacttctctgtgtccggtatatattctatttttcccataccgaaccaaccactcttgcccccacctcattttttcccttttttttggatctgaatcgatccaccatccctcccacagatcggcgacacaccatggaggaggacgacgacaccgtggtggttgatggcggtggctggtggcggttaaggcgaagacacttcttcgggcctcgctgccagacgctgggaatcaccttaaccagcaaggaggtgttcacctgagccaatagcaacaaccagcgactgctccacgtcggcgatattgatagaacaagcaagtaaggaaatgacactctgatttgcatatgtatactctccttcaacttcatacataaagccccatttttttttttgcaaatcaaattaacatgtaatctccaatattacctgatctcaattgatgggctgcgcaggtcctacatttgcacattgtgctccatgtggctagccgcagaggatagtgtggagtccgccggtgatggaggttgattgctatttttcttttgctcgtcatctctattgacaagaacaagaatgtttttttgcatttttttcgtccttgctagatgatggatggctgctaccacgcaacgtcgagctcatctctataccacatcgctacatccttccatgattccattgtcgactactgctcgcgccatgatcataagcactatataaataatcggaatcttgttaagagaatttttctttaattactcttaattacacaagtagacgtgtaattacattactcttaattacacaagtagacgtgtaattacgtcatgtacacaacttgtaatatactaccatacagtgaagagatttttaagccaattaaaatattcactataagtagaaaattttacatgcaaatattataaatgcagttttgctataaatctgtcgtcaaattttttacttagaannnnnnnnnnnnnnnnnnnnnnnnnnnnnnnnnnnnnnnnngttgtntatcaaaggcacac

SEQ ID NO: 10225 - DNA, 1247 bp, Oryza sativa
  unsure (1)..(1247): unsure at all n locations
atgggnnattgtanattcgtatctcgcattcctgcangtcgactctagaggatcccctttttcttcaaacaatcaaacttctaacttttccatcacatcaaaaattttctacacatataaacttccaacttttctatcatatcggtccaatttcaaccaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccttgggcgggttttacaccggatatgtgccctttcagaccatttgtttgaggccgataataagcaggcccgaaaccgggaaaacccgttaccccccttaggcttggtggtcccggattcctttaaacaaagttgtgaaccgttccggacctgttttgtaaaggtttaaccgtttaccaaaccccgaaaaaagggctcgaaccccctttttatgggaaggcggaaaaaaggttttaaacacaggggccatttgggaaatggcgggacccctatgtttatttcaaacaccaaaatgggcccgtcgggaaaacccgtaaagtctttataggaaagggggagggggtttcaattcggcggcctattcttttgggattggcctgttttctccaaaacggggaaaa

SEQ ID NO: 10226 - DNA, 2576 bp, Oryza sativa
  unsure (1)..(2576): unsure at all n locations
tgggggcgctttgaatgcatgatatacnnnnnnnnnnnnnnnnnnnnnnnnnnnnnnnnnnnnnnnnnnnnnaattccatgttaattaaaaaccttgccgccggttagttggatcaataagcacaaacatagatcgcattatgaatctttcttaagggcccctttgaatcgcatgaatggaaaaatagaggaataggaaaaacacgtgattctaacatgaatgcatgtgtaaaacagaggattgaaaaatacagaaaaaaacatagggatgactatttgattagcccatatgaaaaacgtagaaatcggatgagagagatagactcaaaggaatttttcaatgaggttggacctcttgctaactttctccaaaatctctatgggattatccattccataggaattttaaagcatatgatatgattcaatcatttacttcgaaggctcccataggaattatttttataggattaaaatcctacaaagtttctacacttttcctagaaatcaaaggggccctaaatcaaataggctattgaaaataccacagattctttagtttctactacagtttagttttagatgtcctaaaatttaataattcttaaatccaaaattaataaatatgaaattgtataaatcttactcttaatttagttcctatatttaaaaattaataattacagtgttgtagttgacacagcgatatatgtttacaatctaaatattatgatactaataataattactaataatagtaatagcctgtgcaagacacaggttaacgactagttcaatctaatattctcttttgtcacataacatgtagggtaaattggaaccatgccattataattttacaaagtttgagataggcctaaattaataattactgtgttgtagttgacacaacgatatatgtttagaatctaaatattatgatactaataatagtaatagcctgtgcaacacacaggttgactagttcaatctaattttttcttttgtcacataacatgtattctatgaacaggattttggaggcctggagccaaatttctctacacgtatacatgtgctagcttacatcctatcgatcgactttatgtctgcaactaactcgacgaaatatatggttggcggaccgctcacatggcattgcttgttgtcaaaatgcacccttgtttggttgctttggcgataaatatgagttttgcagaactttcttgttcatcgatgcttgatgaacctgatatgaaccaaaattgaaaccatcttgttgcacgaattcgaattctaggagagacagcaacagaaaataaaagtcagatattagtttgtcgcaggaactctaagaggtcatgaggtaggagagggaggcaccgggaattgccgccctactttcttttcggctcgatcattgaaccccatcagtaaacgatggcagacatgcaagggtggcgcattcaagaattgaggtactggagaggggcataaactaatgcaggcagaattccaagatgatacttcctccgtttcattttataagtcgttttgatttttcaatcaaacttcttttaagtttgataaagtttttaaaaaatatgaatatgcaacggagggggtaatggacaaggctccagtagtagagggttatgtaggtatcagccatatggcaccatttccatccaagctgatgtccttggtacccccgtacacatgggagtggattctaatccctcgaggggatgtcccctcgtgcaaatttttcttttatattcgatgtgaatagtcatgaaaaattttgaaaaaaaataacaatgtagagtatcgtaatatcttctaggccacaaaaatcaaagttcaaattcgatctacacatcgagaaacaaaaaagacaaattcagatataaacaaaatacactactattcatacgccgaatttgtctttttttatatctcgatttgtgtgagttgagtttggactcaagatagatagatctattttataagtgttgccaaaattttctagaatttttcataaccatttaaatggttttaagcaaacaaggggacatctcttcgagggataaaaatattttccccactttcatcctggtctgtatcaacgatctgggcataggaattgctaatggtatttcttgttccctcattctattaatttttttcagttcatcccggcatcatgtatatccattctatttcttttgtttcttttcgatattttttttaaaaaaaatccaagcatgtaaatttcttctattgtctcaaaacaaaataacaacctatgatgccattataccctactatctaagatcatgaaatattttctacctattgatgaaatatttttcaacaagtaatgaatatctgaaataatttttgttaaaatagttttttaataagtaatgcccatctaaacatttcctgcctagtgaggaaatatttctcaacaannnnnnnnnnnnnnnnnnnnnnnnnnnnnnnnnnnnnnnnnnnnnnnnnnnnnnnnnnnnnnnnnnnnnnnnnnnnnnnnnatagtcattcaaccgggc

SEQ ID NO: 10227 - DNA, 2234 bp, Oryza sativa
  unsure (1)..(2234): unsure at all n locations
gtgggtcaataaanattgagtatcgctctcggtaccctgatgaaatatttttcaacaagtaatgaatatctgaaataatttttgttaaaatagttttttaataagtaatgaaacatctaaacatttcctgggtagtgaggaaatatttctcaacaagtgatgaatatctgagataatttttgttaaaatatttgtaacaagtaatgaaacatctgaaacatttatttacacatgacgaaacaccattcgatatttggcaaatatcagacattcgagccgtagcgctccctatagcgtattggttaactatacaacatgcctatgatttgacccccttcccatccactactgccacccatgcggctacaccctcactatggtaccacatgtagttattttgttataggtcatgacattctacgttaaggagctagggatgacactatagcaatgggtgacatgctcaagtcggtgatgagatgcaaacgagcggagtggtcaggatggagtgttccagatctacgatgccatcatcaccttcttgaggtcaccgacttgagatatggtggagtgcggctacccaatcgggtctttttgtccaaacttcaggaggacattggcccccatacttcattttccgcagcataaaaaatgctagttgtatagttgcttcatttttcggtgcatgtatttcatatatgttcagtggatattctcaacctatggatttttccttgattgtgtgggtgttcttgatctacgtggatgttgattctgatgtgttaggttgtcggtgttcttgactatctcattggagggtgacggtgggggtagggggtttgaaagcaatcagcttgaatcgagctgattcattgagcggcatccccttttgttctggctagtgtaaagctatgagtgtcggttcccagtccatcattgctgctggacttagtgccgctaatttggtaccggcgcagcatcatattcggcattgatggtccgtcacaaaccaagacctatgattatttctatagcagtgcttagagctagcagttggctatattggttaaacttgctagaaggccctactaaggggactgagttttctccagtaattttagtgggaatggcatatgctagcttcgatatattctaagttacatactagtacatatacgtaacaacagtaactttgcccctgcaacttactgtgcaaggatggttgttggactgctcacataactactaattgttcaacgcacccttgcattgttgtttcggagataaatactaagcacccttcacctttttctccattcttcatcgaggctacaaccaaagccacctagttgctagttccatgaactctggataacacaaaaaaaaacgtgaaatataaaatcaatggtcggaatctgagaggctacgaccttttgtgacgaatttcttatgacattagagctattcgtcactatgccatttcggtttatgatgttcaataggggtggtgctgattactgatgaaaataaggtgcttgtcactagaccaaatacagatagtcataaactagtccaacgatgtattgtgacgaatatttttttttgtcgtaagagaccaaccagcaaacatcataagttcctaacaatgctggttgattgtgcaagctaccaactccacctacatgctctcttagcctatcctttctataatagccattccaaccaacgttaacaaatgctttgtatccttcctcctttttattccggtccctaaacaagaagcaaaagaaataatatgctctatctttttattccggtccctaaacaagaagcaaaagaaataatatgctctatctttggacttgttgtactcaagccatccaccaaactcatcaaaccatgccggattgaattttctatctttgttagaaataactgatatgggaaaagcatgatcaccaggttggcaaggcccattctctgagtactttcttctcaccttggctctttggttgggatgataatcatcaattcctttccttgagcctggatcatattcgatcgtcttttcccaactggcatcatctagtcgaagggatatgaactccccacattgcttgtacaatctggtgctttccgcttaagaaatttctccatagaaacctattagagacaataaaaattttcaagcttgggtnccgngcacgatatcaaaggcattcaaggggagcgcg
